United States Patent 10,240,205 (METHODS FOR ASSESSING RISK OF DEVELOPING A VIRAL DISEASE USING A GENETIC TEST) - sequence listing, part 16

SEQ ID NO: 1714 - DNA, 50566 bp, Homo sapiens
aagaatattaattaaatgaaggttttatttcaaaattagtcttaagagtataagctgtttttgagggctgtagccagactacataatgagcggtgaaagcggctgccttcccctctcctgacaccagcaagggggaggcaccatcaccggccctgccccatcatgcatccaatgattactagcactagaagccaacggcaaaggaccccgcgcgcttgctcgtgtttaatccaggttaagctatacacgtttaaatacatgtcggaggttacatggtctcatgcagtccctgtgatggaatgactcttgctcagtgacctcctgcagcgaggctgctccaaagggcaaggttaggtagggcagagcactgcaacgagaagagaggaggggagagcggtcagaacacagttgcaggtggggacctccgagccctggatagccctagctgagagcagtcacaccagctcctgagtggtgacagcccccacttagtgcctagaataagggagagacaatggcaggtggttgctggttataataactaagcgtgtagtctccggggcctgagttcaaatcctggatccagccattactaactacatgaccttagggaaattaacttcacctttccatgcttgtttcttcatcaatacaatagaacgtacctgcgcctaccccgcagggttgttgagaggcatgtggcaagtgctgagtaaatattaatcacttgtacaaattcagtgacaactcagtggctcgtgaggggtaaagtccagccctccgactaccaaatttatataacctgtttctataatcctcctttgagaacctcctttgagaaatgtgctgctcttttaaaatctttgagtcacaaaccctttctgtggttttttgtgttttgttgttgttgttgttgttgttttgttttgtggtttgtttgtttgtttttttgagacagggtcttgctgtgtcacccaggctggatgcagtggtgtgatcacagcccccactgcagtctcagctcctgggttcaagtgatcctctcacctcagcctcctgagtagttgggactacaggcgcgcaccactacacctggctgattttttttttaattgagacgcggtctcaccatgttgcccaggctggacaagttatttttaatgtttactctaagttcctcctgctgaaatttaagattagtccttctgatccttatagaaacaatatatctcaggatttcttagctataggtcccacaaatatggtccctctgcaaccgtacatagttttgtgtgcatgcaggacaaaaaacaataaaataatagatctagacagtgagcaatcctcaaggactattaacatcacaaaaggaaagacaatcagacaatatatgtcaccccatggaagtctggaaacctataaccacctataatgtagtgcttatcaaaaaatcggaagctgtatctgatcaggcttccagttctatcagttcacaggcaataaagaagacaggagaacatattaaattacaccatggggatgaaattagcaaaaatccacaatgaggaaattctatggcacaaacaacctagtttctccaacaaatgcatttcaagaaatggaagagagaaagaaaaggggaacctatatacatcaaagagatgtaagagacatattattatctaattgcaacctactgatctttattggcccctgattcaaacaaataaactgaaaaatactttatgggaaaaacagggaatactgattggatagtcagtactaagaaactcttggctgggcacagtggctcattcctgtaatcccagcactttgggaggccaaggcgagtggatcacctgaagtcaggagtttgagaccaccctggccaacatggtgaaaccccgtctctactaaaaatacaaaaattagttgagcatggtggcaggcgcctgtaatcccagctacttaggaggctgaggcaggagaattgcttgaatccaggaggcggaggttgtagtgagctgagatcacgccattgcactccagactgggtgacagagcgagattccatctcaaaaaaaaaaaaaaagaaagaaactcttcatttgttttagttgtgaaatggtattatggctatgttttcctcaagagttcctatgttttagaaatgcataccgaaatagttatgcatgaaaactatgacagagatttgctttaaaataacatgggaggggagaagttgggtagaggcgtaaatgaaataagcctggccgggacttaataactgttgatgccagctcatcagtacctgagagtgtattatgccatttcctctactcttgtatgtacaaccagtttccataagacaaggttaaaaagttatgaaagggtgtagtcaattatgtctccagcttcctttcaagtgcttgaaaagtattaaattatcatcaggttttgtttttcccaactaaatactaagtagcccaaactctgcagaattttcacaataagtcctttgttggtttgttgctccaaggaaagtcactggtgactcgggggtgatggaatctcctcctgcggcctcctggcaacacccaaagggaaaacctattactccaaagcctttcaattgtccctgatttccctggcccctgcctggtctggtctggcatgggcaagctgggaaggttccctaactggagcaggagctccagagaaccccttctgctccaggaggcctggggctgctcttaccttttaaaatgtagtccgttagcaaagtaggcaccttctcattatcctccttcatggcaaagagaactaggaaaggagacagagagaggaactaagataccatctggtcagaggttcacttctagggccacatgacccaccagcccagagtgagagagaaatgattcaaaagaaccagacatttattgagtattgagcaaaagtctagaaggctctatcaggggtcagcatttcaggggcaagggctaaaaaactacctatccggtactatgttcactacctgggtgacaggtttagtttcagttgtaacccagaccttgagcccaggcattcaagaccagcctgggcaatatggcagaacctcatttctaattaaaaaaaaaaaagatagctgggtgtggtggcacacgcctgtagtccaaagtacttgagaggcatcacgcaatatgcccccgtaacaaacctgcacatggtgatagacgagaacacagcaagagccacagtgtttgtctctaggtagtggacctactggtgactttcttttcttttttatttttgagacaggatctcgccctgccacacaggctgaagtgcagtggcgtgttctcagctcactacagcctcaaactcctgggttcaagtaatcctccccctctcagcctcccaagtagctgagacttacaggcacgtgccactatgcccagctaattttttttttttttttagtaaagatgaggttttgccatgttgcccaggctggtcttgaactcctgggctcaagcaatcttccccacttggcctcccaaagtgacctgtgatcatgccactgcactccaacctgggcaacagagtgagactctgtctcaaaaacaagaaaaagaccatcctggacaacatagcaagactttgtctctataaaaaaaaaaaaaaaaaaaaaaaaaagaagaagaggaagaaaagaaaaataagagagagctatatgtacaagacatagttatcagtgaagaaaggttacagaacatttattaactttataattaaatgctaatgttcatagaaaaaaaatctagaacaataatacatgaaactgttaagtagttatctctgagtgtaagacaataggggatgttcttttctatgctgcatttctgtggggtctggcttttctcaatgagcatgtattacttttgtaagccaagaaaacactaaagatcaactggcactgatagctagggtcagaaggcagctgcaacagtgggattgccacttcatttcgatatccttgtcctcctttgattgattaccttgactagtttcaagacagggtaatgaaacttgaatccaagaattaggagtgagtgaggaagaaaatccaatggtggcgtgagtcagcagccaggtccagaaaaagagactcaacctgaggccattgaggggttggtttgtttctgttttatttcttctgtatctttagacatgtattcatctcagcttaagtggattctagggggtcctggtttcttctgggtttttttttttttttgagacggagtttcactcttgtcatccaggctggagtgcagtggtgcgatctcagctcactgcaacctccgcctcccgggttcaagcgattctcctgcctcagcctcccaagtagctgggattacaggcgtgcaccaccacatctggctaattttttgtatttttagtagagatgggggtttcaccatgttggccaggctggtctcaaactcctgacctcaggtgatccacccgcctcggcctcccaaagtgctgggattacaggcgtgagccaccatactcggcctgttttatttttttctgcatttttagacatgccttcatttcagcttagttgtcaagaacactttgcaactgagcataagcagactaaatgccacaccacgaagatcacgtaaaaatacaataattgctcttgccaatacgtatctaaattaatctccaaaatctaaaatttacaaggattggctagtcgcaggagctggtctttggcctatgtacttagttcaaagagtagaagagagaagaggcattgttcacaaattcatatgaggatctgccaaaaaagagaggcttcataacctacaggagaattggtattcagaaaagatggcaggttttttttctaaaagcaataaaatgttggaaggtagtatatccacatgatagaagagatagccataaaaagaacattaacaaagtgttaactaatgtgactaaaatcatgacacaaaattttacagccagtataatctcaactatatagaaaagatacaaaatattaagtctgaaaagcaccaaaatggtaaccatagtggagtagacaatgagttatttatttttctttgtttgcttttccttatttccaaagtagtctaaatgatggatatactctagctataatttttttaatgaacttaaaaaatgtaaacaaaaccactcaaaatagaaaaaagtctgtttcttaattaaaatgaaaagatttcacactgaattcctgaatgggtatctgcaacaaattaatagctatttatttttttgagctatgatagaatactttacatatatcaaccttcataatttgtccaaattactttccaaatgtaacttgtgtgaaaacacaaacatctataaatgtcagttcatctctattttctcccttaaaaaaaaagaaacttagtgcatatttatgcaaataaaggagtttacaatgagttaaggacaagtcactgtactttgattttaaaattcctgattctcaaggacacagtgtctattgatgcaggcatgatgtaggcaggatttctgtttgccagaacctcctgctttcactctccaaattgacaaaaaatgaaacgtttggtcaccttcagcaccaggccccagcaggtatccatcctcctcagctgaacagaagctcaacttcccctctccttgggtatccagtagccccgcactggccccttccctccagaacaggctgcagtgggcggggcctcgttagctgtcactctctgcagggcacggttgccaaggaaatggaatttccctcgtgatcctctgggcctgtcaccacatctcagcctaggatttttctcgtcctaagagggccaagctgacactgatggctaacaccatgtgccccccagccctttgggggtcgtactgtttgatgtatataaacagttactgtctacaaaaggctctttgttacacactgttttccctcatagttcagaatgtttattaatatttgacaatagagcaaagtggaggagaggaggcagtcacttcctggaaggaaagctggactctattttttccagtcagccttaccccacccaagaaaccttgcttctcattaaaaatacagccagacccagagaccaggcgccctgcttcaaggggcacaagtgccgaccaggcaacctcaagttgcagggagagagagaacagggaggcagaggatgccaagccttgggaactgcaggggaaaacaaaaagtcccctgcaccagcaccccaacctctttcaccagctcatttttttttcccccagcaggcctcttcccttatgggaaccaggagaaagaaaaaacagctctggttatcactgcagagtattttaattttacactgtgcgggaggatgtgacgcagtaatttggagggtattttggcccatgtaaacctgctttgaggagtctcgggcctgcggcacggaggtacaacgtacaggcaggaagggagaaaaaggagccactgatctggctgagaacaagaggaactcactgtttgtcagcatctgcaggtcttccactgagggaggagaggctttcttctcgtaaggaatgactgtgttcagatactgcaagacaaacagcatgcagggggcttgagacagaagacatgcttcctctgggttgagatttagcctttctctaagacacacactgcaaatctgaccttctctgaaacattcatggtcactggtacgtcactgtttcagaacttcttacccctctttagggaatgtctctttaaaagtaagactttcccacatttctctccatcccaacttctagattcttcctacactacaaacttctctgttatttaggaatcctggggagctttttctcctttagactgaaagcagagaataaatccaaggggattatattttcttattctttgcagtgcaatttgagaaggaattgtttgtcttttgtcaaaaaagatatgcaagagaacctcaaccccgcccagggtctctgatgtcagatttgctccctctgctggatgtcaggtgctcctacaacaaaaccagcatcagggcctagtgggctgtcaaaggagtctcaaggaagcctgaggtggtgagtgccagagctctagatcaaagctaagaagctcacttttttttttttttttgagacagagtctcgctctgtcacccaagctggagtgcagtggcttgatctcggctcactgcaacctccacctcccgggtttaagcgattctcctgcctcagcctcccaagtagctgggattacaggtgcctgccaccacacctggctagttttgtatttttagtagagatgaggtttcaccatgttggccaggctggtctcgaattcctgactttgggtgatttgcccacctcggcctcccaaagtgctgggattacaggcgtgagccaccgcgcccggccagaagctcacattttagtcttggctttgccactgacagtgtgtgtggctttggaaaaatgccttgaatctccaggccatagttctcactgccataaaacaagaggactgggatcgatgctgctaaaatctcttccccttctctagactctctagaattctagagttctagaattctagcacttagaattcagctacaaatatgtttaaaacatatacactttcatgtacactcattccaccatctcaaactttctgttcacgtgccagccatgtctattagattatacactccatgaggacaggggtcaggacttttcacctttgcacctgagggcttaacaacagagcttagcacatagcaggcgcttgataaaagttgtgaatgctgtcttaataaccagaaatgcaagctatgtcacagggaaattactgagccaacaaaaagccacagcatgggttccaaccagagctgggaagctgcagaggcagtcttagtgggaatggcttggcaggtgatccagtgtggtggaaagttaactaaactctaggatgggatctatcatcaaatggactccctcttaatgcatttcatccttaaaacaacttaattcttagacctacaagcagtgttgagttttaagtcttgcccatgtcctagaacactagagctcaaaaaaaaaaaaaaaaaaaaagtttgccttttaaaaagatattctctgttcctccttaagaggagaaaaaagtgttaggacccctaaccccctaaataaatgctgggataattctggtgagtcactgtccccctgcgttgctggggaggccaagctgcaggagtctaggaagagagcttggagcagggagactacgcgtacctgtttgtcagttcctgaggagccaaaggtctggcggatgccactctgcagaatgttggagatgccttccatgctgaagcgctgtgggggagagagactcaagaagggcaaatgcttcttgctacactgtcaccacacccagggacctctcagctaccaggctgtcccagataacgccccagggttctgtgactagacagtaagtgtaagacactggcttacagagacaggccagaattgaagcctgagctttgcaagaataaacagagtctcaagaactcttatcttagtaagtccctcagggctacaagacccctctgcatcccccagttttcctccttttatcctccatcatgcaaatagaaaaataaagcagttcagtcaaacttaaatgaaccatgatgcaaagatcttaggggaaaacaaaatgttcagctatcagaagaggctgtcttaaagcaactgtcctgatgggggaagtttttttcaaaatgtacatgcggagaactaattccataggtctgtgatagagcctagggaaaggcattttgaaaaaaactccttagataattctactgagctcccctgattaagaagcatgagtggctgggcgcagtggctcacacctgtaatcccagcactttgggaggccgaggcggggagatcacgaggtgaggagtttgagaccagcctgaccaacatggtgaaactccgtctctactaaaaatacaaaaattagccaggcgtggtggtgtgaacctgtaatcccggcgactcaggaggttgagacaggagaatcgcttgaacccgggaagcagagattgcagtgaaccgagatcgcaccactgcactccagcctgggcaacagagtgagactccatctcaccaaaaaaaaaaaaaagaaaaaaaaaatgaaccatgagaaccaggggtttgggttaaacccaaaaatagaacaatagaacaataaggcatctggggccaggcacggtggctcatgcccgtaatcccaacactttgggaggccaagatgggcaaatcacctgagatcaggagtttgagaccagcctggccaacatggtgaaaccccatctctactaaaaatacaaaaataatccaggagtggtggcatgaacctgtaatcccagctactagggaggctgagacaggagaattgcttgagcccaggaggcggaggttgcagtgagccgagatggtaccattgcactccagcctgggcaaaagagtgagactctgtctcaaaaaataataacaataataataaggcacctgatcattttcaatcactgaaacaccttagcacgccctaaagagaccagtcaggactggaacctgggacacaaggagggatttggacccagaattctgaggcccatctcaagactcccaacacgaaataccctcactccactttctttaaggtcttgcctacagagaacacaagccaaattcaattatttcctaatgtacacactgtcttcctgggttagactgtgagccctttgggggagtggaggagataggtgatatcttctccctttctgaccccctgtctgtcacagtgtgctgctcaccaccactgctcggtaaacgttgatgagtcccctgcagggttggtagggcactgaaacgggcagggttggaggttggaggcacccagtcttccacctggttgttcacctaccttgagaggcatctggtttcccttctctatccggctgctctgcaggctcagccctttctctttccgcctctttttcatcagttctcgctgctccttctgcttgttctgaacctcaataagcaccgtgataaaggagttcttcacttccttctcaaactccagctcgtcccggcgggccagctgctgcaccagctcctccgagaagtcacggatggcaccctccacctggtccagcagctcggtcagctcagacccagacatgtgcctcagccctgcaggggaagaccgtctcccgcataacacctgcatccacaccagagcccgctggggaggctcctggggccaccaccaatcaagatgggactgcccctcagaggagatcccttccaactccttaaagatccaagaaagaccttcacaatttacgagcacgccaggaaggcgggggcctgtgtactgactgcagaagagaacacccctctcaggaaacaaaggaggaagaagaaacagcccacgaggaagtctgtggactctattctcaaaaatggggatggtttgttccttctattttctatctgtgtccataagattccttgtgtgaaatgggtcaagaattggggatggaaaagtgatgggagggaggtttttgtcatccatactgaagagcaatagagacgttggtgcttattcccaagaactgatcaagatatagcatacggcaacaacaacaaaaaagccgaccatctgagcccttctttacatctctggtcctgtgtcgcagtgcatgtattcaaaaatatgtgaaacctggaagattggtgactatgcatgaaaaaataaagcctagcgggttagcatacggcagtcagctactttcaaaggaaagaaaagggaagctgagatcatgggaaatatataactttaagaagtctcctaagacttctttcatttaaaatagatttggatattttattccaaatttttctgtttacatgttatatattttcatagttgagattatacttgtatacaggtctaaatcatgctttaaaactttatacactttaggccaggagcagtggctcatgcctgtaatcccagcatattggaaggctgcgatgtgcggatcacctgaggtcaggagttcgaaaacagcctggccagcatagtgaaaccctgcctctacttaaaatacaaaattagccaggcatggtggtgcctgactataattccagctattcggcagagtgaggcaggagaaccgcttgaacctgagaggcggaggttgcagtgagcagagatcacaccactgtactctagcctgggcaacaacaagagcaaaactctatcttaaaataaaaataaataaataaataaataaataaaaactttataccctttaagcattttctgattaaaaattcttttaaacacttaaaaaaaaatttaggccaggtgcagtggctcacacctgtaatcccagcactttgagaggctgaggtgggtgggtcacctgaggccaggagttcgagaccagcctggccaacatggtgaaactgtttctactttaaaaaaaaaaaaaaaaaaaaaaaaaaatatatatatatatatatatatgtatatatacacatatatatgtatatatacacatatatgtgtatatatgtatatatatacacatatatataatttgaaaaaataaaatatacttgggaaacatcttttaaaatgtgtctccatctaatggtatctttttgcggcaggggaggaagaattaattgattgactggtttttaatttttaatttttgtgggtacatagggggtgtatgtgtttatggagcacatgagatgtttggatgcagacatgcaatgcataataatcacatcatggagaatgaggtatccactccctaaggcatttttcctttatgtcacaaacaatccaattatactcttttagttattttcaaatgtacagcgtctaatggtgtccttcactttcacctcagaatccatttccctcttcctctttgtttctgctttgcccggatatttgctgacttggttgggctttccccttattctgctctttggagctgccctctcccccttctgtttttttgccatttcactctgcatttcagctgttttcacaagtcttttgctgaacgcgtctatctttgggacctttgtgtggctgggaagggcctgacaagggcagtcgggaatgcagcgaggcagccaagtccagttcagcaccgagcagactctctgccggccacctcctgccgctgctattcaaagccaaagtctgacttgcaggatgcaggcctccagattctgcctctgctttcaccacttctaacccgcagttgacctttgaaccctgaccaacccaccttctccctcccctgtttctaagttcccatctccccatgggtggatcaactcctaggatggggccccttctgcagcgtgggcatttgataccctacggctggtgaattgttctgcctttgctgtgttacactttttcatttcatgcttcatccagccgtttcttgtgcacagtcataattactataaacctgtgtcagagagttaagaggatggcctctggagttaacctacctggcttcaaatgttagcttcaccccttatggcttctgcatggactaagcacaaatacaaattttaaatgagaggcttgattctccccgttgaaaataagggaagagacttttcctctcccccacctcccttttctttcagaatttcttctacctatccttttcaatctctcaaagatttagattaaatctttaaaataaacatatgttacatttacattaaattattgtcatggctaaaataagcctcttgtcattcttataattcaggaggctttcttcaagggcctggaggttactgctttgaaatataatcatcgggccgggcgcagtgggtcatgcctgtaatcccagcactttgggaggccgaggcagtcggatcacgaggtcaagagttcgagaccaccttggccaacatgtgaaacctcatctctactaagaatataaaaattagccaggcgtagtggtgcatgcctgtaatcccagctactcgggaggatgaggcaggagaactgcttgaacctgggaggcggaggttgcagtgagcagagatcatgccactgcactccagcctgggcaacagagcaagactctgtctcaaaaaaaagaaggaaagaaagaaaagaaaaagaaacataatcatctctcattgttctgagcagaggggcctaactcccttccgactccaaattgcaaaacctactcaatgtaatgggttccattcatccacttagctacacaagagtgagactgctttctgtctttgcagtctcttcagagagttgtctgtgatgtggctcccatcctggtttagtgcttattcaataataaaatagttttctaggccgggcatggtggctcacacctgtaatcccagcactttgggagaccgaggcaggcggataacctgaggtcaggagtttgagaacagcctggccaacgtggagaaaccccatctctactaaaaacacaaaaagtagctgggcatggtgatgcatgcctgtaatcccggctactcagggggctgaggcaggagaatcgcgtgaagctgggaggcagaggctgcagtgagccaagatcatgccactgcactctagcctgggcgacagagcgagattctatctctaaaaaataaataaataaataaaaatagtaacaaaatagttttctttctcacctgtctttgtggagaggttttctgaacaggaaggaaatctcatttctaatcatatttccctaacagtggccttggacaagtcatgtaacctctgaaagactcggttagcttgatccaaatggggttggtgtgaagatgaaatgagattaggcataggaagtcttagaataaggccaggcgcagtggctcacacttgtaatcccagcactttgggaggctgaggcaggcagatcacttgaggccaggagtttgagaccagccttgccaacatggcgaaacctcgtctctacaaaaatacacaaattagcagggcgtggtggcacgtgcctgtagtcccaactactcaggaggctgaggcttgagaatcacttcaacctgggaggtggaggttgcagtgagctaagaccatgccgctacactccagcctgggtgacagacagagagagactctgtctcaaaaaaaaaagaaagaaagtcttagaataaggtctggcacatagaaagcacttcagaaatatgagctgttactattaccttttttattcattgattttatggtagcatcattcattgcttttatatagtagttcagatttcttctgcttattctgccttagtcttgttctttggttagttttaacatttaaattttgctcgactaccttgttcttttctcaaaaatgcaaacttctctcctgatgccgagtaagaaaggtattgctgaccacctagatctgcaaggctctgctctgaggcagtcagggttctattagccatgtacaaagcacacagcccagagcctggccccgagcaggtgcttcctcctcggccagcccagcgcccagggccctcaccttcataggaccagttgttgttgaaggtctgtgtcaatgcctgcatctcctgcaggaggaccgagtctgcctgggaggaagtttctcctccatcctcttcttccagaacctcctcttcttcctcagggtctggggagttctgcatcatttcctcaatctcctcaattacctgaagaaggtacacgagagagtgctaactctgttctctgctagaggggcattctggcttgaattttgatcagttaaggatgttcctaattagctatctgaaaatttctaaagcaatattgtttttacataaatactgaataataaaaatagttccaaccaaaggcttgcatacactctttctttaatgtaaggcactctttaatgtaaaacctcttccaagagctccttttagataaatgacttattggaaataagctgctctttcaggaagcaaggcagagctgcctggaagggaacatttacttcaatgtgctgagctatttctaagtgggaaaatatttcattcacccaactttaacacaaaacccagtccattaattgacataatacacgtgactgtaaaaaatagcgtgctcctagaacaacacaaaatggggaggaaaacaactatttctccagaattcacctagacaggaactgaagctgcccagcaacaaatgaaaatagagataatgaaataatagaaggataggtggagtctagagagcagcaaatagataagaaccccagctctaatctagactattgacaggagccagctcccagaagtggagggaaaattagatatctgccaaaaggaacaaaagtgaattactagctgggcatggtgtctcatgcctgtaatcccagcactttgggaagccgaggcaggtggatcacttgagctcaggagttcaagaccagcctgagcaacatggcgaaaccccatctctgcaaaaagcagaaaaattagccagttgtggtgacgtgtgtctgtagtccatgttacttgggaggttgaggtgggaggatggcttgagcccaagaggtagaggttgcagtgaaccgagactgggccactggactccagcctgggcaatagagccagatcctgtttcaacaacaacaacaaaaaaaagagtgacttactttgtacattaattatttacaaataaagaagactgctgctgaaagcaggtctttagatgagttttgtcccaaccttcacctttgtctgttctccatggatggactaaagtccccgaggccagcattgtactctttgaggtggtttcttcacagtgggctggaccaaaggtaaggggtttcagggtctcctcctttagaataatttccattcttattcccaaaccttttcacctctactcacaaacttaggaaatacccagtctttgactactgaaagccattttacagaatgcaaccaaatgacacaagtccctgtcagggtcttatggctgaatgtccttttctctaagaggagttataattgagttcatatcattgaattgtagatcctcctacaagtcacaagaatagctattagcccctatttttaaaaatctggttctcttcagtctcctaatcctcacgtgtttcaattcccacctttctatcacagatatgaaaaagcaccattgctgctaaaaaagcactttctggcaccgaaggctgccagtggagctttgcagaaagactttgtggaaacttatgtagtgtttagctcaaaataagcacccataaatatttgttgactaaaacattaaataaggaatccagaaactgaacattatcctctctaagtaataaattattaaagctatgatgatctcaattgaatgcgaagcactctatcttttttcacaaagtcgaagtggctctaagactcctttcggaaggcccaaaattttgagtgttctatgaaatgtaagaaaatatccatcacacaaaagcctcatctgtcacttctctttttgggaaaacaggtatttgggacccttgtttgagtgtcttgactccgagtacaacgaatttcaataagaaggcttagcaggattgtagctactaaacactatgcctgtctctggctcctatcagagactgaccccaactatcccaagtgtcaagaatgacattcatgttcactgcaggtgggcaacctgaggcagaaagagagatgaaatcccttatcaaaaatactctgagttggacagtcaccgtggctcatgcctgtaatcccagcactttgggaggccaaggcgggtggactgcttgagtccaggagtttgagaccagcctgggcagcatggtgaaacctcatctccactaaaagtacagaaaattagctgggcatagtgatgcatgcctgtagtcccagctacttaggggcctgaggcgggaggatcgcttgagccaaggaggttgaggctatagtgaaccctgattttgccactgcactctggcctgggtgacaaagtgagaccctgtctcaaaatgaaaaaaaaaaaaggtcaggcacagtggctcatgcctataatcccagcactttgggaggttgaggtgggcagatcacttgaggttaggagtttgagaccagcctggccaacatggtgaaatcacatctctaccaaaaaattttttataagaattagccaggcatggtggtgcatgcctgtagtcccagctactcgggaggctgaggcaggaaagtcacttgaatccgggaggcagaggttgcaatgagccaagatcacgccactgcactccagcctgggcaacagagcaagactctgtctcaaaagtatatatatataaagaaaaaaaagaaacaaaaaatactctgagtcatgagcacaggcaccacatgaccacatatctttcttctgccttaaatggatgtggcaagtgtgttctcttggactttttctccatcaaaagaacaaaaggtcccgataacctggagagatacttatacctgatctgctgtgagcagaggctcctcgttgataccggaatcattttcactcttctcattgaactcttcctcttctttctcatggatctggagaggaggtggggagatggaattctgggtgaccatcagcagaagtgggattgcctctagtctcgagaatggatgatactgactgggaggccactccagccagctgctgtctaaacagtggagctgaagaggtgtccagagtttcatccaattccaaacatatctttgccccatcactaactccagcatgccagaaatccagcatgcagcactgaatccaacttggcaggaaaagacgacaggggaatggccagcaccattctgactcaaaggggacagcaccgttttttaacccacagacaggtcatcctggggtgaacaaggcgccttctccaggtaagtgacactgcagccaactgcagcaaaggtgccctgattttgttaaggagttccaacctggggggttgtttccagatttcgtcttactaggcattttaaggaataggttgttctagtccaaataatgatgactttcagaatttgatgaaatgccatcctgttactggaatccaggcatgatgtcatagctgatggcagatgtaagaaatctgcatgggacatgccactgaataacctgaccacatgaactaaacaacaacaaaactacaaaagagaaccccatttatctcatttgccctgtgtctctataattccataatcccaagtaagatcctcaaagttcacagccatcaaaattctagatgtttaaatctaacaagctattcaaagcatatctggcttaactgaccatatcccaaactgccatagtctggcatttacattcaagtcccacagaaaagttaatcactaaacacctaacaagctgtatgtctagaagtctgatttgaacgtcatacaaggaggaggcaggaggtgtctctaggaaatctctctgctgagtcacctctcatccaggaatgaatcctccttgcgctccagtagctggcacaccgattggccccttccctggggcttgtattctgccttttctaacaggaaacagcccagctccaatccaagcaataatgtcagaggtagtctatcctcagaaacttctcccgtcttctgtgagctttgccttggcagacatccctaacagagcacatcaccttttatctccatttgcttaaaaccaggactatgtcattaaaaaagaaaaaaaaaattaagcaaatatatctcaaatgccatccgcactcaacctagatatggggtaggacagggaggtaatggaatcatctgaagggcccgggtaccagatggtgacatctatttccgctgtcaaacccatatgctcctctctctgccaagtccaccacctgcgatagcctcgtggtttccaccgctccccactatgcagaacaaaactcctggagctacgctttgttcacaactacactcatatggaagaactttcttcaggccagaaaatcctgcagtagaagttagcccaaaattaagagaacgaagatacattttttcctccagacaaaaattaggggagaaaaaggaagaaatgtatcaatatgaacccagcccaagttagtgtgagcccaagttaggctcatcctgggaaacagggttatttttcataagcatctaacagcaactgttagtctataaccaggatttggcagggggtagggggtggtgggcactaagtctatataaaaatggcatgtttaccttttctgaaatgtggctgattgtagtgggtttaactccctgactgttaatattgcttctttcaactatatcatctcctccctccccaagttcctcactccttggggagttccaggaagaaggcagggaggaagcttctagggatagatccttcttgctgctcaaatgctaataagcctgggctgtggccggaatgatgcactagtagagtttctctcccctccccctctcaggcgcaaagcctccaggtctgaattgtcaggcttgggaaaacagagatgggaaaatcaattataagcttatgaaaggtactgtgagttcctactcttatgggaaccatactcatcccttattttcttatttctcagaagtctgccactaaaaaataaaataaaaggagaggcagacataaaatacggccaagaaaaccctggctccttccctctatgtgcgggttaccccctaatccttgggcttccccacctccatcgtgccccagcctcttcacctccctctccagcgtttgattctgatcctctcacccttcccaccctccctaggcctggttcccacattttctgtccatcctgccagactttgctctgttccaacagcatccatcacttcacaagcccttgcctctttacgggcactgtttacagactccttccctcccctccttgaccaggacagtatcttgtgcacagggtggagagctggaggggaaacaatgacagaggaagaaagaaaggtttttgaaaaatgacagcccttgtgcatataaatactcttaatcctagcataagacactgacatagatatcacggtagagagttcctttagccccttgtgcagcagtggggaagatacatgtcaaaaataacttcaggccaggtcatttagggctgaatttctttgtcagctaaaactgctagttgttaccagatgtggtggcttacacctgtaatcccagcactttgggaggccgagatgagaggattgcttgagtccaggagttcgagaccaacctgggcaacatggcaagactccgtctctaaaaaaatagaaaaattagtcaggcatgatggcacacctgtagtcccaactactcaggaggctgaggtgggaggatcaattgagccatggagatggaggctgcagtgaggctgcagtgagccgtgattatgccactgcactccagcctggatgacaaagtgagatcctgtctaaaaaaaaaaacaccttgctagctgtttggatactattgacgtgaactatgcttttccaagaaaagtcattcttccaaatgatttattcccagaattgagaagatttgaatccagaaaggggtctggctataccattcagcaagctgtttcttcctcctgcttttgggaagagtgtgtctctaggactataacatgaaagcttgaaacttgaaaagaaatgcagaaaactttccccaaggcctataacattgctaaatcttgctgcacagtgaagtattctgaatgatgattaaaattatgtggagcccttgattccaataatgactattaaccagtgtattttattaaagtgtttcaaatgaccccattcatagaaaaggtaatttttacagcatatttagccctttgcataatattttcctccccttaccactattgtttgacatgagtggttgcccccctgacaaaaattaagagaacaaagatacatttttaccttcagacaaaaagtaaaaaaaaaaaaagaaattcacaacaactgtgtcccattttttttttttttagacacaggatctcgctgtgtcacacaagctggaatgcagtggcacaatcatggctcaatgcagcctctaactcctttgctcgagtgatcctcctgcctcagcctcccaagtagctgggactacaggcaggtgccaccacacctgactaagattttttttgttttgaatttttttagagataggggtctcactgtgttgcccaggctggtctcaaactcctggcctcaagcaatcctcccacctcagcctcccgagtgggattacaggtgtgagccactgtgcctggtaactatgtcccttttatgcttatgaacaaccaggaaacatctgcgtggattaagtcaatggctgtgcattcccatagggagatgcactagggcatgcagccaacacatatttgttgaaagaattaatgaacaattgaaaaagagaggactgagagcagtactatcatctagattcagtccacttccacaggtaacttagctatttagtcacctggaaaagaggaagatgtgactgggcatggtgtctcatgcctgtaattccagcaatttgggaggccagggtgggagggtcacttgagcccagcctgggcaacatagtgaaactctgtctctacaaaaaaaatgaacaaaattagccaggcatggtggtgcacacctgtagtcccagctactcaggagatggaggtgggaggattgcttgagccagggaggtggaggctgtagtgagccatgactgttgccactgtactctagcctgggtgacatagtgagatcctgtctcaaaaatatgaaagacataattcactatcctggacttccaatttcctcttatccagacaaccactatctgctattaaataaaggttataaggtaaaaggagactgtgttttacatcacaggaatagaatagattgatgaatcgaaagccccagtaaaagtggtaaattgtgaaaaaaataataatgcctcctacagacatattaactcaagcaaattattttgacctaaaaatgtaaatgtacatttatttattcaccaagttcctagtgtaggaccaagcttacaatgaaactctgagtagagttccacagtctctcttgcatcatccacataataacttttttttttctttttttaaacagagtctcacaatatcacccaggctggagtccaatgacatgatcaaagtccactgcagcctccctttcctgggatcaggcaattcttccacctcagcctcccaagtagctaggaacataggtgcacaccaccactcatggcaaactttttcatttttttgtaaagattgagtccaatactccctctttatctttacccaggctggcttctaactcctaggctcaagtgatcttcctacttcagcctcccaaagtgctgtgcttacaggtgtgagccaccacacccagcccataacataatttttaaaatgatttcctgtttccatttctttatagtagaaggtgggtacacaggagattgggcacaaatttatcagcccttcctcctcaaaccctactaaaatgagagtcaagggatcaaaaaagaataacccaaaagggacaaagtgaacaggagaaaaggcaacagcaagagaaatgccagaaaacagacgccggcccagcaggctcagcagggttaaacttggcgagagcaggctgcccaaggtaaagggggtcacacagcagatactgaatggctcaggaattgcagaccccgaggggcagcatggcggggctatgtaaggaagatttgctggtattcttcatcaagaataatgagacccaagtgtcttcttccaacccagataaaaagggactgcatcctctcagctcaaaaggactgtagacttcactctgagcaggttgaactggaggttctggactcagagcaccaggccacctaaaagtgagggtgagggttctcaccaaaaacagagagaggatgtaagactctacagaatgactcaccagacagacctctggcctccttccctgagtaggctccaaggacactggcagctggtttattctgtccatcaagccattggagaacacctctctatggatgctataagtctacaaatacatgccaactgtcaagatctccgaacaagacgcataggtccttactggcactgtgatccagcaggaaacaagccctgaccccatagccttctagggcctcactttctttttttccaagggtttccctctgtcacctagactgaaggggagtggcttgatctcagctcactgcaacctctgcctccccggctcaagcaatcctcccacctcagcctcctgagtagttgggactactggcgcatgccaccatgcccaactaacttttgtattttttgtagagatggggaacttgccatgtttcctaggctggtctcaaactcctgagcacaagcaattcacctgcctcggcctcctaaagtgttgagattacaggcgtgagctatcaccagccattttttttaaaattaatgtttttagagacaggggcttgctctgttgcccaggctggtgtgaaatggtgtaatcatagctcactgtagcctcaaactcctaagctcaagcgattctctagcctcagcctcccaagtagctgggactacaggtgcatgccaccaggcccagctaatgcttttttttttttttttaattttttgtagagacagggtcttactgtgttggccaggctggtattgaaaattctgggctcaagtgatcctcctgccttggcctcccaagtagttgggactgcaagtgcactccatcccctggctacctttttgttttttttgtttttgttttttggtagagttgtagagatggggctggtcacaaactcctaggatcaagggatccccctgccttgtcctcccaaagtgctaggattataggagtaaaccaccatgcctggccataaagcctcacttttaaatatgaaaagatgctcaaggattgccagacatttgagaatagcccccaacatgaaagatgaaaatgtatagagaagagaaatcaaaagcaacagagagagcagaagaaacctcttctaagaaactgctatacctgccttcagaaggataacagaacaccttgcttcctcaaaatgtgtcctatttatcagaattcatttaaaaactacaaagatgtacacttactaagaccagaaaaaaattttaaaaacacacaaattctgtaaaaactggaaagggctcttagaaattaaaggtatgatagaaaatttagacttttccatcgagctgaaggctgagaaagttccctggagagtgaaacaaaataagcagatagaattatgggcggggaaaaatattcagaagatcagcttcagaagtccaatacttgaataaaaggaattctagaaagcaaaaacagaagagatggcccctttcagccatgacagagtaactggtattggacttatccctcctaccataaacaactacaatctggacaaaatctatgagccaattgttttcaggcactggacacaggcagtgcaaggctgtgtgttttgaaagaagggaaaaacatgaaataaatgagataaataaatgaaggctaaaggaatctgtcacctgtggctctacaccaaaagaaatgctataaaaagcattttgggttgaaaggaaatgatagaaaatcagaatcttcaggaaaaaataaggaatgccagaaatgataaatacataggtaaatattttaaaagtatcttttttttccttcttttgattttcttaaaagacaactaactgtctaaagcaaaaataataactttgtgttgtggagtatataatgtagattgaaataaaatatatgacaattatagcacaaaagatggaaggaatagactttatactgtgacaaatgttttacattttatgtaaagtgtacaatattaattctaaatggactatgattaattaataatgtatagtgtaacccctagagaaaccactaaagaaaaatacgacaaggtatagataaaaatccaacagaagacataagatgcaaagccaaagaatatttgattaacccaaaagaagacaaaaagtgtggaacagaggaacaacaaaacagcaacaaaaccagatgggacaatcagaaatgaagacaatacgctccaacacaaattatcaatattatgccaaatgtcaatggactacacactatgcaaataaactaaacacaataatcaagaagcataaattgtcagactgaatataaaaacaagatccaagtatacactacctgcaaaaacacactttaaataaaaagacagagataggcagaaactaaaaggattgagatagatacacacacacacacacacacacacacacacactttgcaaacagtatgcataagaaagcttaagtggctacattcatatcaaacaaagtagattttaagataagcattacagagaaagaatgacatttcataatgataaaagggtcaactcatcagggagatgtactcagagcttcaaaatatataaaacaaaaatcaacagaactaaagaaatagaaataaatgcacaacaatggttggagattttaataaacctttctcattaattgatagaataaacagacaaaaaatatcatttggaacacaggaattcaacaatactatcaaccaagttaacctggttgacatttatagcacattacaaccaacaattgcagaatgtgcatcatttccaatggcatatattacattcactaagacgtaccatatgctggaccctaaatcagtctgaacgtattttaaaagatttaagtcatacaaagtatgttctctgacaaaattaaattagaaatcaatttttaacaagatagctataaaacctcccaagcactttgaaattcagcagcaaactgccaaataacctatgggttaaagaagaaattgcaagaaaaaattagaaactatgtttttaattgaatgatgaaaacatacccaatcaaaatatgtagaattcagctaaaacagtgcttaaagggaattttatagctttaagtttttttaagtttaaaatataatcaaatttcctaccttaagaagctaaaaaaatgagggcaaattaaactcctactaagtagaaggaaggaagtaataaagctaagagagggaatcaataaactaaaaagttaacaaacaataaaggaaatcaaagaaataaaaagtggttctctgaaaagattaataaaggtgataatcccacagaccagctgacaagagagagtgagagagggatggagggagagagaacacaaattaacaatgtcaggaatagaaaagggaacatcactataaatcttacagacattttcaataacaaaacaaaattataaacaaatgaatgttcaatacattcaatgattaaatagataaattccttgagaaatgtaacttatcaaacctgactcagtaaaattgaatttgtaactgaaaatcttccacagagaaaaccctaggcccagatgctttcactagtatagtctatcaaacattcagggaagaaataataccaatgtaatacaaattctttcacaaagtagagatagagaggataatttccaacttattttatgacattagaacaaaataaaatttcagaaaaagaacatgatgcaaaaatctttaataaaatatcggcaaatcaaatcccacattatataaaaaagataaaatatcataactaagtggggtttattttaaaataaaatgctggtttaatatttgaaaaccaattaatgtaattcatcacattaacatgataaattgatctacatatataaattggtctgtagattctacacaatcaaagtcaaatttccagcaagattttttgcaaaaattcatctgctgattccaagatttatatggaaatgtaaataacctaaaataactaaaacaaatttggaaagaaaaaaaaaggacacagttggagaacttatattactttatttcaagacttaccataaagctacagcaatcaatacagtgtgggattggcataaagatagacacattttaaaataaattagggatgataaaaaaagacacacacatatatatatcattgaaacagaaaaaagaattcagaagtagatccgcacatacatgatcaattgattttcaacaaagatgccaaaacaatttaatggggaaggaataagattttcaatgaatggtactggaataattgaatagccatatgcagaaaaataaaccttgaagcccagcactgtggagtgcctcggtagtcccagcaattggggaggctgaagcaggtggatggcttgagccaaggagctcaagaccaacctgggaaacagcaacctgggaatcaaaaattttaaaaaatgagccctgacccttactccatactatatacaaaactaatttgaaggctgggcacagtggctcatacctgtaatcccagcactttgggaggccaagacgggtggatcacttgaggtcaggagttcaagaccagtctggccaaaatagtagaactctgcctctactaaaaatacaaaaattagctgggcatggttgcaggcacctgtaatcccagctactcaggaggcacagacagaagaattgcttgaacctgggaggtggaggctgcagtgagccaatattgagtcactgcactccagcctgggcaacagagcaagactccatttcaaaaaaaaaaaaaaaaacagaaagaaactgatttgagatggatcatagacctaaatacaagagctaaaattataaaacttctagaagaaaacttaagaaaaaaatcttagtgaccttgggtttaacaaagatttcttaaatacaacataaacacaaagtataaaaaggaaaatatcaataaattggacctcatcacatttaattttccttttctttttttttttgagatggagtctcactctgttgcccagactggagtgcaatggtgcaatctcaacccactgcaacctctgcctcccgggttcaagcaattctcttgcttcagcctcctgagtagctgggattacaggcacgtgccaccatgccaggctaattttttttttttttttttttgtatttttagtagagacagggtttcaccgtgttagccagcatggtctcaatctgctgacctcgtgatccacccaccttggcctcccaaagtgctgggattacagacatgagctaccacgcccggcctaatttttctttttgagaggggatctcactatgttgcccagtctggtctttaactcctggcctcaagcaatctgcccaccttagtctcccaaaatgctgggattacaagcttgagccaccacactcagccttcatcacatttaaaaaacatttgctcttcaaaagataatgttaagaaaattaaaaggcaacctatagactaggagaaaatatttgtaaaacatacattcaacaaataatttttatctagaatttataagaaactcttatggccaagcacggtggctcatgcctgtaatcccagcactttgggaggccaaggcaggcggatcacaaggtcaggagttcgagactagcctgaccaacatggtgaaaccccgtctctactaaaaatacaaaaattagccagtcatggtggtgtgcatctgtaatcccagctactcagaaggctaaggcaggagaatcacttgaacctgggaggcagaggttgcagtgagctgagattgcaccactgcactccagcctgggtgacagagcaagactccaactcaaagaaaaaaagaaactcttacaactcaatactaagaacacaaacaatgtactaaaaaaatgcacaaaagatttgaagaggcatttcaccaaagaaaacatacaggccgggcacagtcacgcctgtaatcccagcactttgggaggccggggcaggtggatcacttgagctcaggaattcaagaccatcctaggcaacatggtgaaatctcatctcttctaaaaatacaaaaattagctgggtgtggaggtgtgcacctatggtcccagctacttggggagctgaggtgtgaagattgcttgagtccgggaggtggaggttgctgtgagctgagattgagccactgccctccagactgggcaacacagcaagaccctgtctcaaaaatacacacacacacacacacacacacacacacacacacattgtaaataatcacttgaaaagatgctcaatattctatgtcactagagaaaagcaaattagaactgaaataaggtatcaattttgttactacccatgaagatgtctaaattttaaagattgtccataacaagtgttagtgagaatatgggacaattacagctctcaaactgggcaacagtttggtagttccttaaaaatttagacatgggagttaaatgatgagaacaaatggacacacggaagggaacaatacacactgggccctactggaggatgaagggtgggaggagggagaggatcaggaaaaataaccaatgtatactaggtttaatacctgggtgatgaaataatctgtacaacaaacccccatgacacaatttacctatgtaacaaacctgcacatgtacccctgaacttaaaataaaagctaaaaaaaaaaagttgaacatacacctaccatatgactcagccattccacacataggtttttatctaagagaaatggaagcatatgttcacacaaagacctacagaaaaatgttcacagcagcttcatttgaaatatgcaaaaagtagaaaaaaaactgttcatctataagcgaatgaataagccgctggtgatatatccatacaacagaatactactcaacaataaaaagaaatgaactgttgctatacttaaaaacatggatgaatacctaattacattgagtttaataagccagacaaaagaaaatgtacatattgcatgattccattcatgcaaaattctagaaaatgaaaactaatctacaacgacagaaagcagataagtggttgcccagagattgggcggtgagagagagggatgaggaatatgttgaatatcttgattgtggtgatggtttcgcagatatatgcagatgtcaaaatttaccgcattgctcactttaatatgtgcagctcattatatgccaattacctttcaattacgatatggggggaaaaacagaataaaataaaatgataatatatcatgatgaagttgtgtgtatctcaagaatgcatggttgagttgacatttgcaaattaatttatgaaattcatcacattaacatcataaaggagaaaagctatataatcatctccacagaggcagtaaatagaaataataaatcttcagaaaaaataataagaaaacgtcacaatttgaagtcatgagcttctatgttgaaaggactcactgaggacaacataatgaaggaaaaaattcattctaaagcacattattgtaaaatttcaaatgagaaaggaaaagaacatcctaaaagcttccagaaagaaccaaaaaagtcatataataaaggagcaggaatctaaagatggagaacagagtcagcctaaaaagaaggactgggaatcggaacagatttggggtttctcaacacgacctaatgctagaagagaacaaagccctcagaatgctaaataataatattcttatatatcctaaaaaccatttcctctgtactcctttctcaaaaatatgctgaatagtttggtttgttgttggtttttttcaccaaaacaaggaactatatctagaaagatttttaaaatatggtaaccagaagacaggagtggaagacaaaagaatccccagcatgaagggaaggacgttctcaggacagcagctgtgcagctgatctagcgaatgaccagaccagtttgtagcagaaagatgaaaggtactaactgggatgttttcaagaaaaaaacatggaattgacacaatatagtatctgatttatttaagcattgtgttatttatactttttaattttctgaaaattatgatttttaacattttaaagatctttctggtggggatagactgtaccttcaagattagccaattctggctgggtacagtgcctcacacctgtaatcccagcactttgggaggccaaggcaggcggctcacttgagatcagaagttcaagactagcctggccaatatgcaaaaccctgtttctaccaaaaatacaaaaaaaaaaaaaaaattagctgagcgtcatggtgcattcctgtaattccagctacctgggagggtggggcaggagaattgcttgaacctgggaggtggatgttgcagtgagccgagatcgtgccactgcactccagcctgagtgacagagtgtgactccatcacacacacacacaaaaaattagccaattcttagagatagcaaagggctcagcaagccttctatatgcaaactaaccaaagccaagccctgccgcctctacctgacctttacatcccaggaggcagagtcctcttccttagtcatcccagagtcaggtactaggcactaaggaccatccctagtgtttacagcttgcagaaattactcaaactagccagtcctaaactgtttaccccatctcgccattcctgaggcactggcctggctctcccctggctccttctgcctccaggggacactggagcttccccatgtggccccgcatggccccactataaaagtggagctttatgcaaaaaaaaaaaaaggcagctaaaagaaatgcaagcagttgcctgtatggagtagggaaagacaagaaggcaggggtctactgttttgggtggttgttttgtcttgcacttacagtgcattactttcaaagcattaattaactttttaaactatgtagacgtgttactttgattttaacaaaaaatgacactctttgcagtcacaattcaatagttggtacaatatttaattaaatttcttagtgcagtcacaaggacagcacaaacaggtttggggacaactgattcttaaaaatggaccacttggccaggtgtggcggctcacacctataatcccagcactttgggaggccaaggcgggtggatcacctgaggttgggagttcaagaccagcctgggcaacatagtgaaaccccatctctacaaaaatacaaaaattagctgagcatgatggcacatgcctgtaatcccagctactcaggaaactgaggcaggagaattgcttgaacctgggaggcggaggttgcagtgagccaagatcgcgccattgcactccagcctgggcaacagagagagacaccatctcaaaaaataaaaaaaattgttttaaatggaccacttaagtggaggtatgagtgctcactagagagaagcatcacagctgtgcacattcagcatgccaaacgcttttggtcgtatgttttacagaaggaatacagagcactggttaatctggtaaatcgtttaaacttagggcagttaatagagctcctactgtaattaatccagataataaaagaggatgaaataaaacagccttaatccatctacttttgctaccctgtccttttcccatgggttagatagaagaaatactacaaggaacagagctcaagatcatccttctcagggtcattcagtttgccctgaaatattaaccctcttgagggaaatctggaaatgaggataaattaaagcccttttgaagggcaggctatcttatatatcctttggcttaattcacaaaatgagttggaaaggtgtcaaaagagataacaaagcaaaatctgccttttgtaccatgacggacctgatttaatttcagtaactagatttattccattattgcctccatcttctttgcggtttgggtaagtactaagcatcatacctgtaagcattacaagagaacatgcacagccgagagttcaaaacaggacctgagacacagcctcctatgtctgtgctgaggaggcttgcaggaaatcttagtctcaaagtcatcatctcacttgctcccgtcaatgaagccttgaggttttgagtaccttagattgctaattactagaaaaatggagaaggatatatatggctacattttcaacaaatcagtcaactgctgatctctttgctgtgctattttgagcaataatctacaaatatattgccgagtaaggggaatctgtttcttgctcttttacttggactcaattctgaaacacttagaaagattagacccatccaactctatcacttgctgagcctgcagggctgtgacagcccttcctgacgataaattgtcaaatttccttcacaactgaaactagaaaaccaagtgaggcagaaatttgcttttaacatagagccattaaatgattttatcttttgctgtgctctgaatgtttatgtcccaccccccaaatttatatgctaaaatcctaatgcccaaagtgatggtattagacagtgagaccttgtggaggtgatgatatcatggaggtgggatgcccacaagtatctttctaaaagaggcccaagggagcactttagacccttctaccatgtggggacacagtgagaaggtgccgtctgtgaaccagaaagcaggtcctcaccagatattgaatctgccagtgccttgatcttggacttccctgccaccagagctgtgaaaatcaacttctgttgttaataaattacttagtctaacgtatcctgttacagcagcccaaactgactaagaaaccattccatatgtagattcagataggaggggcaatttggatcttctgaaaggtcaccccctttatggcctttgcaaatcaactcaaaataaatatcatctttatttttcagaagcccctaagctactttctcccttggagtcagtaactcatggagtgtgactctggtccagacacataaacgtccccttggttgagtttcataaacaattctaggccagcatggtggctcacacctgtaatcccaacactttgagagtccgagttgggtggattgcttgagctcaggagtttgaaaccagccttggtaacatggcaaaatcccatctctacaaaaaatacaaaaattagccgggcatggtggcgtatgcctgtagtcccagctactcggggagggggtggtgggtaaggctggaggatcacttgagcccaggaggtcaaggctgtagtgagccgagactgtgccactgcactccagcctaggcgacacagtgagaccctgtctgagaaaaaaagagagacttcttccccactgtgtggctacattgctaatatctgggccccacctctggccattgtcaagtgcaagatccgtcagcacttgttctcagcactgtttttgtgggcctgaactattcatttaagatgggaaaatctaatttttttaaaccatcattatttgaacccaagagaagcccatgacagtttcctcctcttatttccggcctgaactgttcatttaagatgagaaaacctgatttttttaaaccaccattatttgaacccaagagaagccatgacagtttcctcctcttatttcaggccactttatttttcatgttgtagtacacaggttagaaatattgatagtaatggcaggctgggtgtggtggctcacgcctgtaatcccagcactttggaaggccaaggcgggcggatcacggggtcaggagatcaagaccatcctggctaacacagtgaaaccacatctctactaaaaatacaaaaaattagccaggcatagtggcatgcacctgtagtcccagctactcgggatgctgaggcaggagactcccttgaacccgggaggcgaaggttgcagtgagccgagatcgtgccactgcactccagcctgggcaacagagcgagattccatctcaaaaaaagaaaaaaaaaaaaaggaaagtaatggcagaaaaaaaattacttttgcaccaacctaatagaagtgatctgtgtttctgcttttctatagatgaccattcctatcatttcagatatactggatgtcttccttatttttcaccctcctctacaactcctccttcccaacaataattttttttttaattgaacctcctaggctcaagcaatcctcccacctcagtctcctgagtagctgggaccacaagcatgcgccaccatgcctggctaattttttgtatttttggtagaaatgggggtttcaccacgtggcccaggctggtcttaaattactgaactcaagcaatcacccacctcggtctcccaaagctgagattacaggcatgagcctccatcaacaattttgaggaagactgttgagttactgaatgtttttctaactggattccacatctcaagccctgctaaaccaggggccccggagaggtacctcagtgtcagagcagttgccattcagagcctcgatgtttggatccctccagtcttctgagagtgaagggatgtaattgtctgtcagagcatcccaaaccctgtaaacaaagagaagctctcattaacacacatctgtggcctggccccgcctggaggaaggaagagctgggccgggagaggagagaggcttctgtgtgtgccaggctgagatcatctgccttccagcatgcaggggcaaagcagcttaaaaactgaatcagaggcacatccaggggagaaagtgcatggagcttggccaggggcttcagtgtgaaaggtgtttgcttgagggaagaggaatttcctaccattgagatacaaatggcagcatctataatcaaactgcctctggctctgaaaataaatctgcccctcatccaaatagctcatgtttctgaatctaagagatgcccatgtttcttttcctatgggcagagagagagagagagaaagagagagagagagaaagggagagagagagagaggaacacagagaaagagagatctgggcagtttttctggctgaatctcattaagatcagaatcattatctagtttataaccgtttcagtttcagaggcctacaatctaaatgatcaggaattccctccttgacatctaatgtaggtaagggaataatgccaatacagtgagtgcttacttactacccaaaatgttctatcgaacccacgggttgcaagatcctgccctctaacaatgtagaatctaaatcctgcattgtgtcattccaacatcacggacactctcaggtaaatactgtatataaaagaaaccaataaatacacctctgtctacacaatttgtttttagtggggaaagatggagctacatttattacatttctttttaaaattctgatatgtacattataagaaaggatttctacaattcttattccttaacttatttcagaaagatttcttacaaaaaaagaggagggaggttggggaaaatttcaaagtcacaaacacacatcaggaagatacataaattattcaacaccaagagattaatgtaaatcagtaaacaaagcccttaagataatgaccgccatggaagccaatggcacctgaattaatattaatgaggccgggcgcgatggctcacgcctgaaatccagcactttggaaggccaagatgggcagatcgcttgactccaggagttcaagatgagactggccaacatggtgaaaccctgtctctacaaaaaatacaaaaattaaccaggcatggtagcatgggcctatagtcccagctacttgagaggcttgaagtgggaggatagcctgatccatgggaagaaccttaggaagtcgaggctgcagtgagccatgattgtgtcactgctctccagcctgggtgacagaacaagacactgtaaaaaaaaaaaaaaaaaaaaaaaaaaaaaactaaaatattagataatgataaattagggctctatgctgcactctccttcaggtgcctatgcatgtcaaacacaaatgatacccgtgacagcaagatttcaaaaataagcaagtatgtatatatacaccagggcacagacacttgaaatcagaaagtaatgagggcactattaactaaacaaaatgcccatatatcacatcacattcctgattttgtttgtatcaggaatgcgacgtgatatatgggttttaaaagcaaaaagactttcttagtgcacaatgcatataattggtgatggaacaaatagaaggaacccaagaaaacacaatgtaatggcagtgcttggggcatctgcttattcattattttcctaccattacaagaaaacactttgaagagaactcatcaagtactcgttagccatctactcagcaggatttcagagcagacttcttaaaccatgggtgataccctaatctccatcaggcactattagagctgcattaatccaggctaattctaaatccaagtgccattagcattctagagccaagaagcaaataggatttgctttctccaagacaaaactccaaggcaccacacccgctggaaaggtcactgcaggactactctttacatcactgcattacattctctgctgcaagaatgaacatgcatacaggcactgaccttcagatttgtccctgcaggaagtgcccacagaaatgaaattcagcaaagcccaaaataggcaggagccttttgtatctctcccaggctggagggaagctgagaactttaacgagctacacactttccaatgaccttgagactatttacatccttaaagtgataagcaggggctctctcgggatcatttagagtgcccgcttttctcatctgagcctttgctgataagctttgaattttatcttctgattctacatttttagcgacaattccctaaacttttatcttctcaggatttcaagccatcctcattctctttcacattttgtccaggtttcctttttccttgctgacatactttttatcctttgaagtttataaacaagctttaagataaagcagctttcttctctttataatcagttgtataccctttccatacttacccagtgcccatttaacaataacaatagcagtcaacacttgctgagcacttactatgagccaggtagtactctaaaccagattcgaaacatggattaattcattcattcttcacaacaattatacaaggcagatgctaatgagaaaaaaattgaaacatagtgaatttaattcacttgtctcagctcacactgccagtaatggtaaaagtgggatttgaacttgggcagcacggctacagagcccatattcctaaccacttaacaattccaagtctttatgaattctgtaattggcatcggtatgggcatcagaataacataccaagttcctaatcataacctaggagagcagtttagaaactggctctgcgtgaaaattagctgggcgtggtggcccacacctgtaatctcagctacttgggaggctgaggcaggagaatcacttgaacctgggaggcggaggttgcagtgagccgagatggcgccattgcactccatcctgggcaacaagagtgaaactctgtctcaaaaaaaaaaaagaagaaaagaaaaaaaaaaagaaactggctctgcgtgagaaacccatacgtacgatgatcctgaacattgtgttttcatggatctacagaaggaggaatggcaaaggtagcaggggtgcatggccactttctatgtagatctccagcccagggaagggcacaaggaaggcacaggcagatgctggcagccagcagcctcagcaacagaggagccaatgcagccagggcagggggaaacagctttctgtgaggaagagaaagggaagggctgtctatcccatcatatatcccatcataagcagggttcttgggagtgtgcatcaccccttttgtgagtacccggaggtggactgtaaagttttacttccctgagaagcatcctgctatttactcttaccttggggaaagaagactttgaaagctatctcctctatcattcatcagagaactaagattaaacaggttgcctcagttcctatcattatgctgccatgacacctgagattcaatttgctctctccatccctgtataacagaaaaggctttttcaggtgcatattttatagcttgggcttaggtgcctgtagaattgacttaagtatctttcgccacagagagcaggggctttgggaaaggctgctggcagagtatgagcaaacccagtggaggagggtggagactggggggtgccaggacacgtgtacaaagaactccagggcctggaactggcaacatagccatcagggttctctcagtcctgatgcacacgtaaacccttatatacctatttctgacaatatggcaggcagcttaaagggcttattagaattctaacttgctgacatttccctcaagcctggctacttcccttgtctagtgttttgctggtgtgcagtcatgccaatatccacacccaaatgtgtattaatttgagtacacctttgcactttatgtttagaaagtagaaattagtggctgggcgtggtggctcacgcctgtaatcctagcactttgggaggctgaggcgggtggattgcctgagctcaggagttcgagaccagcttggacaacatggtgaaaacccatgtctactaaaagacaaaaaaaaaaaaaaaattagtccggcgtggcagcgtttgcctgtaatcccagctactcgggaggctgaggcaggagaattgcttgaaacaaggaagcggagcttgcagcgagccgagatcatgccactgcactccagcctgggcaacagagtgagactctgtctcaaaaagaaagaaagtagaaattattagcagcacattaatgcgtttgctcaactttctagatgtcctcaaatgtttaaatagaatcaatactatatccgctttctataacctctaaaaagagaattaaattttctaaaaatcacaattatgtgtagttttccctagctgactatttggtatttacttgtcttcaacatgtagtatatctgatgacaggcagtttattgtgtgcactttatttttaacatcacctataacaattctatctgaagaaacagccattgcatggttagcccctctgtcttcagggtactcgtaagagggctgatagggatccccagtgacgtaggaggtaagctgagggccgtcaatttccattttgtagtgacccctaagaggctgtgacctccaggcccaatctcttatggcaaaggaagagggtggtcacatatacacaaagaagagattctgggatatttcttgaatgcaaaaccaaaaaatgtgtattcaaatctgactctcctttaatgcctagaacttccatgccctgacagatcagagataagttgacaaatcttagccaactcccctcttggctaaatagttccaaatgaagactaaagaaagcttctaagggaatcactacatttgctctatgatttgtgctgtctttaaggaggcagtttaaccaagtatttccctgcttttgttttaagcttctattatttacctctaacccatccacagcacttttcactcatttgtggatgaaacagccctctaaatactaaaccggaacaagtttataacaataacattagagctatgttcaggagaagtgtagtcaggtgagatattaagtcacccttttcctttacttagccataatttcacagttgaaatatctggatagtgtctatgaaacaaagtgtgtaacagaattctgatttttattttaaattataaagaggggttagaactgaatgcctagaaagtgttgtgttaatttttctcttcccagcttcctcccgctacactgtccccaaattataccttatctcgaaggaattattcaatctttggtctcttaactgaggcagtcaatgaggcagtcaagtcagaaaaatcaggctgaggaggccaataatcccatgtgatggtaattaacattgagtggcctcttctaatgtgctagaagacagtaagaatctgctcattgggccttcatccttaatgaggcagaggaggggttttgataggggggaaatgatttgttggaagcaaaaggaatgggacgcatcttgaaatgtcattttcagagcacctgggcatcctgggtgaggtaagaaattaggttctttacaagtccttagcctcacttcatcaagattgagctctggaggtttcatagatgaggacctacacagtcaaccagggttaaatgacttgcccaaggtcacacagcgagttagagagagtaccaaaattagaattcatagtctttgtatttctagttcattggctggtgcactagaacgaaaaaatattcggcataataaacccccagagccattcttttttgacttataaatgttgagcagataacaggctcagaatctaaaaagaatctgtttgaaacttaaaatttaaacacatagcccacagctatagtactagtcagcagaatgaaatgttctctgtgatcataccttccggccagcattaattaaaaagaaaagaaggaaatggtgtgggcttagaaatatattacatgtacatacaaggctactagctattatcactcatctagtttatttgatattcaatatttcattcaaaaatattatttgcacattgcactgtattagacagtggggctgtaagagtgaatcagacagatatttggcccctctatgtgtaaaagtagagtcttacagtagtcatcaaataagcaaccctctcccaaatacagtcaggttccaatcctctaggacgtgcctcttaccccattatttgtgggccattcttcccactcaaatccacaaaaagggaaacaaaagcacaggtgcttcagacttccctgacgtttgacatttcttgtgtgatagctaagaacaatggatgcatattgtatctctgcagggaactcatgtagacagtagtccccccttatctgtggttttgctttcccagggctcggttatctgctgtacagtacaatgaaatattttgaaagagagagagaaagagagaccacattcacataatttttattacaatatattgttataattgctctattttgctgtgagctgttgttagtctcttactgtgcctaacttataaactgaactttatcatatgtacgtacatacaggaaaaaacattagggtttggtactagcagcggtttcaggcattaactgggggtcttaaaacatatcccccaccatgggccaggtgtggtgactcacgcctgtaatcccagcactttgggaggccaaggcgggcaaatcaccaggtcaggagttcgagaccagcctggccaacatggtgaaactcccatctctactcaaaatacaaaaattagtcgggcatggtggcgcacacctgtagtcccagctactcaggaggctgaggcaggagaatagcttgaacctgggaggtggaggttgcagtgagccaaaattgtgccattgcactccagcctgggcgatagaatgaaacttcatctcaaaaaaaaacaaaacaaaacaaaacaaaaaaacacatcccccgaggatagcggggaaccactgaatttttactaaatgcctaagacatccttctttaatttgtgtaacatatcacccccttctctttctagtccctcctgaaagagtacttttctcagatcccttttcttgactactattaagaccctagaaagtagcgagcaagtgatacaaggaatctgcatactcaaaggccacatcacctagtttccacctttactttgtccagggtagcccgctgtgctctcagttcagtttagatgctttcttatgtggacatatcctaacatctgtagataactctccaggcctgaggggctgtcaaaaattcgggattttcaaaattctggtgtttcttgaagcaaattagtccaataacatagattcatccatcatggttaattaattttttctggcctttatttctaatatctcgctggatttccactgatataaagaaagcttaagatagacagaccctgaaatttactgtgctcctgaaattccattttgtatctaggaaaaccttcattcctctaaggtttcaatttaagaaagttctcctcaggggactgtaaagggacatatatagagctatgacagcaagtaccagggcactgctccgctggcaacacgaaaatgaaagtaatagcccataaacctatagacagaaaccagcactatgtcaaggagacaaggactacagggctctcgactgaagcaggagagggcaattaagacttcttactcctcgtcctgaagggtctcctcctcctcttggatctgtaactggttcttcacgggagctaggttctcggtcttggcgttgtagttccgaaagcagacattgagcttctcatcaaattcatttacgaggtcctccatggacttgaagctgattatttcggaagaaaaattctcaagctcggagagggaggggtcctcgagatggtggggagatgaaccatagaaacactggggcttctcctccgggtcctccgagcaggagggtcgaaggtcctcaaactcttcatccagactcaccagtggggcctccattcttgctcagcaggagaacaacagcgactttcaggatgagtttatctaaaagaaatgaacagcgtaatgtgagtttagaccaggctaatctaaataatagagttaactttagagacacacctgcttccaattccctactccaaaaaacaaggcactggttaagtacgaagctcctggacaagatcgtctaggtttgcattctgttctgtcctaccagctgtgaccttgggcaagtgattaattgctctgtgcttcttattcttctcaagacagatataatactgaacccacctcaaagggctgttagaagactaaaggagtaaacacaggtgagtgcttaaaacagtacctggaagataataagtgccaatattattgaatactttctgttggtgttttagtattattatttttattactattactattaccacagatccatatccttaactatgtgatctgaaagctgaaaattctccatgacttgtttggcagcaaaatgtgacatgatctaaactcatctggcaactaaacatgaccaacatgaatataaagctgttcatggctttaatttatcccattttgtgtgttttgctgcagaaatattaactttttaattacaaagattgctatcccagatcccactggatgaaatgcggaatgtacactctattactactttccaaaatctgaaataatctgaattccaaatgcctggccccaggggttttggataagggtttgtatacctagatattactacccttatcaataaatagtagaaactaataaaacattggctggatgtggtggctcatgcttgtaatcccagcactttgggaggttgaggtgggaggatcatttgagctcactcaggagttcaagaccagcctgggcaacatagtaaggtcccatctctatttttatttttttaaaaaaactaataaaacatcaatagagaccttccaataaatgcctgagttgtttttgtttcgtttcgcttttgagacatagcttcactctgtggcccaggctggagtgcagtggtgtgatctcagctcactgcaacctacacctctgggttccaccaatcctcatgccttggcctcccaagtagctgcgtgtgccaccacacccagctaatttttgtattattagtagagatggggtttcaccatgttggccaggctggtctcgaactcctgacctcaggtgatctacctgcctcagcctcccaaagttctgggattacaggcatgagccaccgtgcccagacaagcacccaaggttttcccacacatagagcatatgcctaggagcagaggaatagactaaatgatctattatcctgtatcctgtaagaaacagacccaactacccatgtgctccaaagccatactccataaccatcttgggcactgcaccctggaacgctgcacacacagaactcccttcagttcccaccaactgtgggacctctacccctcatcgggccatcttcatgcactgcttccaactgtgatttatccatctgtgtgtacatctgggccccattcaattttaacttaaattcctcgaggacacagaaatcctctggatatcttccctggctccaaatatacactgcctaccctgtggctaggcagtcaatcaatatgtgctcgttgaaaaaatgatctatctcccacatacagttttccattttcagtttcaggcagcacaagcattgctgactatcatacccttctctacacgctcaacagaaaggctaccaagcttttctcttcggtctatagggttattgatatagttaggtgctcaaattggaggcgcttcctgaggggaaccagacagcaaaattcatggattttgccctaggagtgcccattctccatctctacctacaaaactaaaactctaaataagcaaggcaaaggacatgccaggcaagaacactgccagtttgtaccgggattttgctgggattaagttgattaccgttgctttaaaacatatttggagcatttacagtttgcaaaggcaacatgataggacctttgaatacaaaaatatatacaagtagtaccatatcttggaaagaagacaggctcgagagccaacagatctgccaatggctggctgagtgacaagcatcattggtcctgatttcctcatttgttataaggaaggtgttggtacagagttaacatctttaggagttatttttaataaatcaataatttaattaatcattttgattgaagtaatatgtttatttaatccaatatatccaaagtgttaccatttcaaaatgtaatccacaaaaaaactaatgaggcagtttttattctttttttatactaagccctttgaaatccagtgtatattttccatttacagtacatctcactttggactagccacattgcaagtgctcaacagtcaaatgtggcctgtggctaccgcaagggacaacacagctctaaagcaaacacaagtaattgccagtcaggggttcttcatcttcagtacatagacccctgcaggctctttgaaggtaactatatttcaatgaaattggtttcctttacaagactaagtattttattttatgcatttaaaaacattatttggagaaggagcccacaggcttctccataccaccaaaggaggtcatagtgcaaaaaagattaagaatccctgagcaacaaaaaagtgagattagaaaagatggcagaatgcagtagagagtaaaacagttttcacagcccagggatttgtgttgattaaggcagtactctgtgatggctaagagcataggctttgggttcctgtcctggtcctgtcactcctagttgggagactttgggcaagttatcaacctcactgtgcctcaatttcatcatctataaaatggagtttaaaacagtgcttcccttgaagattactttttggactaaatgagatcatctttgaagtgttaagtacaatgtgcagaatatagaaagcatccaataaatatcaatcattctagaaaaatcaaagctgggcacggtggctcacacctgtaatcccagcaactggagaggctgaggcaggaggattggttgagcccatgagtttgaggctatagtgagctatgatcacactactgtatgccagcctgggtgacaaagtgagaccctatctttaaaaaaaaaaaaaaaaaagttaaaaataattctaggaaaaccaggatagctaacttacatagaaatgtgatgtgggggctgggcacagtggctcatgcctgtaatcccagcactttgggaggctgaggtgcgtggatcacctgaggtcaggagttcaagaccagcctggccaacatggcaaaaccctgtctctactaaaaatacaaaaaaaaaaaattagctgagcatggtggcaggtgcctgtaatcccagctacttgggaggctgaggcaggagaatcgcttgagcccaagaggcagaggttgcagtgagccgagatcatgccattgcactccagcctgggcaacaagagcgaaactccatctcaagaaagaaagaaagaaagaaagagagaaaagaaagaaagaaagaaagaaagaaagaaagaaagaaagaaagaaagaaagaaagaaagaaggaaagaaggaaagaaggaaagaaggaaagaaggaaagaaggaaagaaggaaagaaggaaagaaggaaagaaagaaagaaagagagaaagaaagaaagaaagaaagaaagaaagaaagaaagaaagaaaggtgatgtgggagtgcttcaagtaaaagaaaaattatccctgccatgatattctctgtgcaatgcttcaatatgcttatcaaacaagagaactattgctgaaagaattttagcatcttttttactaaggcttcttttttcaatttatttgttcaaaggttcctggatcgtgggttccattttacagagatatgaaagccaatccgatagtgttgcaggtatttacactgcctttaaatttgtacttttctctgggaatgacaggggagaagcagatggtgacaccagtggggtttctgatttgaaatgacacagtctatatgattaaccagcaacaagaggccaatccaaccagaatctaggactaagactgagttttgagtgttggcaacaggaagagtgtgctgaaagcactctgcccaggcagagtgtagagaaaatggattcatctagaaaattataaaagacgaaatgaatatcacagctctagggttcagacacatgctcatttgaaacagtccataatatagactgattgttttttgtcaactcattatccaagagccaagaagtgctgcatgaatgaccatctggagatgaagttaaagtgaaagccagtgctgggaaactagtcactcaacacccaaactgaatccagcatttgtggaaagacctcaggctgtggcacagatgagagtcaggcgttctgactggccccactatagcctccaggagggctctgtggattggggttggcagcacttccttagatggtgaccctgccttccttcctttagcccactttctttcgccctcctctcttcacggagtgctttcatccttcaactaaaatgtctgaaacaaccttattttccatcctggcaagcttgcaccatcctcattcatagctcatctgggagccttcttttccttaaagtaggattaatacaagcgatagcttattccctttagacttccaagatcaaaaataaatacgtacatacatgaaaatggcagaaagaaggaaccatgggagggtcgccttttctttttctctttaccacagaacagagcgcaggactatagtctgattgtcctacaatctattccatttattttcactcccaatagatggtgtaatttggaaaagaaaagacactcacggggcttaacagagacccagtaggaaacgcataaacgtctccctgcagcacaatgatgcactcgctgcatctcggggctgcggtacaaatgctcagtccctgctttgctgagctgacccgagtggagcggagcggtggagatttcaccacgctaaccccgctgggcctcggcacctccacacaagccccattccatctccttcttcccatcacttggtccatagatcaactgattccgtgcctcgtcccccatatccgtccctaaaacctaccctgcactgatccaccttcagatttcccactgctcctccgcagaacccacccagtgtgcatgtttgtgcacattttgacagaaaaagtatttcgttgcatatggatcagcaaccccttcgcggttctgcttgctcccctccccctcctcccgctgctccattcacctccatctcagatccccctcctccccccagtccggtggggtaaagaaagcctcctccaggcagcacaatggctggcactctgaggaagccggactcatcccgtgcaggccgcatacacactccactgcccttccggccaaacaagcccggacacgggagagggatgagagtcggggatgcctagcggcgaggagagaagggataggcaaaagggaagaagagcgggctgtgatacctcctcgacgccgtcaaacactgctccccgcattccagagcccggggcccacccgacggcagcgcgccccgccaccgcgcagccgccccggtcccttctcccgcccgtctgtagtaaaacaatcgctctcccggcgtctgcggccgctgccagcggttctgacactgcaggaatgcgcggtctggggaaggctccgcactctggggaggggcacgagcggggtcgggggtaagtttttagggacaaagatgatcttggggcgtttacggtgactggaccagataacggtcccgggacgaggtaccgacccactgccccagcgcgatcgggcggcgttcccttcttcccccagcccccatacctcgccgccctgccttcacacgcgcgcacacacgcgggcacacacacgcggacacacacacacacacacacacacacacacacacaccaggcctggctggagggccgatgctgagatgatactggaagtgcccatcatcccacatctccagggcctggcgcggcgtcccagctgcgctccctgaagggctgggcaggaaggcgacggcctcccgttgttcctttctaatcccagaatgggaccaggtgaggggagctgcggcgaccccagaccgtcctgtcagagaatcccggggcctccttaccacccccaccagaccccacccccagcagtgagtcgggtcctaactaaagtcaacccccgcgacggcacctgtgcgggtcctggcggagggaggcggatcccggggctcagccggacacccccatccacgggccgcgggagcggccggagcgcagcgcagcgcagcggagagccagccagccagccagccagcgagcgctccccgcgcagctccggcggcgcccggctccgctcccgcctccaccccaccccttccccg

SEQ ID NO: 1715 - DNA, 8111 bp, Homo sapiens
cacattcacataatttttattacaatatattgttataattgctctattttgctgtgagctgttgttagtctcttactgtgcctaacttataaactgaactttatcatatgtacgtacatacaggaaaaaacattagggtttggtactagcagcggtttcaggcattaactgggggtcttaaaacatatcccccaccatgggccaggtgtggtgactcacgcctgtaatcccagcactttgggaggccaaggcgggcaaatcaccaggtcaggagttcgagaccagcctggccaacatggtgaaactcccatctctactcaaaatacaaaaattagtcgggcatggtggcgcacacctgtagtcccagctactcaggaggctgaggcaggagaatagcttgaacctgggaggtggaggttgcagtgagccaaaattgtgccattgcactccagcctgggcgatagaatgaaacttcatctcaaaaaaaaacaaaacaaaacaaaacaaaaaaacacatcccccgaggatagcggggaaccactgaatttttactaaatgcctaagacatccttctttaatttgtgtaacatatcacccccttctctttctagtccctcctgaaagagtacttttctcagatcccttttcttgactactattaagaccctagaaagtagcgagcaagtgatacaaggaatctgcatactcaaaggccacatcacctagtttccacctttactttgtccagggtagcccgctgtgctctcagttcagtttagatgctttcttatgtggacatatcctaacatctgtagataactctccaggcctgaggggctgtcaaaaattcgggattttcaaaattctggtgtttcttgaagcaaattagtccaataacatagattcatccatcatggttaattaattttttctggcctttatttctaatatctcgctggatttccactgatataaagaaagcttaagatagacagaccctgaaatttactgtgctcctgaaattccattttgtatctaggaaaaccttcattcctctaaggtttcaatttaagaaagttctcctcaggggactgtaaagggacatatatagagctatgacagcaagtaccagggcactgctccgctggcaacacgaaaatgaaagtaatagcccataaacctatagacagaaaccagcactatgtcaaggagacaaggactacagggctctcgactgaagcaggagagggcaattaagacttcttactcctcgtcctgaagggtctcctcctcctcttggatctgtaactggttcttcacgggagctaggttctcggtcttggcgttgtagttccgaaagcagacattgagcttctcatcaaattcatttacgaggtcctccatggacttgaagctgattatttcggaagaaaaattctcaagctcggagagggaggggtcctcgagatggtggggagatgaaccatagaaacactggggcttctcctccgggtcctccgagcaggagggtcgaaggtcctcaaactcttcatccagactcaccagtggggcctccattcttgctcagcaggagaacaacagcgactttcaggatgagtttatctaaaagaaatgaacagcgtaatgtgagtttagaccaggctaatctaaataatagagttaactttagagacacacctgcttccaattccctactccaaaaaacaaggcactggttaagtacgaagctcctggacaagatcgtctaggtttgcattctgttctgtcctaccagctgtgaccttgggcaagtgattaattgctctgtgcttcttattcttctcaagacagatataatactgaacccacctcaaagggctgttagaagactaaaggagtaaacacaggtgagtgcttaaaacagtacctggaagataataagtgccaatattattgaatactttctgttggtgttttagtattattatttttattactattactattaccacagatccatatccttaactatgtgatctgaaagctgaaaattctccatgacttgtttggcagcaaaatgtgacatgatctaaactcatctggcaactaaacatgaccaacatgaatataaagctgttcatggctttaatttatcccattttgtgtgttttgctgcagaaatattaactttttaattacaaagattgctatcccagatcccactggatgaaatgcggaatgtacactctattactactttccaaaatctgaaataatctgaattccaaatgcctggccccaggggttttggataagggtttgtatacctagatattactacccttatcaataaatagtagaaactaataaaacattggctggatgtggtggctcatgcttgtaatcccagcactttgggaggttgaggtgggaggatcatttgagctcactcaggagttcaagaccagcctgggcaacatagtaaggtcccatctctatttttatttttttaaaaaaactaataaaacatcaatagagaccttccaataaatgcctgagttgtttttgtttcgtttcgcttttgagacatagcttcactctgtggcccaggctggagtgcagtggtgtgatctcagctcactgcaacctacacctctgggttccaccaatcctcatgccttggcctcccaagtagctgcgtgtgccaccacacccagctaatttttgtattattagtagagatggggtttcaccatgttggccaggctggtctcgaactcctgacctcaggtgatctacctgcctcagcctcccaaagttctgggattacaggcatgagccaccgtgcccagacaagcacccaaggttttcccacacatagagcatatgcctaggagcagaggaatagactaaatgatctattatcctgtatcctgtaagaaacagacccaactacccatgtgctccaaagccatactccataaccatcttgggcactgcaccctggaacgctgcacacacagaactcccttcagttcccaccaactgtgggacctctacccctcatcgggccatcttcatgcactgcttccaactgtgatttatccatctgtgtgtacatctgggccccattcaattttaacttaaattcctcgaggacacagaaatcctctggatatcttccctggctccaaatatacactgcctaccctgtggctaggcagtcaatcaatatgtgctcgttgaaaaaatgatctatctcccacatacagttttccattttcagtttcaggcagcacaagcattgctgactatcatacccttctctacacgctcaacagaaaggctaccaagcttttctcttcggtctatagggttattgatatagttaggtgctcaaattggaggcgcttcctgaggggaaccagacagcaaaattcatggattttgccctaggagtgcccattctccatctctacctacaaaactaaaactctaaataagcaaggcaaaggacatgccaggcaagaacactgccagtttgtaccgggattttgctgggattaagttgattaccgttgctttaaaacatatttggagcatttacagtttgcaaaggcaacatgataggacctttgaatacaaaaatatatacaagtagtaccatatcttggaaagaagacaggctcgagagccaacagatctgccaatggctggctgagtgacaagcatcattggtcctgatttcctcatttgttataaggaaggtgttggtacagagttaacatctttaggagttatttttaataaatcaataatttaattaatcattttgattgaagtaatatgtttatttaatccaatatatccaaagtgttaccatttcaaaatgtaatccacaaaaaaactaatgaggcagtttttattctttttttatactaagccctttgaaatccagtgtatattttccatttacagtacatctcactttggactagccacattgcaagtgctcaacagtcaaatgtggcctgtggctaccgcaagggacaacacagctctaaagcaaacacaagtaattgccagtcaggggttcttcatcttcagtacatagacccctgcaggctctttgaaggtaactatatttcaatgaaattggtttcctttacaagactaagtattttattttatgcatttaaaaacattatttggagaaggagcccacaggcttctccataccaccaaaggaggtcatagtgcaaaaaagattaagaatccctgagcaacaaaaaagtgagattagaaaagatggcagaatgcagtagagagtaaaacagttttcacagcccagggatttgtgttgattaaggcagtactctgtgatggctaagagcataggctttgggttcctgtcctggtcctgtcactcctagttgggagactttgggcaagttatcaacctcactgtgcctcaatttcatcatctataaaatggagtttaaaacagtgcttcccttgaagattactttttggactaaatgagatcatctttgaagtgttaagtacaatgtgcagaatatagaaagcatccaataaatatcaatcattctagaaaaatcaaagctgggcacggtggctcacacctgtaatcccagcaactggagaggctgaggcaggaggattggttgagcccatgagtttgaggctatagtgagctatgatcacactactgtatgccagcctgggtgacaaagtgagaccctatctttaaaaaaaaaaaaaaaaaagttaaaaataattctaggaaaaccaggatagctaacttacatagaaatgtgatgtgggggctgggcacagtggctcatgcctgtaatcccagcactttgggaggctgaggtgcgtggatcacctgaggtcaggagttcaagaccagcctggccaacatggcaaaaccctgtctctactaaaaatacaaaaaaaaaaaattagctgagcatggtggcaggtgcctgtaatcccagctacttgggaggctgaggcaggagaatcgcttgagcccaagaggcagaggttgcagtgagccgagatcatgccattgcactccagcctgggcaacaagagcgaaactccatctcaagaaagaaagaaagaaagaaagagagaaaagaaagaaagaaagaaagaaagaaagaaagaaagaaagaaagaaagaaagaaagaaagaaggaaagaaggaaagaaggaaagaaggaaagaaggaaagaaggaaagaaggaaagaaggaaagaaggaaagaaagaaagaaagagagaaagaaagaaagaaagaaagaaagaaagaaagaaagaaagaaaggtgatgtgggagtgcttcaagtaaaagaaaaattatccctgccatgatattctctgtgcaatgcttcaatatgcttatcaaacaagagaactattgctgaaagaattttagcatcttttttactaaggcttcttttttcaatttatttgttcaaaggttcctggatcgtgggttccattttacagagatatgaaagccaatccgatagtgttgcaggtatttacactgcctttaaatttgtacttttctctgggaatgacaggggagaagcagatggtgacaccagtggggtttctgatttgaaatgacacagtctatatgattaaccagcaacaagaggccaatccaaccagaatctaggactaagactgagttttgagtgttggcaacaggaagagtgtgctgaaagcactctgcccaggcagagtgtagagaaaatggattcatctagaaaattataaaagacgaaatgaatatcacagctctagggttcagacacatgctcatttgaaacagtccataatatagactgattgttttttgtcaactcattatccaagagccaagaagtgctgcatgaatgaccatctggagatgaagttaaagtgaaagccagtgctgggaaactagtcactcaacacccaaactgaatccagcatttgtggaaagacctcaggctgtggcacagatgagagtcaggcgttctgactggccccactatagcctccaggagggctctgtggattggggttggcagcacttccttagatggtgaccctgccttccttcctttagcccactttctttcgccctcctctcttcacggagtgctttcatccttcaactaaaatgtctgaaacaaccttattttccatcctggcaagcttgcaccatcctcattcatagctcatctgggagccttcttttccttaaagtaggattaatacaagcgatagcttattccctttagacttccaagatcaaaaataaatacgtacatacatgaaaatggcagaaagaaggaaccatgggagggtcgccttttctttttctctttaccacagaacagagcgcaggactatagtctgattgtcctacaatctattccatttattttcactcccaatagatggtgtaatttggaaaagaaaagacactcacggggcttaacagagacccagtaggaaacgcataaacgtctccctgcagcacaatgatgcactcgctgcatctcggggctgcggtacaaatgctcagtccctgctttgctgagctgacccgagtggagcggagcggtggagatttcaccacgctaaccccgctgggcctcggcacctccacacaagccccattccatctccttcttcccatcacttggtccatagatcaactgattccgtgcctcgtcccccatatccgtccctaaaacctaccctgcactgatccaccttcagatttcccactgctcctccgcagaacccacccagtgtgcatgtttgtgcacattttgacagaaaaagtatttcgttgcatatggatcagcaaccccttcgcggttctgcttgctcccctccccctcctcccgctgctccattcacctccatctcagatccccctcctccccccagtccggtggggtaaagaaagcctcctccaggcagcacaatggctggcactctgaggaagccggactcatcccgtgcaggccgcatacacactccactgcccttccggccaaacaagcccggacacgggagagggatgagagtcggggatgcctagcggcgaggagagaagggataggcaaaagggaagaagagcgggctgtgatacctcctcgacgccgtcaaacactgctccccgcattccagagcccggggcccacccgacggcagcgcgccccgccaccgcgcagccgccccggtcccttctcccgcccgtctgtagtaaaacaatcgctctcccggcgtctgcggccgctgccagcggttctgacactgcaggaatgcgcggtctggggaaggctccgcactctggggaggggcacgagcggggtcgggggtaagtttttagggacaaagatgatcttggggcgtttacggtgactggaccagataacggtcccgggacgaggtaccgacccactgccccagcgcgatcgggcggcgttcccttcttcccccagcccccatacctcgccgccctgccttcacacgcgcgcacacacgcgggcacacacacgcggacacacacacacacacacacacacacacacacacaccaggcctggctggagggccgatgctgagatgatactggaagtgcccatcatcccacatctccagggcctggcgcggcgtcccagctgcgctccctgaagggctgggcaggaaggcgacggcctcccgttgttcctttctaatcccagaatgggaccaggtgaggggagctgcggcgaccccagaccgtcctgtcagagaatcccggggcctccttaccacccccaccagaccccacccccagcagtgagtcgggtcctaactaaagtcaacccccgcgacggcacctgtgcgggtcctggcggagggaggcggatcccggggctcagccggacacccccatccacgggccgcgggagcggccggagcgcagcgcagcgcagcggagagccagccagccagccagccagcgagcgctccccgcgcagctccggcggcgcccggctccgctcccgcctccaccccaccccttccccg

SEQ ID NO: 1716 - DNA, 3457 bp, Homo sapiens
attcataaaacgcttgttataaaagcagtggctgcggcgcctcgtactccaaccgcatctgcagcgagcatctgagaagccaagactgagccggcggccgcggcgcagcgaacgagcagtgaccgtgctcctacccagctctgctccacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggtaaggctggcttcccgtcgccgcggggccgggggcttggggtcgcggaggaggagacaccgggcgggacgctccagtagatgagtagggggctcccttgtgcctggagggaggctgccgtggccggagcggtgccggctcgggggctcgggacttgctctgagcgcacgcacgcttgccatagtaagaattggttcccccttcgggaggcaggttcgttctgagcaacctctggtctgcactccaggacggatctctgacattagctggagcagacgtgtcccaagcacaaactcgctaactagagcctggcttctccggggaggtggcagaaagcggcaatcccccctcccccggcagcctggagcacggaggagggatgagggaggagggtgcagcgggcgggtgtgtaaggcagtttcattgataaaaagcgagttcattctggagactccggagcggcgcctgcgtcagcgcagacgtcagggatatttataacaaaccccctttcaagcaagtgatgctgaagggataacgggaacgcagcggcaggatggaagagacaggcactgcgctgcggaatgcctgggaggaaaagggggagacctttcatccaggatgagggacatttaagatgaaatgtccgtggcaggatcgtttctcttcactgctgcatgcggcactgggaactcgccccacctgtgtccggaacctgctcgctcacgtcggctttccccttctgttttgttctaggacttctgcacggacctggccgtctccagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacaggtgaggaactctagcgtactcttcctgggaatgtgggggctgggtgggaagcagccccggagatgcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgttctcttgctgaggatcttattttaaatgcaagtcacacctagtctgcaactgcaggtcagaaatggtttcacagtggggtgccaggaagcagggaagctgcaggagccagttctactggggtgggtgaatggaggtgatggcagacacttttactgaatgtcggtctttttttgtgattattctagttatctccagaagaagaagagaaaaggagaatccgaagggaaaggaataagatggctgcagccaaatgccgcaaccggaggagggagctgactgatacactccaagcggtaggtactctgtgggttgctcctttttaaaacttaaggggaaagttggagattgagcataagggcccttgagtaagactgtgtcttatgctttcctttatccctctgtatacaggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcgaccaa

SEQ ID NO: 1717 - DNA, 2604 bp, Homo sapiens
ttaaaacgttgcaaattcctttactgttatcccccccaccaccaggaccatgtagggtgcagtctttactccctaacccgtttcccgaaaaaggtgctacctcctttccagacagatgagagagggcaggacttcaggctggatccaccactgggctctccctcccccagcctggagcacgggaggggaggtgacggctggtgactgatggatgggtagtgggctgagaagaggggactaggaagggctattccaggctcagccctgctcctgcagctttgccgctgagtgtaggaaaaacaggcatgacagaccagggtgagggttgtgcccagctgggccacggccatgcgtggggtggcccaataaacaccgtggactcccagcaaggctgctgcctggtgtttcgaggctgctgtggtcgcagacagccgcctcgccttggctccctgtcaacaaggtgggggtgggagcgggagggaggagtggcccctgtcttaagagcctcacaggctgcaccaggagagcagccagcctgggccaggggccgccaggtcccgagggtggctgacccaaacgtcgtagatgcttttgttgggtggcaccccttggaagagggcgtctagatcgcagagcagccctgggggccctcgggtttcaggggccaccccccagtaggcagggctggttgacggacactggggacaggaggtgggtggtggtgccaagggcattaccacattgggagtgtagataggcaagtaggaggtgggcagctgcccccagagggaggccctgtgtcccccgctggaccgtcccccaggaactgcggtgccctgcagtaagtggagaggccaggccctaggctctggggagagggttgagggcccgatggctcccccctgcacagtctccccctccactctcgtggggccaggaagggggcagaggggccacagaggcctctcagaagagggaaggggtggggtgggcaccgcctcctccccactgttccctgtgcctgcaggaactgggctgctctgtggagctagccccggccagggtgccccctccccggaccctcctagcagggacttgatgctgaagccctcactgggtggtggcgggggactgggcggccggtatggccggccgtgcagcacgtaggggcccaggtccttggcgaaggctccacgcgcacctccgttctgccagcgccggcacagggcggtgttctgcagccggagcgcctcagctgggatcaggctcacgtcgaccgcccagaagttgcccttggcctggggctttgcagggtccttgggcacctgggtgtgggggtcagacatgggtggggctgcccaaccttggatgctcaggacttccgcgcgcgctccgcccccgggctccgaccctggcctgccccaccttgcggaagcatcggttggaggaaaggttgtggcgaatggagtctttccagccctcgtagtcttccctgaagaaggggaacacggcctggacctgacggatgatctgaaaccgccaggcggccggccggcgccgtgagcccagacggggagggggtagcgccctacccctcccccactaccgggctcaggggcgcgcggtgccggcccctgctgtccccgaagaaggacatttctgcgcggaagcgcggcagagagggcaaggggctcccggagaagggtcgtgccttgaggccctcagctctcaggactggtcccactggcatacctgggtgggctaggaaggggtgggggtcagggcttgaacctggaagtgggtggggaacgagtctggggaaagagagagtgggggccggggcccgctcacctgggccagcttcagtctgcgggagggagcggcctgaatcaccaaggcgatcatggccaagtaggtgtaggggggcttgtcatgtcgcaggtacctcttcttcctcctcttagggggctgggagggcgactctgcctctgggggccccaggcgggagccgctgcagggccccatgcgggacggtagacagcgtgggcaggggcctggccgggtggagggtgcagggcggtggggcagtgtagaaggcagggccgggacctgaggccgggctggggcaggcgggctggggcctttatcattcggatggaagggggaggggagggaagggaggaagaggctgtgggggaggggagcatgccgagggcttccacaattagcaggttttggttaatctggaagggaggggcagagagcattctagtgggggcttctcctgaggcctcagtctccacccctgagttgcctttgggtggccaggcccggcttcaaaggggctgcgatgacccatggctactttatcccgtcttccctggtcaggtttcaggaccccatttaacaaatgggggagtatttagcccatgccaagctcccaaggcgtggggcgctcctggagttcaagatctagcagctgctagtaggccctgaactatgggggctggatatccacccaggacatgatcaggtggagcttcctggaggagaaggccatgaagcccgcaccctaggaacaagagggggacacattgactcaac

SEQ ID NO: 1718 - DNA, 14217 bp, Homo sapiens
acggctttctttgaggccaggactgggtgatggtgtcgctacccccgccgcagtctgacgtcacgctgccgggccccaccagactggagggcgagcgccaaggggacctcatgcaggcaccgggcctcccaggctcccctgccccacagagtgtaagtacccggcatctgggcctgggtttaggccaaggcctgcggctgcccaggcaacaagaagaccagtcaccttaccgcccccagggacctcccagggcctgtcttgtcccctccaccagcaaacaagtcctcagggaccccgagatccagaggggtcactcctcatcccttcagtctgagcctgtcccagggctgtgagccccatcagatttggggtaccccaggtttcatggcagggtgccctcatgaaatcggggccaagggtaggctatttcttctccaccatttagggtcttcccagagctcagccatagaccccctttaccccagaacagagtagggtcccagccagtccccaggcctggttcagcctccactcacaggctcgctactctctgtctacccagaagcatgccggcttcagctgctcgtcatttgtgtccgacggccctccagagaggacaccctcactgcccccacacagcccccgcattgcgtcaccagggcccgagcaagtccagggccactgcccagccggccccggccctgggcccttcaggctctcaccctcagacaagtatcctggctttggctttgaggaggccgcagcaagcagccctgggcgattcctcaagggcagccacgcgcccttccacccgtacaagcggcctttccatgaggacgtcttcccagaggccgagaccaccctggccctcaaaggacactcctttaagaccccagggccgctggaggccttcgaggagatcccagtggacgtggcggaggccgaggccttcctgcctggcttctcagcagaggcctggtgtaacgggctcccctaccccagccaggagcatggcccccaagtcctggtgagtactagtggccagcgagtgtcccatcttcccactgtcccagttcctagcagcctagaaagagtcagacctctgagaccaaagtcccaccttctctttgcagaccttgccactcaagaccagagagttggggcctcctggtcagctggggaggggtgttggcctggccagcatggaggggggcaagtgggggaggtaggccaggctaaagaagctggcagcttcccagaggctcctgagtcaggattccagtgtgtgacttctcactgtttgtttaaatgtccagaaactccagccagacctacacacccatatgcaaatgtgacaagaaaaacacattccagaggccaagggaaagggtttggggaggagccatagtacacagtttttccctccccagccttagcatacagagttgagagaggactttaagtgtggagggacccttcctggccccattctttgcccagagtggggcctgggtgtattcctggaaataccttggaaggttaacatgtccttccatagcctgacctccataagcggcgtgaccctggacaagtcttaacgtctctgagcctcatctgaaaagtaaggtcaacattacctgtctcatgggattgttgcttagggaagataaaagctaaagggaatttgctccctgctcccccgctctggtttggaggtccctgaggcagtgactgagtgggcgtagcctcagcagtgcctactccacatgcccaccagcccccctcacctcttgctttcaaacaggcccccattccagccccaagccaccccaacaaaggcttagaaggaagatggagaaggcggttgggtcctaccaggtgtggccaaaacaggactttattctggccctttgaccacttcttctcaggccccttaaacatgaccacagcctacagatagggcaccatcatctcagctactgcccccaaacctccactcaataacagctgccaatcattctgccaggtgctttctttcaagtgcccccatttaatcccctcaacaacactctagagagttcccaccatacccgtgttgcagatgaggaaactgaggctcatagaggccaagtgacttgcccagggtgtctcctaacctgcaaatggtgaggctgagattgagttcacacccttgccctcccacacatggagaagagctccagagacacacaggtatctggtcgacttgctgggtgaccttgggcatattgcttcccctctttgggctcagccccatcatctgtcaaatgaaggggttggacacaagtgctcttggcccttctaggcccgagattctatgattatggcaatctctgcatcaacaaccccagggcacacccagagagaggtcacagctgatttgcccctctgggcccagatgctggtttcccaaggcccctggtaaccccaggaagtgcaatccgcctcctccagggcttgtccaccttccggggcctagctgcacaccctcctgtccgtactcaccggagagctctgcactaggccctgggactctgtgccggcctctcacacatgggaaggcggagtctggccatcatggctagcagcagctgcaggctccccatgcccagtgtgagagcatccacaggactcacgcaggccagcaactgtgcagactccctggagcagggagcaaaagctctgcatcagggatggccaggagtcagagcggagaggagttactagccccattcagagatcctgctggagcttcctggggctgtacagaggaggaaacagaagggacccaggcccacagctggaccagcctgtctggccactacccatgctcccctcaccatggatcctcagggagagttctggagctgtgaccttttcctggtgtcctttgcacacctactcagagggtctgagacctctgagtcaggcgtgtcgagtgaggtcagcaccgtgcctttgtgctattccagaagatccctgtccctaccccagcacaagtctccctgacttctcaggacagcccagcctcagcctctcccctgccgtgaggggaggcgtagggactgctgtcagttccagccccggctctaccactaaattgctgagttcccttgggaaaatctctgcccttctctgttctctgttgttctccaggaataagctttgggggaagcagaataggggttgcttttatgtaaggttcaagacacaggaaagaggaagggagaaaataaggcctaatctagtcatctgctttctcttccagcagggttcagaggtcaaagtcaagcccccagttctggagagtggtgctgggatgttctgctaccagcctcccttgcagcatatgtactgctcctcccagccccccttccaccaggtgggtctggggcaagtgggcctgcttcccccaggtctgaggatatcgtgtgtgtgtatgtggtgtgtgggtgtctatgtgatggcatgtgttcaccaggataggcagataaggacagcagggccctgaaccttaggcttggccacagcaggtggcgggaatagttaatgggaagagaagcaattgccctcctccaggggtgggcttgtctgagtccctggcaaggcctgagaggcctcagataagagtgtggggctgagatggaggcagggctgtgatgtgagccagaaatgggggaaggaggagagctgccccagacagagagaggggcaaagaggagtgtggtgtgaaacacaggccgagcaggtcgaggaacaagggcttctgtatagtcagccaccatcttgctatgtgaccttggcctccaacttctattagcctagaaagggtgggcacccagtgtgggcttaggggaccttcccacccagaggactccaagtccccatcatcttcagccctttcctcctttcccagcttcagctcctcccaagtgtataggatgccaagtaattgccccacactggcatgggatggaggagttttaaaggagaaagaaaagagccccagagcagccaggcagctcccaggagtcaccaggcaagacagagcaagtggctgcccagcgcccagctccatccacctgcagcctggcactgagacaggccctgcctgtggagcaggttctgcacccggctctctggcactggccctgatctcagccaagccagggaggaaggcaagggagaggggctgggtcagactgctggctttgcagggaaaagaaagagatagagggaagcaaagagaaggcatgagaggacatcctctctgccatgaggggcctgggtggaatgaccgaagctatcctgaggctcatggtctgacccagggtagaggatgtccctgaggcagggacagagattgagccacagaaggactaaggggccaccagaccttaaatgacctcaccatgcctggccctgctttgatggcctctgcagtctgcaccccctctcaagatggccacacccagggctttatggagcctggaccgaggtgactcaggcactaaatgtctcttgggtaacctggaaagagctcttcagcctggagcagctgggggagtcagagtctcctacccccatcccccataaaacaccatccgtggcaccgcagccactccctttgccgtaaaaccacctcctaccccgacctgtccaccaccatgactggccctttcaaagagccactgaaactcataaaaggtggcagtgcccagcaaacgcccaggctggacatcctgcttccggcccagctgctctgggagatgcacaggcactgggagcaccttcctggaagggtgcaggggccgagggcttcacttcatactctccctgcagggtcccgtcaccatagcaaccagagcatcaaaagggctgagaggaaggagctggaggaagagggttttaaggcctctgagatcctgaattacagggtgtggatctcctcacagcccctcagacagctctgctttgggggtgatggggcccatgacccaggagggaagaatctggcctgagccccttctctggatgtatataaatggggaggagggccctcctgggaaaggctgggtaccatgcaatcactctgccccttttgacctcctcagtactcgccaggtggtggcagctaccccataccctacctgggctcctcacactatcagtaccagcgaatggcaccccaggccagcaccgatgggcaccagcctctcttcccaaaacccatctattcctacaggtacatttcccactctccagggatgggaggaggaggggagtgagagggcccctgggaacactgaggcatggaatcctctgggtctaccagtaatggcagcaggtggaaatcataccagtgggcttccagaagatgctggagagagggttcctgcatgaaggcaggggcatagactggatcagctctgaccctttgtctaagcctggggagtcatgtctgtgacttgactcagcagatgctggtgccatgtgatgagcctgccaaggtctcacctcctagggcccagggcctggatctgagaatttaagggggatgcttgctgccttccctgtgcctccccggaaacagacggaagcccccctcaaagctctactggaaggaaatgggggatgaggcctgcagatgtgactcggctatccaccatctgccagatctggtgggacttctctggggctgggttcttaagtgtcagcagacccagcctgtctgggagacccttccatctgtcctttcattcatccaaccaacagtgacacttggccaaatatgtgtcaggccctacatgggatcgggtcatcagctagtgtgagctgaggggaagggagaggaacttaagcatcagccaggagtgcagagaagggctttgtgaaaggcaggatcattcactgaaagacatacacgcagctcttggagtccagcagaaatgagttcaagaccagctgtggaactgaccagcatgaaacctcagggaagttacttaatctctctgagcctctatttattcctctttaaaaaaaaaaaaaaatgtcaggggttgggggcaaggggagggacaacgttaggagaaatatctaatgtagatgacgggttgacgggtgtagcaaaccaccatagcacgggtatacctatgtaacaaacctgcacgtactgtacatgtatcccagaacttaaagtataataaaaaaaataaaaatataagacttttaagattcaaaagaaaaaaatgtcagggtttggggtagcagttcaggctgttggaaggattaagtaagagaatgtaggtactgtgcttggtacattgcataggctcaagaaaccttagttccctccctactctccaacattcatgcaattggctgaggactaactagtaatgacagcttccgtttaatgagtgccttctatgtgacaggcaccatccttaatcctcacaactctgaggtagctattactttcttcacttcaaagttgaggaaactgaggttcagagagggtaaggcattcacccaaggtcacacagccagagagtaactaggccaggatggccacccaggtttctcagattccacaagaccctcgcacgtctgtaattcctgacttccgtgctcacttcaatggacaccttctcattcccttctctttcacctccaatcccatagagcctctcaccaggggtggggggcttggggtgggctcaggacccagtcagaggttcggactctcaggggctttctctttcttcagcatcctcatcttcatggcccttaagaacagtaaaactgggagccttcccgtcagcgagatctacaattttatgacggagcactttccttacttcaaggtgagcccaagattcctccccatcccatcacccccaagtcctggacaggccaggcctctctgagcagaggcttctgtctggaggtgggagaagaattagaacgaaagccaggagagggcttacccccaccatgctttccgttgtctccacctcagaaggacagagttcctacaaaaggtgctccaagtggggaacagagagcccaagtggctcatccaaggttgcacagcagactggagtcagaccttctgctggggaaggtgggcaaggtagcaccgatgggcctcagggagcatccacctaccccaagtgggaagagaaagttggagaagaaataagacactattgctaccccgaccgctgggatgctgtggggctggagaagctagtcagccacggtgactgggaggtcggggctgaagaagccattgccttccaaggtgagattaggatctatctctgtgggtggcaggctcagctgcagttctgccagaaagcggggtgtgggcttcccagtctttgagtgtcccaggctggctcacctgactctcccccaaccccttgggcagaatctcatttctatcattcacagaaggcgcttctgggagccttacccagctccctctctagaggcaggacaggggctcttctcccaaggtggacaaacacatcagacagggtggtccattcccctaaggtcgcacagtagatgggatcagttactggatcaagctatttggctttgcacacccctctctgcgtgccacctagaccctccagcacagacccccttctcctgggatgggtatcagggagaccagagattgtgtgtgaggagtgccttctccaagccctagtagacacaaatctcatctgtcacccaggcagtgggcagttgctgagacccgggtaatccagaactcagctccacctgccagggggtgattcctgcccccaccatctatggtcctgcctggggataatttgacgcttgatgttcaaataagtttatcctgctgggctgccatcagatgaggagtgggcaagttggccggagtggtctgtccaggagtggaaaagtgtgttgatccaccagaggttctggaagggaaagagggagggaggtgagtcgtccctggaattcaagaagcatcaaagcctgaattcagggctgccctccataccccagcaggtcaggggctgaactctccctaacccctaaagcttttggagggtcttctagggtttcaaggggccagggcagagagagggaaaagcccagtcctctcagccttccttccccaccagctcccggcctggcccccacccctccccgcatctcatcttcctggcttaattatttttcctgggagccatgtaatccctgttttatggggctgaggagtgaagaggtctaacagctttttgttccctttggttctagttgttgcttttagccacttgcatcactccctcactcctgagtttacatttgatctcagagagaaagcatctgtgaggatgggatgggccccagattgtgaggcaggccctatggggtgacctgggcagggcccttagctgggggacagagttggaggctaagctctgtcactgcctccttgtgtgatccagggctaggccctttcttctctgaacctcagtttcccagtctgtaaagtgggtcagatccgttggcacatagattccttctgactctgacagttcccctgtgacccacctaaggaaattccttagttcaaagatcccccacctctttccatctctcacttcccttttgaagatcatttttctgggcaaggatagactggaccctggagtggccagcactcatgcccaaggcagctgctgtgggcatcccatagccccatgagtcagggatgtggggctggggaagtgtccagccactggacataattgttagtgctgaccatccctcttccaaacaggaagtggctggggtgggggctgccctggcatcccaaagtcacagattcatggggccataaaaggccccagcgcccattaactccgcccatggggcaacgtggccttaactcctagtggagactgtggtgggagtcgaaggtgaatccctagttggctggtctggtggctcaagaatcctccctggtgaccctgggagccttaggggtcatctcaaccagcaacctgccccaggccagctgcccccaagaaaggctgcaccaggtcctgccagccacttggagtgacgctggcatcaagacccagttctgctgggcatgattcagcttggctgctccctggggcaagtgagctgaggaggaaggagtggccgcccctcattaagcagaaactttgggctgaaagggggaggggccagggaatgagggcgaaggagccccaccggccagagcgagtgccctacccacagtcagcccctgctgaactcagggctgtcacagagcctggaacagagctggaggtgggcgggcagggggcccactggcactcccgccaccgcctctcacccaactgagtcagcctaatggtttttacaaccctccctgggcacaattaccacactggtggcatgaccaggcctcctaatgggtgtttattctattggcacgagcacccccccccactgcctgagggctggcctccccaccagggcacgccccctgggcacactcatgcaaacactcacacccacacatcatacgatcatggctacccacagtcacacccagagagactttctcacacacagccatcctcacagtcgaggaattcatggacccatgaaggagtatccaggagacgttgcttatgccaggatgacacacttagggacgtatgcacatgctcatacgcactgtcccttcatataccaaacccacttagacacacaaacatatgtgcaatgcacacaccgcacacacccaaacactcaccaacctcgcccatctttcttttctcccaagttagtcccagaggggataaggcagacccaggagaggagcattcttcccctaattcccctgtctaaagccagccacaagacctcagagtaatgagtcccccttccacagaggggtccaagcacaggcatggagacccagtggggagtggctcagcttcagatgggagagtgttgtgggtcagaaggcctctgtagcgcccaccagccctggctttccgaatcacctcggcagtcctctgaggggtcaggaagggatgcgggtgggatgaaggcagatttgagatgaaaataacttggggtcaaggttcctgttcacccgtcccctaccaccaaagggtaccaagcaagggatgggtgctgaggaggacaacaagccccagagtgggcggcagctctgtgcccagaggagaaacaggagtgttctagaacccagacctgaagcccgctctggcttcctgagcctggcctgaatgcttgtcttgctctgttccggcagacagcacccgatggctggaagaattctgtccggcacaacctatccctcaacaagtgcttcgagaaggtggagaacaaatcaggaagttcctcccgcaagggctgcctgtgggccctcaatccggccaagatcgacaagatgcaagaggagctgcaaaaatggaagaggaaagatcccattgctgtgcgcaaaagcatggccaagccaggtgaggccggccgggccacgcaaggaagggcccagggtactcatgagccaaaaaaaaaaaaaagagagaatcagagaatgaggcaaggccccgagtaagggttccagtctggggaagactgtggaggagggaggtctcatggtgttctttctctcttgggcctttcagaagagctggacagcctcattggagacaagagagaaaagctgggctccccactcctgggctgtccgccccctgggctgtccggctcaggccccatccggcccctggcacccccagctggcctctccccaccactgcactcactccacccagctccaggccccattcctggcaagaaccccctgcaggacctacttatggggcacacaccctcctgctatgggcagacatacttgcacctctcaccaggcctggcccctcctggacccccgcagccattgttcccacagccggacgggcaccttgagctgcgggcccagccaggcaccccccaggactcgcctctgcctgcccacaccccacccagccacagtgccaagctactggccgagccttccccagccaggactatgcacgacaccctgctgccagatggagaccttggcactgacctggatgccatcaatccctcactcactgacttcgacttccagggtgagctgggggtgggaaagggaaggtgggacaggactggagaggagcacctggcagtgggactcatcttctccaagtctccagactgcagcctgcaagtggctgggtttctggtcaactgaagcagaggaggctggacctggcagggggagcttcccacttgctctctgccatccagagaatggggaaagagggatgtccttgcccctgtctccctcctcctggtgctccaaacatggtccaactgacctcatcatcaaaccactcttggcagggcacagtggctcacgcctgtaatcccagcactctgggaggctgaggtgggcagatcacctgaggtcaggcattcgagaccagcttggccaacatggagaaacactgtctctatttaaaaatgcaaaaattagctgggcatggtggcatgcacctgtaatcccagctactcgaggctagagaatcacttgaacccgggaggcggaggttgcagtgagccaagatcgtgccactgcactccagcctgagtgacagagcgagactccgcctcaaaaacaaacaaacaaaaaaaccactctcagctctggagagactgcaaagggctccgtgttctattctatactcgattgtgagtgaccagtagtctgaacattctcagatgcatttgcattttatcagagttcatcttctaaagcagaaggagagagactctaccctagaggaagagtctcagagctgggcaagtcctggagagatttggagataggagtttggggagggttctacccattccactccatcttggctgctccgtctctgcagatggctaagcccacccattcccgtctaaattccagtgcatcccaggccctgatactggccacaggaggtttggaacggggtgacgacccaggcctcagactctgtgtgcacaggggtgggggacattcacaagctgatggaggcagcctgtcctcagagagctcccaacccgatggggagacaacccaggtttaggaagctattagaaaagtgcacatagatcctcagcccagtccagaagtggggagcagggctcaatcagcctcagaggaagctatagacatgtgggatacgaaaaacatttacttgatcccctgctaggcatcaggcatcaggctggctgctctctatgtgctttctcatctgggcctagaggataggaaggattattaaacctgcttcatggaagcacacagaggcttgagaacttactctaggtcacttagctagaaagagggagagttgggactggaacccaggcagccaaatccaatccagggtttagtcaggccctctctctccagagcttgcagcctggatacccagtgcaggagccccaggccctggtcagccatgatgagggtccacaggtggcagcactgtttgctcctcggactcaggtgtgcatcctggctctgctcccattccctgggccctgcagtggaggagacccagggagccatgcccatccatcccattaggtccagagtacactgccggaagctgcttgatctgggctgcaaatctaccttccttgggagactgggcatgagccagggttcactcccaagtgcacaacattggcatccatgctgtcagcctgtcagcaggcatcaacccctccccaatgcccaccccccaaaaagaaccacagaggtcatctagatcgacggctttcagattgtgctacacgggaggaggaatctgaggctgagaggttcagcaactgcctggggtcacaagctagtgccaggctctgttcccagcacatgtcaccctgacccctgctctctgcagcatgtgaagattgacagggaggaggggccagacagggctcctccggtgcctcccagtgacacctgttctctccttccccatctaggaaacctgtgggaacagttgaaggatgatagcttggccctcgaccccctggtactggtgacctcatccccgacatcatcttcgatgccaccaccccagccaccacctcactgcttcccccctgggccctgtctgacagagacaggcagtggggcaggtgacttggcagccccgggcagtggtggctccggggcactgggtgacctgcacctcaccaccctctactctgcctttatggagctggagcccacgccccccacggcccctgcaggcccctctgtgtacctcagccccagctccaagcccgtggccctggcatgagctgtgcccagcttcgtcagctccagcgtttgcctggtctggaagtcctggccggccgcccacatcgggctcaccttaaaggtcaaggaaggaaaatactacctgtcccctatgccactaagccaacgtgtgtgtcagctggtagctgggggcgcagaggacatcacctggggtgctgcctctcacacatttctgccacgtggtggcccagctcctcacccagggcccccaaagagcaagcgtctgggcaagaggaaaatgccctgtccctagctcacactcatccacacttaagccctcgtgcacacacacaaattattcagatgtacacccacccacatatcttacagccagaggaaccagcactccatcactgagagcccgacttcgtttctggggcaactgagagctgagcgctttgcttaccaaaagctcagggccctgtgccaggccaaagatccccccagacccccattctgacatccacatgctctgcagtcctggccccctcgtcattttctttcccagaagcgccctgtatttattcccccatcttcatcccaacagcccagcaagaaggaggagacagagagctcctccctgggttgtctgtggacccccccaggagctgctaattggcagcacccactcagccattctctacccatccttagtacatgctctgtccagctttccccagggtgacatacagaaggggcaa

SEQ ID NO: 1719 - DNA, 14392 bp, Homo sapiens
tgtggggagctcggctgcagtttattggggacggtactgtgggttgggggccttggatcccaaataaatgagtagttcctctgcagtctaagctgaggcatggatcagggctcagggaatgggagtgaggtgagtggcaggggagacacggggtatttttggcaaggcagtgtgtgtggctgtgtgtgtctgcacgggactcaagagacccactggggggctgtgcgtgtgcatatgcgtgagatacacaggtgaattctaacaggccgtgtgtgtgagcgagcacgtgttgggacctcagatcctgagggtactgacgctgcttctgtgtaggcctctgggcacacccctgtgttgacagtgcccctgtgggccctgaggctggctgtgggtgcgtgccttggggtgtgtgggttgtcagggctgtgcttgtgtgtgattgtgtgatgatgcagctttgaggttgtttgagtgtactgaggcaggctctctgtgttttggggtttgtgttgagtgagggacaggattgtgacattttgtgtgtctgtgtgacttttccagccctgaagtaatctgtgcgagcagctgaggcaggctctgtgtggctggttgtgaaggctctgtttggctgcagggctcgactggggggtgtgtctggggcggaggtgggggctggggccaggaccggggcccctctgagcagccttggggcaaaggatatgatgggggagggggtggctgccagcgggggaacaggggccctggcaggcaagacagtggaaacctcacttcttggtccctgtgggcacatccagggcctatcatccctgcccccaccacctctgcctcccaccagtttggcccctgttcgtccatcctcctttccttgatcttgaggtcaggggccaggtgtagggttggaacacctgctgggcctctggctccgtttcttgcggaactccagctcatccacggtccacacagcccccttctcgctctccacccgcacaaagcacttgtgcagactcaggttgtggcggatggcgttctgtggaaggccggggacagggagcaggtgggcgtcaacctctgaggccagcagccaccaccaacaacccacatcccgttcctccccaatgtgcctatgagcccagacccaggcctgcccactttgagctgcgatggcacttgaggccatcccagtcaccgccacctcagaggagctcaccttccaggtggcaggatggtttctgaagaaggcaaacatgcgtgtgaaccagtggtagatctcattgagtgtccgctgcttctctggagcctccaggatggcctggaagttggggggtggggtaaggggcacattccccaaacttggggtttagaggggctatgacctaccccgagccatctgacatgggggcggaattgtaggggcaggtaatcagggacaggactagatgtggggtgaagcatggggtcaaagatggggttagaaaaggggtgaagtgtcgggttgggcagggttagatgggtgtgggtatggttgttctgggattaggtaagggatcaggactgaggttgggagtggggtcttgttcagggctagggctgaagtgaggtgaaaggtctgggatggagttggagttggggttctctgtggaggtgacatttcagggttggggaaggtgaagggtcagaagtggggtcaaggatttggaaggggtaaagggccaggccaacttaagggtcagggaaggggtgggttaagagtcaggctggggtggactcaggtggggggtctaggggtgagggatgggatgacttggctttaggtcagaagccagagatggtttgaattatcgagtatcttacgtgtcagggacatggttaggtggttaggctcagggcaaggatgaggttagttgtggggttcggtgtggagtgaggctgagggtcagggaatttgatcagtttggattcaggaatgggattacagagtcagcgatgatgattgcagtgaggctatcagtcaggatggggctaggtcagggtttcagttcagagacagtcggggaatatctggtatcatgtaggggtgaggttcaggtttggggttaggtgtggcgctaggatgaaggttctgagaaggcattggggaggctgagatgaaggagttgggatggggtgatgaagttaaggatcaaatgggtgttacaaggaaaggttgggaatggtgcccagttgggggtgtattgacatactggggtacgttggggccagggaaggagatggggttgggttggcataaaggctggggaaggagttagagtaagagctggggtacgtttagggcaaggtgcagagatggggttagctttaggctattttatgggtccaggagagggttaggtatggggctgaggtggacatctggaaaggggtaggtttagggtcagaatttggcatgctctggcctggatggtggtttaggtttggatttgcggacaggtttggggtgaagccagcatgaggggtcacatttgaggcacggcttggggatccttggggctggggcttgggaatggaggaacccactctgagggcactcagagggagacaggagtttgggaggcaggtcccccaccccatctttgtcttcctcctccttggggccgagctgccctgcttacccagcggatgagcgtggcgtaggtgaaagggggtcgcatgttgtggaacttgaagtagtccatgttgtggaggaactctgtcagagggtggggatgaatcaagccccatgcaggacctcctagctagctccctgtcccctccccctacaaggtgagtctacaggcctgagatctcaccgtcaacacccgtgtccacgggcacaggtactgtttgctgagcacctgacataagttgtatcatttattctttgcaccacttctgccaaaatagttctccccgaggttgaaaagaagcggagtaacttgcacaccaaaggatgcaagaggttaaatggcagagccaggatgacagtcaaggtctctgatccctgctaagcccacaggccaggcctggtggagagcagtggataggtgagctcgggcgaatccaccccgattttccttggtcaggggaggaaaggaggtgctcctggaattacttagcagggtccctcccttctgatggccgaatatagtagctggagtccagagtgggtgaggcatggccccaatccccaagggagtcagggctaggggcccgacactcgagaccatatggggggctttcaggccacggacatcccgaaaggaagcttttgtgagcggatgcattttcccaaaggctgagtggcggcagctgcagtggtggtggtggtgggaaggggcagcatggagctcctttgcaccctccacccagagcctgtcaggattaggagcttgggggcaccgtgtagtgcaaggaccattcttacctgggaatgtgctgtttccatggctaccccacaggtgcctccggacagcaaacaggctgtcaggggcctcccgggggccagaccaggctgggacgacagggccttggctgccagcagctacgatgcagcaggagcccttgtcggatgatgcctgggtgagggggagaggctggtgacccagaggcttaaacttcccactttttactttctattttatgttttttattttttttgatactgagtcttgctctgtcgcccaggctggagtgcagtggtgcaatctcggctcactgcaacccccacctcccagattcaagcaagtcttctgcctcagcctcccgagtagctgggactacaggtgcccgtcactacgcccagctaatttttgtatttttggtagagatggggtttcaccatgttagccaggctggtctcgaactcctgacctcatgtgatccacccgcttcagcctcccaaagtgctgggattacaggcatgagccactgcgcctggctccactttatttttaaatcagtgtttttcaaagcaaggacgccctcttctaaattccagtctgaggtggaatcccacaaaacagcatgagccgtatttattagagcacaggtgcggatgtcgtatgtggccactgatgctgggaccatgaactggggttgaatagggctctttaccacccaactgtgaccttgggaaagtcacctaaacccccctggcctcaatattcctcatctgtacattcgcatcatgagaaataaattaccaccagcaaagcgctcagaaacagtgcctggcctccagggctggcttcatgggcgtgtgacctatgtggttatgtggcaccctgtgctttgtttaatgctctgtggtcgccatcttgaaatctgaacaaggggccctgcaggttacatagctggtcctgctggcacacagcctgcatctggcaagtctggctatttgcatttgctttaacaactcaggatcacagtgtttggggatcttagagtcagagggttttttttttttttttttcttgagacggagtcttgatctgtcgcctaggctggagtgcagtggtatgatctcagctcactgcaaactccgcctcccaggttcaagcaattctctgcctcagcctcccaagtagttgggactacagacacctgccaccacgcctggctaattttttgtacttttagtagacacagggtttcaccatcttggcgaggctggtcttgaactcctgacctcgtgatccacccgcctcggcctcccaaagtgctgggattacaggcgtgagccaccacgcccagccggggtcagagggtttgtaagtagaaggggacagatttccaggtctgggcatgtttggagctggggacaggggcccctagctctcaggacctgaatgtgaggttaggttccctgcaccgtgcagacctcctccctgccccccagcagtctgagtctgccaccaccagtcctggggtcgctcaccacagatgaagccttggtcagtgccattttcccagccaggtgggcctgcatggcactcagcttctccttctccagcaccagctgtgaaatggcacaaacatgaggcctcagcctggcccttctctgccacatctttgcccaggctacggtcttccctgggagtgcccgctcctcttccttcctttataccagccctcgtcccaggtgaacttggtttctggcacatggtggacagaaggttttgcgcactatccctatcccttaccctccaccgccctggcattacctgctgctccagagactgtaccatctctctctggaggagacattgtgccctgcccttctcatccagaagatggtccgcctggcagtgcctaagtagggagaagattccatgcaggtgaccacgacaggcctggtctggctcaatgctctgaatggggagggcccagaccctctgggagttctctcctctgagccccagctcccctcccctctctacctcagtctccctctcacacccctcgttcccttaacacatgcccctcagcacctactgcatgtcaggcctgaactcaccacttgagcctggccagagtgctggagataatgttggaagtgtggtgagttgagaatgggccagggaggtgagagtgggcaaagcattctgggtggagggacggcctgtgcaaaggcctggctgcaaggaggacaggacatgtggggttgctgctaagggttgtgtgtagtgtggtgtgtatttgtgtgtgtgtgtgtgtgagagagagagaaagagagagagagagagagagagagagagagagagagagagagagagagagacatatggggggactgaggggaggcagcagcagccatctagaggagctagaactttgggaacagtggaataaggctggcatgttggcatgaggagtagcagggcaaagcaggagtgcagattctagagcctggctacatgggttcaaatcccagctctgtcactcaggaactgggagattttgatcaagacacttaacctctttggcctcagtctccttgtctgtaaaatgggggtaaataacagcacaaacgtttcttattatacatacgagaaaactgaggtcgagagaagctaagtaatttgtccaaggtcacacagccagtcagggatggagctgggatttgaacccacagtctcagagtttagctcttgcatcttactacttattgggatgaagcctgagctgagatctgcaccctagacctctccccacaagccagggccggtagactggcacaggcctgggccactcacttgaggaagtcctctggctcttcgaagaccttctcacatccgggccacttgcagacaccatttgccagcagtgggtaggagctctggggcacagccgaaagggtgctggggggacagagggtgtcaggggaggggataggagggcgaggatccttcccagccctgtccactgacctgtccttcctgggtgcactgggatttgggaaggtgcagagcagtgccggctccctggacacccattccaggctggccacgttgatccctgtgggtggggacagggcacctatggaggctgtgggctgggctctggagcttggcccacaaggcctctcattttgagcttcccaccctcctgagcctcgaaaaccctgactcccagggggctctgctgtccccaaagtcccaggcttctggcagagaagcttaaagacggccattcgcaggtgctgacattttgactagctttgtaaagctctgtggttttgtgattttgacattctgcatctttaaggttctgcacctgacgttttttggagggtggagtttccaagcctctgagacctgacacctttgacccccagagtactgcaattcagaatagcctacactgctcacagccaaggatctggggacttgggggttctgtgaagccatggggtacgggctgaggtgttaccaggtgggaggccaggccgggccttgagggagaagaccccagtggcggtggtgggtggtgtgaggctgatcatggctgggctctccagggggtgcacctgcagcacaggggtccgggcgtgggcatccaccgttgagagctggggggcacatgtgggctgtggttcagcctgactcggggcccctccccacagttctcccacctgctccctcctccctgcccattcaccgtccatacctggtgcatgaaatgtggcctgtcctggaggagtgcctgtaagtggggcaaggggcccagccgtgccccggagggtgccaccatgactaggggcagtgtgggcagctgggcagaaaggcaggtgggtgagaggccatcctgatcctcactgttctgtgtctaattcaaatactctgcactgcaagcccacatggtagatgctatgatcatcccccttttacacgtatggaaactgaggctcatggagatcgagtaactttttaaagatcaaacagctaataagttgcagagctggcctcagccctgtcacctcacctacttggccccagtcctcttctcttgtcacatggggatggggacacatagctatgctcatgggactacaatacggcctcctcctctcctgagacagggattgggaggtcggggagagcctccaatctctgaggcctggcaggtggggattttcttggccctgcaacatctgcataagtcacagacttgcctgggacccagaaaccacttcctgtgccccagccagcccccctcccgcccagtgccacagtaaaggtcggcacctgtaggtccaggtaccccaccctgcctgccccatcctgggcccagggcctcacctgcagctgcgatggtggcatggggttcaaggaagaagaggaggcatgggccccgcctcgaagatctcggccctggaaggttccccctgggccccgggcccccagcaggtctgaggctttgggtgcagccctccagctgggcgaggctcctggggatgggccaagggccaaggaaggggccgagggcttgccaggcctggggttgggcatcgggtccttgtccaagggcaggctgcgtagacaataggggaaaggagtcacacgtgtgctagggcggtatgagatactcgaccacctgagccacgtggacactcctctggtcaaagcaggcattggctgggacatgtcccgaggggccccatagttgcaccccagctctagacacacacacacacacacacacacacacacaccaagaacacaggtacatgtacatacccacacatgccccacgtgcagaggtccagcacctggcttgcctgcccacgctagcacagccctggtgtggatgtgtcctctatgagggcaatggttgtttccccctccacttgagagctgtttcaagcctcaggcctctagccctccctgcaccctgcacaggctgtgtttgctcatcttgccggagctggtctcggactttctcctcggagtcctattttgccccagtgactaggcatggactcaaaagattcatctggctgctgtgagtggggctagtgaggaggctattgtaacagtcctggcaagtgatgatgctggcacagaatgggctggtggcagtggagaaggcgagaagtgggtagattctgagacttaatctgaagctggatcaggagcagtgctagcagcttggatgtagtgggcaagagggagagtcaaagtgacatgggttttagcttgagcagctggaaggaccgagctgacattacctgagatgggggacatggcggggagttggattgggtgcaaaagtgcaggtgtagatagacatgaagagtctggcattaaatatgtgagtggaggagctgagggggcagctgaatacgggggtctggatctcagggcaaggaggcgagtccaggagtgtgatcatgcacggatccagcatggcaagtgacagagaggaggagagatggggtctcttgagctggggcctgtagaagcttctctacccagcccccatcagagttcaccccaatttctggccctcaagcctggctcatgctacaccccctgcctcaaatgcccactccttctcctctttccctgtccaagccacgcaagacctgctcttctattgtcctcaccttgaaagccctccacaatggctccgggccccctgctgagccccagaaccttccactccctgagggaagcactggcttttcaggatcctataatcctggtctgagaggaagccagagctggaagggactgcccagccaaccccattatacagaaggggatgctcagatgccgagttccgtagtcccatagtgacttgagaactccacttctttctttaggaagtgtttccgtgtgcacattttataaactctctggtgtgtgtgtgtgtgtgtctccatctccccgttccacctcacagcactgagttgggcacacagctgctgagagcagcccgggggagtatagaagggttctgggggagcagttgctccttcctttctttgctgtcacctcctgggggtggttgtcagagctgtggtgctgagggagatgagtgtgagaatccaggtattaagttcttagtctcctgggggcttagaacattactgcgtgagaaacaggagtgtgggtctgtggaggctccgaacaagggcctgggagagcactggtgagatgagaaggtgagtgaatgaatgaagccagagatggggtgatgctccttcaagccaagaaataacaaagattgccagcaaccaccagaagctgggggagaggcctggagcagcttctcccttatggcccccagaaggaaccaaccctggcaacaccttgatcttggactctggcctccagaactgtgagatgatcaatttctgttgctgaagccactcagttgtggtactttgttatagcagccagaacaaactaataccgatttcggtgcaaatggatgttttccaccactctggcctggcccatgtggctggcctgtggtcacttctgaagctgcctggacacttggccagagctaagaattctccccaaacacatgtgggatggcctgactcagcaaagcatagatacattctcagacagggacatggagatgatctgtctgggggtagaggacctagagggccgggctgggcagccggcttcctgcactgtctgttgggacgtccctttctgactgggtttctcagaagctgaatgggggatgtttctgggacacagattatgttttcatatcggggtctgcatctgggccctgttgtcacagcccccgacttgcccagatttttccgccattgacgtcatggcggccggatgcgccgggcttcatcgacaccacggaggaagagaagagggcagataccccaccccacaggtttcgttccgagaactggctgccctgtcctgcagcaggcttggcccaggtggggtgacatgggtgctggtggatgtggtaggtgatgtccatctggccactatgacaagcccctagctctgaagacctggcccttcttgggttgtggagaggacccaggtttgaagctctgagagtgccaggcaggctccacagatactgggacccctggggtcttcaaatagtataacaccaggacctcagaatcatagaacagcatttcttagatttaaaggatcctagaatctcaaaaccacagactgtggggtctacggtcccaaagtctcagtatgtgtaggccagtgtccctggtgtccaaactccttggaaccatctgaaagtcaggcagcttgctgcttcatagggcctcttgcctaccaggcctggaaacagagccagcctccctagggcctcagtctccctgtccactctggaacaacgttcccaaatacatggccactccgccagagatggcaacagggggaggaggaggttgaggctggtgtgcctttggtctgggcctcatggggggagctggaaaagcctcagccttcgccaatacagagcccatcatcagactctctagaggggccccacaatcaaggttttcggggaccagcaccagctctggggacacacagcctgactgactgacatgcctccatcatcaccacgctctggccaactaggcctcctgacctatggagtccggggcctcacctagcccagctcttgtgaggctgggccccacactgtgatcgtggatcgtccaacctgtgggaagttggggtccaacgtgtgagaaggcagaagggggaatggtagcccaggttccccttcccccttctgggtgctgaggggtaaactgaggccttcagttggggagagagccagaaccagggtcccacctagagtcctgagatctaggcttggatttcaactctgccgctgcatttcggtgaggccctgagatctctggtcttcaatttgcccttctacactgagcacggagaggcgtggagtagacaagggccagggcccttctacgctgtctggttaagtcattaggtgtctgcagggcttcaagttgacaattgcccctctatccaggggactggctgagagatagggatacatagagacaaagagacacacacaaagagcgagcaagagagaacaagagatagtgagagacattgagagaaatggacacatgcatggagagccagagtgcatgtgtgcgagaggaggattgcctcaaataagaacatttgctggtctctggctggttcaactgatgctgcctgaaataatcaagaataaagaagggcaaggtgccagggacacccatggctgggtattgaattgtattgcaaagcaacaatcagcaaaacagtgtggccctggtataagaacagatactggggaagagaacagaatagaaagcttggacatggacccacatatggagagaactgaatttgtgatgaatgtggcatttcaaactggaggaccatggagtatggtttaacaaatgtgtctgagataattagggagaagataaagttattgagtgaatagtcagtccattatcccaacaacccctccctgcccagtttgaaatgtcaccatcatcatataccctaaaatgcccagatccattcaagatataagttttaacacctaatgctgatcttgggtttattgtgtgtcaggccttgtgctaagtatttactgtggttaaaaattttaatctaaacaaagactcctgaggaaggtactattataaccattgcagtacatatgaggaaatggaggtatggagaggttaagtgcctggctaaaaatcacacatagggcttggggtgacgctgggtttgtcccagacagtctggctccagtacccacactcttaacctctatagtaaatggaaaaaatgaagccataaaagagactagaagccaacataggtgaacatttatctcattttcaagtaggaaaggactttctaagcacaaaaccagagacagaagccacagaaaaaaagactaacctatttgactgtataaaaccatcataagcatcacaaaaaacaccataaacaaatagaaaaaaagcaaatgatgaattggggaaaatatttgctatatatgtaatggctgatgaaaggttaataaccattccaaataaagagctgtggcaaatcaataagggaaaaataagatgaacaccctattaggagtaaggacatgaccagacaaccaaaaaaaaaaaaaaaaaaaagcatgaatggccaatgaatagtaaaagtaatcacaagatgcaaatttcaacaatgtgataatgtgtttttcttacctgtcatgttgggaaataattaaaacataataatactcacctagggttagcttaagtagagggagcataaaataggacaaccttttggaaggagaattagcagagagggtcataaactttaaaaatgcacgccccctttgccccagcaactcccttttcaggaatccaaggaagcagtcagggatgtttatagaaaaaaacgagaaacaaccggaatgtccaacaatcggcacttggtcaaatcaatcaaagttcatgctgatgtgaggacagtcttgtccatcatgaaagatcatgtgttcaaacaatttttagtaagcttcaaaaacactactgttaattgaataaagcaggaacaaaaccaatatatagcatgattctaatttggttacagaaatactaatagctaacacttcgtgagcacttactttgtgccaaacgctgtgctaagcctgcagaatcgagctcaccccagccctgaacaacctgtttgcttcctgaatatggactctggtcacacacatgcagtcctggggtaggtccacacagctaaactacggttgacaatggtgtgaagtgctccctgcccccccgccccaagggtctcctctaaagcgatacaagcaaagttcagttaagtgctcagcttgccccggcaccttgcaatcctcctgctactagggtgaacagaactgatgctcactctcataaaatgtaaaggtcctcggcgacattactattattaaacgccagctgtgtacaaagctctaggctggatgctggctgggaaggcaggtgggggaaggcaagaaaagagagcgggagagatggaggaaaggagatcgatggagtgtggtcaagatggaggagacagagataggggagatggtcagaggccaggagagatgcggggaaagagagtctgagtgtagcgacagacagatggcgggagaaagagaggcagagaaacatgtaaaagagcaagacagggtgagcagagagacagagaaggatgagaggcatcaagagctaagagacaaagagatgagagagatgcagttgaaattttcagttgcacctggacagcatttcaagttgttcaaagctctgaaatccataaagactggcagctgacatattttaaaaatcctatccatctacgtatcaattgatgaattcatttatttttgcccctgcccatgcattaagtacttcacctttaagtcttctgccatttattctattattatttttttaaagaccttacctggctggaatcacggtagctgggtacatcccactgtaccagagggcccctgacccccccgccgtgcctacctccctgccatctcctccaatggggcccacatctggtaggggagagcagggacactcaccttggtgaagtggactgacagaaaaggatcagcctggcttgtgggaaactgtcacgtatcaaaaacaactttgcttttataccgagaagaaaaaccacgctgtacggtgtggaagccgcagacctctctcttctaataatccaaatttttttcgatgagtgtgtgc

SEQ ID NO: 1720 - DNA, 14392 bp, Homo sapiens; identical to SEQ ID NO: 1719

SEQ ID NO: 1721 - DNA, 6128 bp, Homo sapiens
taataaactcatatctgtttattctccccaaatcaggggacacaaaggcttttttttttttttctgatgagtgggtaatcctaaaataagcaggaaatgcctgtggctcagcctaactcaaggtgagacgaagctggagctgggagctcgaaagtgtcccccagctccctcctcactttgcctgtaactccacctctgcagaaggtaaagtagaattggtagctgtgtcactggtttgggttgagtcctcggtcagggccctctccagactggcgggaagggcgtggatcagcctctcccggaagtcctggcccatgaagacatagagcatggggttgaggcagctgttgaagaaggccagggcacttgtcacatccactgcaataccaatttctttgtacatgccttgcaataactcacggattctgactgtggctataagggccaccacctgatatggggaccagcagagaaaaaaggctgctgcgacaaaggagaggacccgtaagggacgactggacttaatcaagccttgcttgtggatcttggtggcaataagcccataactgacagcaacgatggacatgggtgcgctgaagccaatgatgaaccggatgatgcctctcaccgtcaacatggcaacggccacatttatcctctctttagggtcgttggtccagggcgaaaagttaaaagtgcaggctactgtccccgttttaccaggtactgtagtcacacgaatgataactggcaatgtgaggagcagagccatcacccagggcccaatgatcaccttcttggccaggctcacggtgcggtggttctgggtccagactggatgcaggacgcaaacacagcggtccagagcaatgagggcgatcaggaagacacttccgaacaagttgatgtccactatggtaaagacgaatttgcacaggaaccagccgaaaggccaatgtcctcccatggccttcctgaccatgaagaatggcaaagtggaggtgaaacagaagtcagccacggccaggttcaggtaactgatggtggtgactgtgtgtgtcatccggaatccagccacccagatcacaagcccgttgcccaggaccccgaggacaaaggtgactgcaaataccagataagtgatgatatccaggaagagatagccagcagatacagcaggtgtccctccagagatgttcgtggggagagaggaatttgtctccatcttgtctgctcctgaaatagtgcagtcgtggtcattcctcagttatgaacctccgtaccatttccccaccccctcatttctgcccctgccagttttcccactcctagctttctcaccttcccctagagctcccacaacagccggaacatcctcaccactgtcccttacacatgcccacatctatacattggcaatcttttattgtacctgttgggcaagattacatctttttttttttttttgagatggaatattgctctgtcacccaggctggagtgcagtggcgtgatctctcactgcaacctccacctcccgggttcaagcaattcccctgcctcagcgtcctgagtagctgagactacaggtatgcaccaccccactcctggctaattttcgtatatttagtagaggtggggttttgccatgttggccaggctggtcttgaactgctgaccccaggtgatccacccacctcagcctcccaaagtgctgggattacagacgtgagctaccacgtgtggccaagattgcatcttatgacacatcctcataattgctaacatgcaagcccctaccagggagattaaatggctaaggaagatagggtccttgacctccaagaggagaatatggggccaaagatgtatagagaaaacatgtattcaaacaaaaatgttcatagagacactcctccctatagccaaaaggtagaaacaacccagatgtccatcaacagatgaatggataaacaaaatgtggtttatccacccaatggaatattattctgccataaaaaacaatgaagcactgatatatgctacaacgtggctgaaccttgaaaacattactctaaacaaaagagggctggatgtggtggttcacgcctgtcatctcagagctttgggaagccgaggtaggagggttgcttgagctcaggagttcatgatcagcctgagccacatagcaagatcctcatctctaacaacaacaacaacaaaattaaattaaattagctggatgtggtggcacacacctgtagtcctagctactcagaagggtgagatgggaggctcacttgagcccaggaattcaaggttaatagtgtactatgattgagccactgcactccagcctgggcaacaaagcaagaccctgtctctaaaatgaaagaaaaaagaaaggaaggaaagaaggaggaaggaaggagagaaggaaggaagacaccacaagtcacattttgtatgattccacttgtatgaaatatccagagtagccaaactcacagagaccgaatgcagattagtgattgccagggactggggaaactaggaagtggggaattgttgcttaatgaatatgcagtttttgcttggtgtgattaaaaagttctggaactagataatggttatggttgcaacacactgtagatgtacttaatgccattgaattgtacatttaaatgggtaacttttttattgttgtttgagacgcagtctcgttctgtcacccaggctggagtgcagtggtgcgatcttggctcactgcaacctccgcctcccgcgtttaagtgattctcctgcctcagcctcctgagtagctggaattacaggcacttgccaccatgcccagctaatttttatatttttgtagagatggggtttcaccatgttggccagcctggtctcaaactccttgacctcaggtgatctgcccgcctcggcgtcccaaagtgctgagattataggcgtgagccactgtgcccagcctaaaatggttaactttttgtattttaccatcaatttaataaaggaaaaataagagcataagatatcagaaaatcagtgggcgacagcttcagtgacctagtgtcacacaaacgtggactaagactttctctcacccataacactgcataagaactataaggtatgcaacttctcagccaggcgcagtggctcacgcctgtaatcccagtaccttgggaggccgaggcgggtggatcatgaggttagcagttcgagaccagcctggccaacatggagaagccccatctctactaaaaatacaaaaattagccaggcatggcggtgggtgcttttagtcccagctactccagaggctgaggcaggagaatcacttgaacgtgggaggcggaggttgcagtgagcagagactgcgccattgcactccagcctgggcgacagagcgagactccgtttcaaaaaaaaaaaaaagatatgcaacttctccactccaaattctgctcgctctctctctttaaggtcatgaaatctccctttcctctctcatcgtgggaagcaaggcatagtacttggttagttttccaacataggtcaaatggatccgtgagtgatactaaacgacgtataatcaagtattatatccaatggattctgtgctagaagaagtcagaacaacagactctgtttccactctcgtctctgcggttaccttggccagatggatgggaggtgcttctccatccattggatgggctcagcactcttggggatgtagaagaccgtgatagaaataatagtccaaatatgtattggatatgacatttcattagatcaggtatgcaaagtgcatgtcaggttcttgctgagagctggccttctctcttttttttaatttattttattttatttatttatttattttgagatggagtctctctctatcacccaggctggagtgcagtggcgtgatctgagctcactgcaacctccgcctcccaggttcaagcaattctcctgtctcagcctcctgagtagctgggatttcaggtgcacgccgccgtgcctggctaatttttctttttaattgtattttagtagacatggggtttcaccatgttgcccaggctggtctcaaactcttgagctcaggcagtccacctgcctcagcctcccaaagtgctaggattacaggtgtgagccactgcgcccggcctggtcttctcttctaatgcttgcagcagccttcctcaaaattgttactatgagggtcactgtctttatggtacccattttgcagacgaggaaagtgcgacttagagcatttcagttaattccttaaagtcacccaacagcccaggctgtcgaattccagcaaaagtctctttctgcctctgccctgccacgctactggcacagaagagctgtctaatgcactagtcactcaccacatgtggttttcaagcacttgaattgtggctagtccaactggagacaggctgtaggagtaaaatacccatcagatttcaaagacttagtatgaaaaaaatattgtgaccatctcattaatagtttttatattgactacatgttaaaatgataataatttggctatttaagtttaggttagatattttattaaaattaagttcgcatgtttctcttcacctttttaaagtgcctacttgacactttgaaattacatatgtgtctcacatttctaatgaactttgatactctacaatctcagaaacaactcagagatgtctccctcccctaccacccatccaaccaccaaaataccctgaggactctttgtcctcaagaatctctaaggcaaccagttcagaagattgttgcaatgaatgatgaggattctgcaataatgagctggaacataccagagaggaaaacctgtgcaattttgtccaattatggttcaagggaaaaatcctgtgatttgcaatgaacacaggccttggtggctgccatcgatgaaggactttatgcttgataatcattgtaccacatcctcaactttcttgcctctgatctcaacaaactcagcattgattatacatcatcatccctgtgtgacggaagaggaaactaggagcttgatgagaaatgacagccaatgtctgcagattcatgagagggcagggctgtattccgctactgggtcctatgcaccatgcagaaccagtgtcttcacgtggagactcatcactgatccgaaaggtgactgcttctgtattacactcatttccccatgacccatcataaagtcgttagggctcttttgctttctcctgaaagcttcaaaccaaacatcctttcccatcccgactcaagccctcaagctgatgcccttgcctcttgctccaccagattctcctcctgctggctcctgcatcactgttctctgccctcatctctgtaaccagaaaacaagtgtttccatccaagaattaccctctactggtcccataaaactcattcccccatttactcaagaacttccctccttcacttatcccttctctctcctgcagcctcatagtgtctctatattccatcattcccatcaggaccccaataaagtctagagcctatttgtttatttatttatttacttatttatttgagatggagtctcactctgtcacctaggctggagtacagtggtgcaatctgagctcactgcaacctccacctcccagattcaagcaattctcctgcctcagcctcccaagtagcttgaattacagacgcccaccaccacgcctggctaatttttgtatttttaatagaagtgaggtttcaacatgttggccaggctggtctcgaactcctgacctcaagttatccacctgccttggcctcccaaagtgctgggattacaagcatgagtcaccgtgcccggcctgtttagaacctctttaaaaaaattattcttcaactccacatccttcttcaaacaaagagtctattgtgttcaccagtgtattaagtgtgtctatgtcaagctacccagtcccccagaatatgtttcttacctggactgttcaccagctgtggtcttgctctgggtagttctaggtctgggtctcctggggagagtgactcaggctctaatgatt

SEQ ID NO: 1722 - DNA, 6125 bp, Homo sapiens
taaactcatatctgtttattctccccaaatcaggggacacaaaggcttttttttttttttctgatgagtgggtaatcctaaaataagcaggaaatgcctgtggctcagcctaactcaaggtgagacgaagctggagctgggagctcgaaagtgtcccccagctccctcctcactttgcctgtaactccacctctgcagaaggtaaagtagaattggtagctgtgtcactggtttgggttgagtcctcggtcagggccctctccagactggcgggaagggcgtggatcagcctctcccggaagtcctggcccatgaagacatagagcatggggttgaggcagctgttgaagaaggccagggcacttgtcacatccactgcaataccaatttctttgtacatgccttgcaataactcacggattctgactgtggctataagggccaccacctgatatggggaccagcagagaaaaaaggctgctgcgacaaaggagaggacccgtaagggacgactggacttaatcaagccttgcttgtggatcttggtggcaataagcccataactgacagcaacgatggacatgggtgcgctgaagccaatgatgaaccggatgatgcctctcaccgtcaacatggcaacggccacatttatcctctctttagggtcgttggtccagggcgaaaagttaaaagtgcaggctactgtccccgttttaccaggtactgtagtcacacgaatgataactggcaatgtgaggagcagagccatcacccagggcccaatgatcaccttcttggccaggctcacggtgcggtggttctgggtccagactggatgcaggacgcaaacacagcggtccagagcaatgagggcgatcaggaagacacttccgaacaagttgatgtccactatggtaaagacgaatttgcacaggaaccagccgaaaggccaatgtcctcccatggccttcctgaccatgaagaatggcaaagtggaggtgaaacagaagtcagccacggccaggttcaggtaactgatggtggtgactgtgtgtgtcatccggaatccagccacccagatcacaagcccgttgcccaggaccccgaggacaaaggtgactgcaaataccagataagtgatgatatccaggaagagatagccagcagatacagcaggtgtccctccagagatgttcgtggggagagaggaatttgtctccatcttgtctgctcctgaaatagtgcagtcgtggtcattcctcagttatgaacctccgtaccatttccccaccccctcatttctgcccctgccagttttcccactcctagctttctcaccttcccctagagctcccacaacagccggaacatcctcaccactgtcccttacacatgcccacatctatacattggcaatcttttattgtacctgttgggcaagattacatctttttttttttttttgagatggaatattgctctgtcacccaggctggagtgcagtggcgtgatctctcactgcaacctccacctcccgggttcaagcaattcccctgcctcagcgtcctgagtagctgagactacaggtatgcaccaccccactcctggctaattttcgtatatttagtagaggtggggttttgccatgttggccaggctggtcttgaactgctgaccccaggtgatccacccacctcagcctcccaaagtgctgggattacagacgtgagctaccacgtgtggccaagattgcatcttatgacacatcctcataattgctaacatgcaagcccctaccagggagattaaatggctaaggaagatagggtccttgacctccaagaggagaatatggggccaaagatgtatagagaaaacatgtattcaaacaaaaatgttcatagagacactcctccctatagccaaaaggtagaaacaacccagatgtccatcaacagatgaatggataaacaaaatgtggtttatccacccaatggaatattattctgccataaaaaacaatgaagcactgatatatgctacaacgtggctgaaccttgaaaacattactctaaacaaaagagggctggatgtggtggttcacgcctgtcatctcagagctttgggaagccgaggtaggagggttgcttgagctcaggagttcatgatcagcctgagccacatagcaagatcctcatctctaacaacaacaacaacaaaattaaattaaattagctggatgtggtggcacacacctgtagtcctagctactcagaagggtgagatgggaggctcacttgagcccaggaattcaaggttaatagtgtactatgattgagccactgcactccagcctgggcaacaaagcaagaccctgtctctaaaatgaaagaaaaaagaaaggaaggaaagaaggaggaaggaaggagagaaggaaggaagacaccacaagtcacattttgtatgattccacttgtatgaaatatccagagtagccaaactcacagagaccgaatgcagattagtgattgccagggactggggaaactaggaagtggggaattgttgcttaatgaatatgcagtttttgcttggtgtgattaaaaagttctggaactagataatggttatggttgcaacacactgtagatgtacttaatgccattgaattgtacatttaaatgggtaacttttttattgttgtttgagacgcagtctcgttctgtcacccaggctggagtgcagtggtgcgatcttggctcactgcaacctccgcctcccgcgtttaagtgattctcctgcctcagcctcctgagtagctggaattacaggcacttgccaccatgcccagctaatttttatatttttgtagagatggggtttcaccatgttggccagcctggtctcaaactccttgacctcaggtgatctgcccgcctcggcgtcccaaagtgctgagattataggcgtgagccactgtgcccagcctaaaatggttaactttttgtattttaccatcaatttaataaaggaaaaataagagcataagatatcagaaaatcagtgggcgacagcttcagtgacctagtgtcacacaaacgtggactaagactttctctcacccataacactgcataagaactataaggtatgcaacttctcagccaggcgcagtggctcacgcctgtaatcccagtaccttgggaggccgaggcgggtggatcatgaggttagcagttcgagaccagcctggccaacatggagaagccccatctctactaaaaatacaaaaattagccaggcatggcggtgggtgcttttagtcccagctactccagaggctgaggcaggagaatcacttgaacgtgggaggcggaggttgcagtgagcagagactgcgccattgcactccagcctgggcgacagagcgagactccgtttcaaaaaaaaaaaaaagatatgcaacttctccactccaaattctgctcgctctctctctttaaggtcatgaaatctccctttcctctctcatcgtgggaagcaaggcatagtacttggttagttttccaacataggtcaaatggatccgtgagtgatactaaacgacgtataatcaagtattatatccaatggattctgtgctagaagaagtcagaacaacagactctgtttccactctcgtctctgcggttaccttggccagatggatgggaggtgcttctccatccattggatgggctcagcactcttggggatgtagaagaccgtgatagaaataatagtccaaatatgtattggatatgacatttcattagatcaggtatgcaaagtgcatgtcaggttcttgctgagagctggccttctctcttttttttaatttattttattttatttatttatttattttgagatggagtctctctctatcacccaggctggagtgcagtggcgtgatctgagctcactgcaacctccgcctcccaggttcaagcaattctcctgtctcagcctcctgagtagctgggatttcaggtgcacgccgccgtgcctggctaatttttctttttaattgtattttagtagacatggggtttcaccatgttgcccaggctggtctcaaactcttgagctcaggcagtccacctgcctcagcctcccaaagtgctaggattacaggtgtgagccactgcgcccggcctggtcttctcttctaatgcttgcagcagccttcctcaaaattgttactatgagggtcactgtctttatggtacccattttgcagacgaggaaagtgcgacttagagcatttcagttaattccttaaagtcacccaacagcccaggctgtcgaattccagcaaaagtctctttctgcctctgccctgccacgctactggcacagaagagctgtctaatgcactagtcactcaccacatgtggttttcaagcacttgaattgtggctagtccaactggagacaggctgtaggagtaaaatacccatcagatttcaaagacttagtatgaaaaaaatattgtgaccatctcattaatagtttttatattgactacatgttaaaatgataataatttggctatttaagtttaggttagatattttattaaaattaagttcgcatgtttctcttcacctttttaaagtgcctacttgacactttgaaattacatatgtgtctcacatttctaatgaactttgatactctacaatctcagaaacaactcagagatgtctccctcccctaccacccatccaaccaccaaaataccctgaggactctttgtcctcaagaatctctaaggcaaccagttcagaagattgttgcaatgaatgatgaggattctgcaataatgagctggaacataccagagaggaaaacctgtgcaattttgtccaattatggttcaagggaaaaatcctgtgatttgcaatgaacacaggccttggtggctgccatcgatgaaggactttatgcttgataatcattgtaccacatcctcaactttcttgcctctgatctcaacaaactcagcattgattatacatcatcatccctgtgtgacggaagaggaaactaggagcttgatgagaaatgacagccaatgtctgcagattcatgagagggcagggctgtattccgctactgggtcctatgcaccatgcagaaccagtgtcttcacgtggagactcatcactgatccgaaaggtgactgcttctgtattacactcatttccccatgacccatcataaagtcgttagggctcttttgctttctcctgaaagcttcaaaccaaacatcctttcccatcccgactcaagccctcaagctgatgcccttgcctcttgctccaccagattctcctcctgctggctcctgcatcactgttctctgccctcatctctgtaaccagaaaacaagtgtttccatccaagaattaccctctactggtcccataaaactcattcccccatttactcaagaacttccctccttcacttatcccttctctctcctgcagcctcatagtgtctctatattccatcattcccatcaggaccccaataaagtctagagcctatttgtttatttatttatttacttatttatttgagatggagtctcactctgtcacctaggctggagtacagtggtgcaatctgagctcactgcaacctccacctcccagattcaagcaattctcctgcctcagcctcccaagtagcttgaattacagacgcccaccaccacgcctggctaatttttgtatttttaatagaagtgaggtttcaacatgttggccaggctggtctcgaactcctgacctcaagttatccacctgccttggcctcccaaagtgctgggattacaagcatgagtcaccgtgcccggcctgtttagaacctctttaaaaaaattattcttcaactccacatccttcttcaaacaaagagtctattgtgttcaccagtgtattaagtgtgtctatgtcaagctacccagtcccccagaatatgtttcttacctggactgttcaccagctgtggtcttgctctgggtagttctaggtctgggtctcctggggagagtgactcaggctctaatgatt

SEQ ID NO: 1723 - DNA, 5615 bp, Homo sapiens
tgcccagtagggaggaaaaccggaggagagcgcaggaggaaacagtaccggctggaggccggtcttgcaggagcgggggactgctgggggcggggcttggtggtgaccgctggcggggcggggcctggggctcagaggggtgggctttggagatcagagggtcgacgctgcttcgttgcctggactctggtttccgccctggagcaagccggggcctggtcggcagctgggccgccatggagtccacgctgggcgcgggcatcgtgatagccgaggcgctacagaaccagctagcctggctggagaacgtgtggctctggatcacctttctgggcgatcccaagatcctctttctgttctacttccccgcggcctactacgcctcccgccgtgtgggcatcgcggtgctctggatcagcctcatcaccgagtggctcaacctcatcttcaagtggtgagacagagaagccctccggcatcctggtccccacccccgagggccctgagtcatgtgtaagccctggtctctttcagcaactgtctcaagggccttcccacccctactctgtagtccctgattttttttccccttgagcatctttgtgcagcttggactcaaacctcagagtccaaccatcctactcattagaccagtgttcttcaaactggtctgatggaaaaatcacctaaggggcgtgtctaaaatgtaaatatcccatcctcatctcacacttactaatttagaaactccaaggggttgggaatttattttttattttttatttttggtttatgggaattcatattttaacaaatatggtgatttaagtagtggagagtcctacctctcaactcactttttcattcatgtattcattcatttgctataatttttcagaagcatgctttgtgctgggcatcacggtagctgctaaggacagagacaccttgcagattaaggtgtggtccctggaccatgcccaacggcataggcagcacttgaaaactggctaaaaacgcagactctcaggccccgggccagagctactgaatcaaaatctgcattttaacaaggttcccaggtgattccctgtgcgtatgcagtaaagtttgggctaaagcactgctttccagggaacactttctcttctttctctttcattcaccagtagactcttcacactgagacttagaagccaggaatcccagggacatgggtggaggccctgtggcccctggggctgggcatgcagccacacctcccttcacctcagcctctgttgccagatcctcagcctgggggaaggaagggaggctcataggaggtatttcaatgagctggaatgacttgctgaaaaacaacatagagttcccctcccttccactcttttccacgagggcctcatccttatgtaaagggaaccacagtgatctgttcacttctttcttgcctaattgccctttgctttgtgctctcctctctcaaagtctgtataagcctccccctctattccttgtcccccaaagatcacaatctccttcagacactattaatgtcccccaagtggcaaagtccctattcattttcattttctcttttttttttttttttttttttgagacggagtctcgctcagttgcccaggctggagtgcagtggtgcaatcttggctcactgcaaactccgtctcccggcttcatgccattctcctgcctcagcctcccaagtagctgggatcacaggcgtgtgccaccacactcggctaatttttgtatttttagtagagaaggggtttcgccttgttggccaggctggtctcaaactcctgacctcaggtgatccgcccgcttcagcctcccaaagtgctgggattataggcgtgagcaacctggcattctttttttttttttttttattctttttgagatggagtcttgctctgttgcccaggctggcgtgcaatggcatgatcttggctcactgaaacctctttgtctctcaggttcaagagattcttctgcctcagcctccccagtagctgtgattatcggcacccaccaccacgcccggctaattttttatttctagtagagacagggtttcaccttgttggtcaggctggtctcaaactcctggcctcaagtgatccaccctcctctgcctcccaaagtgctgggattacaggcgtgagccaccgcgcctggcaccgccgttcattttctgtgtgagcacttgttgtatatatactaggctcagttttcagaggggagaggcaagtgccttctgtatatccctccccagcacgtggcttcctgccagcatctcttttgctatcccatcttttctctttctggccacagcagcctcttcattgtgtggttcccagggcccagccaagcacttgctagaccagaggattttgacatttttttgtcctccttattctttctcagccttctctgtccatttcccacccccattttcagacctgagaggctcacctaaataatttaggtgtggataattcaggctgtaactggggacatggaggcaggggtagcaggagggttagtgagggcctggaggagagagctgggtcctggactctctgtggatgataagagctggccttgcagtgagagggggtagagtgggacggctgagtatctcagagcacacacacggcttaccacaatctcttgcctctgtatcagttttattttttattttattcactttttctttttttgagacaggatctcactccatcaccaggctggagtacaatggcacaatcacagctcactgcagcctcaacctcctgggctcaagtgatccttcccacttcagcctctggagtagcagggactacaggcacaccccaagatgcctggctaatttttgtattttttgtagagatggggttttgtcatgttgcccaggctattctcgaactcctgggctcaagtgatctgcccgcccagcctcccaagtagctgagactataggtgtgcaccaccacttccagctaattttttgtttttgttgaatctgggtcttgctatgttgcccaggctggtcatgaactcctggcttcaagtgatcctccagctaaggcctcccaaagtactgggattacagtcatgagccactgtacctggccccagactagtttttaaaaatagtgtttccacaggctgagggttaggaaaaaaaaaagaaaagaaatagtgtgctttctttctcctgttctaaggtagaaaaccatggcaaggtatccatggataccttgagagcagtggacagaatcgtagtccctttttgacttcacccctcaggccctccagagtactctgtgtcctgcccgccttgtaccccccctggctgtgtgtgcatgtggaaagtcatcttgcatctgttctcttccaggtttctttttggagacaggcccttttggtgggtccatgagtctggttactacagccaggctccagcccaggttcaccagttcccctcttcttgtgagactggtccaggtgggaagcctcaaacattctccctttcccaatgtggttagggttcgggtgaacatttcagagtacttttcagcctgggtggcccaaccaaaggaccagcctctcaattactggcgcagagaacaaaagaaccccagggagaccaagctgagttatgggaggagggcactcatgctatgtaccagctgcccaccttgtatagaggacagccaagagacacagatcaggacagaaacctgagcacagtgacctcaagtggcagtaaaaaggcctcagagcagagcgagttatgaatcagtgctggggaaaagctcttctcagccaggaaaggcagctgtattattgaggcatcaccaggggccccggggttctgcctccatcttctcaccacgagcttctggatttgctggcaggcagcccttctggacactgcatgatcacaggagcagccctctggcccataatgacggccctgtcttcgcaggtggccactcgggcccgcaggtatacccttggcattgcccaccattgggagcaggggtgatggcaccctgtacctaatagacacagcagcatggcagcctgggagctggagttttggggaccctaggttgtgtggttcaaccatggagtacctgggtgctgcaggaggccaagctgtgtatggacacgctctgagctccttgcctctcttctttctagccgctgggtaagggtgatgcctagcctggcttattgcaccttccttttggcggttggcttgtcgcgaatcttcatcttagcacatttccctcaccaggtgctggctggcctaataactggtgagcaactggggcaacggggtggactgagaggatgcctttggcagtgggaggatcagtctaggatcttcccatcgctcccagcttctgtagagcccaccccagaggccccccgttatgtctcagtttattctcttgccaagctgcactgcagctgggggtcggggtggggagggtcatatccccagactccttgaagctgttgtcactccactctcctaggcgctgtcctgggctggctgatgactccccgagtgcctatggagcgggagctaagcttctatgggttgactgcactggccctcatgctaggcaccagcctcatctattggaccctctttacactgggcctggatctttcttggtaagtctcgctttgaagcctgggcaggctgggccctgtcctatctcgcctgcacctagcctggtgtgtctctggttcattatagctaaaaaaggacacattacctattcacatagaccctcacaggcacaaaacagaacatgggagtgggccccaagggcagatggccaagagccagtggccttctatgttccagcctctcctggcaagaactcttcttccccacaggtccatcagcctagccttcaagtggtgtgagcggcctgagtggatacacgtggatagccggccctttgcctccctgagccgtgactcaggggctgccctgggcctgggcattgccttgcactctccctgctatgcccaggtgcgtcgggcacagctgggaaatggccagaagatagcctgccttgtgctggccatggggctgctgggccccctggactggctgggccacccccctcagatcagcctcttctacattttcaatttcctcaagtacaccctctggccatgcctagtcctggccctcgtgccctgggcagtgcacatgttcagtgcccaggaagcaccgcccatccactcttcctgacttcttgtgtgcctccctttcctttccctcccacaaagccaacactctgtgaccaccacactccaggaggcagccccatccccttccagcccctaagtaggccctcccctccctaaatctgcttccgcaccacctggtcttagccccaaagatgggccttctctctcccagataagttggtcctccctctgcctttcctctcaagcccccaaagagcaaaggcaacagcaagaccagcgggttcttgcaacactgtgaggggcagccagggcggccccaataaagcccttgaatactttga

SEQ ID NO: 1724 - DNA, 5615 bp, Homo sapiens; identical to SEQ ID NO: 1723

SEQ ID NO: 1725 - DNA, 5615 bp, Homo sapiens; identical to SEQ ID NO: 1723

SEQ ID NO: 1726 - DNA, 9109 bp, Homo sapiens
gggcattcacaaaaagtattttattattcttaacagtactcactttaaaggaataagaggatagcatacattttttacagacaatatataaatgttgtacataattaacaataacttagttcactaatccaaaataaaacaagccaaataaaacataaaaacagaaaatactgccgattctttttcttatgcggacactagtacaaaataagttacttctggccgtggtgctccctgcagcgactgcccgcccatattgcacttggtcactacatcagcacaatcctcctcctgggccaggggcccctcacaggccaccacaccccgccgtcaccgcatacagaatctaagctcgggacacgtttatatacagctgtaccttgggaaggatccagacagccacagtaaagctggacctgagaccccagcagggacacagcctctccctgggtcctggtcctgacctgcccccaactcctgccttcaccccctgccaggccagcaaatgccaaccagcccccagaaaccaagggcagcaaaggcccctccccacccccagctttcatactagggctgtgggatcccagctcttttccaaaaagaattgcaaagctccaaccttgtgtgtaggttttattcctttcatagcagggctcctgtggctacgtacaatcaactggacccaaaaagagtttaaaaataaaacaattaactcatcagcgagttaagcctatgcatttttttaatattttttcttttgtctcagagtaggaggcgagggggttgaagggttagcagaaaaaggatgtatttacagggtccacctgacaagacaggctgtggcttgcgctcagtaaggggacacagtcacagcagcttcggcctcaaagccaagggagcgatctgggagacgtttcccctttcaagaaaatgttgtttccttcctgtgacccagccctggcctgggaatctgtgcaggaccgcccgtgattgtctctgccctccagggcctggcccgtcaaagcaggcaccagctcaccctccctgggccgtggccactctggctttggctcagcccagcctggagttcggctatttcagagagggaagccagaggagaagagggtgcaggctgaggtccccacaaatctgcccccagagccctggcaagtggacccgccaatcccgaggaagaaccggaggacttgggacagctcagaccaccaagtctccaagtccttgttagaaacaagagcaaaataaattatttttgcctaatcctttttccttctaaaaatggttgccttcgtctgtcccgtcccctccttttctctacataaagttgtccttgttgttctccaaacaactgtccatgcaggaaaccccacctgggcagcggtcaggtgcggaggcagcctctcagcggtggggaacattcacagtaactgctggcaggctgctgggcgccctccaggagagggggtgctgggccgagccgggctggcaggagtggtgtcggccttcgggaaatgctgggctgctaagggtttggtccacccatcccgggagtgcccggtcctcgacgtccatctgttccctagcccatggcggtcaccatgctggacgggtgggggtggccgaaggagaggctggaggaggggtggatgggcgtcggagtgggcaggatgtgtccggagtggctgaagggcgggaggtggcccacaggtgccatgtgtccagccagggcagctgcactgaagggggatgacttctcctgcatgcactttgacagctcctcgaagcactccgcccctttcttgctcttcttggacttgttggacatcttccggttccgagtctggatcccttccttcttcatggtcagtggcctgttaacctagaggcaaccaccagttttcagagggccagttccttcctccagcaacattcctcccaccccgccacagcgtggaccagaggcaggtcaagctgagggtcccaggaagccaggaattgtgcccgaccttcatagtcccatcaccagatggctaccattccaggaagggcgggttctggcatatggggctgacccacaccctccctggctctgcccaccgcatgccagcactgcccagccaactgaagtcctcccccccaccctgaccctttttaagcagagaaaccacttccctagtccgagaccctgtcctagccagctccacctcctgagcagaggcaaggcacccctcttacgggaagcccttctggcgctcactcagggcagcagcttcccaagccaagccaagctggatattgtggctggggcctcttgcctggcagcacaaagcgcagaggtcccctgggaggggcggggtggccggggcggggcgcactcacattgtgcagcttgtagtagaggccacaggcgttgcagacagggtccccgttggcgtttcggcgccataaggtggtggttgtcgtctgacaatttgcacaacaggtgccggctcttctggcggccgactgggagggcaaggcagcgtcagcaggctggactcccacgcccacctcgacccccctccctgaccctcgctccacccccagtccccaccagctcagtcaaggagggctaaatctcacatgggaatcaaagcatctcagaaccatggaattttagaatttgagaacgaaataagtcaagactcacagaactttggaataaagaactctcagaagcctgatgttagaatcaacgggattgcaagagctacagaggagaattagctacctcccccaactaccctgcgctctaactccataaatggggaaactgaggccctgagaagggctctctagtagcacaggcatcctgaggctgagccggcttggtccccctcgagcccctggatctggggccgattctgtgtctcctctagcacgactccgctcaaaatccataatcctgggtgagtcagtgtcgctgaggccagcgcaggtttacagagtgcagagctgcaccgtccaacactgtagcagctggccacaggcagccatttaaataagatctaactacaaattaacaaaattaaaaacccagttccctcaattgcacgagccacatttcaagtgatcaatattcacatgtggccaggggctaccacagtgggcagtgcagacacagaacttttccatctctccagctgatgtgagtgctgatcccccccatccagccccccataccccaacccttagagctttaaccaccccgcagcccctctgagtcctagtccctcaggaaatgcctggcagaggtagggtctggaaatgagcgcctggtccttgcagagagaagctagagggaggctttacccaagaaaacagatcccctctcccggttccaccaacgccagccccacagtgacagagggggtcccccaacacttcccagagaactgcaggcgggagtgcaccaggtggtgagtgtggggggctgggggctgaggcctgcagagcctggaacagccccaggcccaagcctggtcacagaagggacagagggactgcagccgcgggggcagggaggggtgagtaagcagcctgaagctggaattctgactcaggggccaacgccgcgtcctccacctctacccccacccgggcctcaccccgccctcgctccaggggaaaaaaaggcccccaaagcagggaacgatttaagcctcataaatcacttcgccctgaaaaaatatatttattattcttagcattttacgcattatttgcagagtggagggtattagaaatttcaaaacagcccagcgagaggcaggactgagctgaggagactctaaaaactcgcagagtccggaaacagatacacgaagtttccttatcttcaggctgcagatgtccggataggaaactccggcaggagatccgaaagggcatttttttaaaatcactcaaatgaaaatacacagtataggtgactccatggaaaaataataaagggcaggtttttttagtggccggtgtgagtttgtgttttatttaaataagcacgaggagcttgtgagcggggctgtcggggagggctgagccacaaggaaaagtacttcatggccctatttttaaaaaagagctaagcagaggccagaggacaggagtccggcccgtggacactcaacttcggggatcccggagcagagtggggtggcgcaagggtgcccggtgggctccctatacccgaggaggaaatctggcccgaaagaatctggccagaaagagagacgaccccaactgacatcccagtgcttttcatgataaaagaggatttcaagcggcaaagcgtctgcatttgaaggagtttttttcccctgtaattaaccgccagctcctgcccagcagccccctcccagccacctgtgcccgctcctaccagtcttcgcttgggcttgatgagtggtcggttctgcccattcatcttgtggtagaggccacaggcattgcacaggtagtggccggtgccgtcccgccgccagagaggggtggctgtggccccacagttgacacactcccggccttctgcaggggaacagggagagacacgggggcctgcttaaccggcaagttctcgggagggagtccagggcaggaaagcagccagccgagcagtgccggtgcctctcaggcacacggttggcctgggcctggctgcaacagcctgggcaggaagagggacgagagggtctcccacatgggagggggcacaggtccagagtcgtttaaagccaaatcccctgcttccaatcctcaccaggagggatggaaacgaaggaggaggggaggaggggcccagggccccaggcgttctggagcaaccaggagggtatttactgcaaactttgccgagggtagggtggtggcaggagtcacccagctcaacctggctgggcccaggaggctctctccttcccgctctggcgcgtctctccccctctcctcttttgtccctctcctttctacccaactgtgtctgccccaccccgtctttctgctctaagtccagaagcatttccctctttctccccaacttttctcctcttccaccaaagctctagaatttttctgagtcctggaaataatggatcgaagttgttgttctttaaaataaaataaataataagctctttcttttttagataagtggcctgggttttttttgtttgtattttttttttcaattaaaagaccatctggaattcaaataaaatgcaaaacaaacaggagaaaggaccaagaaaaggcaagctgacgggtctgagcagaactaggaccctgagccggggctcagcgggtgctggggccagcgggggctggggctggggaccaagttgagcaggatcactggctggcatcgtgttccccaggaagttattcttgatttagtttaaactaaatgaggagtacagcctggcaagagaaggtggttcctgcactcaggagtaactgttttaaaaaccttccccctctgtggctcaaagggattcgggaaagagacatggacagcaagaactccacactagccacgagtttctgggtttatgctctgtggccagattcttggacaaacccagtttggccccagccagctgcgggaaaaggggcgggggcactgcagcttcatcccctcactccagccctcagggagggagagggaagggcctggcgagggcagggagcaggagcaggtcctgggaattttgctctggggaaaatctcccgaggagatcagggagccatcgaaatcccaagatcagactgattgagttagagacccagattccttaatggtctggaacctccggagtgcctgaaacatgcacacacaacatgcacacagacacacgtatacacatgcacacacgctcccaaacacatgcacatacagagtcacttccctcgcttcacatactaagtcctgaggtggcttgaattttcacttaagattcagggagggaaagggggaattcctgttctatgttctggtcaggcagtgaccaaccctggggcaaggaactgaactttgggggtacactggaagcacttaagaaaatggcaaaagttttagagtctcctctccctgacccgggggtctcaaacatctgctgggggctattagagcgagacatcacccatccccagatctgggaaaccaacactgccacctctcccaagtcacagctccccaccacaaaaacgcaaatgctcccctcttccacgaagtccccagcacctgcctttacctgaacaggaacgagccttgctgcgctgcttaggggtgaagctggaggccggtccccccaggaagcctccggggtggaagagtccgctgctgtagtcgtgggcagccgccggcacataggaggggtaggtggggatggggtggtgtgtagcaggctgggtgcccatagtagctaggcctgggcgcaggggactgccactttccatcttcatgctctccgtcagtgacacctggtacttgacgccgtccttgtcctctcctcgggctgcactaccccccgcggaagatgaggctggagacgcagcccccgtggtgctagggtcaggagacacttctttgggtggcgtgggtgggaagccgaaaaggtgggagccagagtgggctgctgtaggggtgagggaggccactgagctcccgctgcctcccccgctcccacccccagcccctgggtacacagagagtgggcctccagggcctccagcagctgaggggtgcagtggcgtcttggagaaggggctcacggtccaggggttgtggtggtgggccgcagcggcagagagggctgctttgcccccgtccagccagggcaaacccgggctgtgcaacaagtgtgggcggcacatctggcctccggtcaggcgggctgcgggcaaagagagagaggatcagggtgggcagaaagatcagggtaggcagagctagggacgcccctgacagacattgagatcacgactcccagaaccagcagtcatcccctccccaaagaaagccagaaacataataccccaccggtaataatcaggaatgtcagtccaagctgaaggacaagtggcatagaaggaaccccaccggacagaccctacagggaaccctcacaggccagctggaagtgggcagaaaccctgtgggtcccagaccctccccaatcggccgctgctcccacctctcccgccccaatttttcagcagctcgattcctgcggatcctacatccgggaagcaagcagacgggccctcctcccctccctcgcctggcgcgcggcgcctgggttctcatcaccacgggcccagtgctcaccgtgcgcggggctgtaggagacgcgcgcccgcgcgtgagcggggttggcatagtaggggttgccctgcgagtcgaggtgattgaagaagacgtccacctcgtctggaggcagcagctgcgcgggttccatgtagttgtgcgccaggcccgggtggtgtgagtcggggtgctgcgcattcagcacggccgggtgcgccatccagcgcggctgctcgggcgccacctccatggccggcggcggcggctcagggtctgggtgcagacggcaacggccctgcgcgaggaagggggagtgaggcgtgccgccagcgcctgacaccccccaaagtcccaccacgaggtgtcccgcacgccacggagccccagcccagatccggcgagaaagagcaccagtcccgggtgggaggaaagcccaaggctcaaaacgaaaggaaggcgggggagggggttcagccacgcacactcacgtggtgacccgcggctccagaatcacacacccgtgcacatggggtcacgcccggggacgggtcccgacaccagtgaccccaacaaacgcacagagcagcacttcagtcagacactcacactgagcccccccgcccggtagacaaacacatgaacacagactcaaaagttggagacaggcgcccgggcacccagtgtggcacttgatcccagcgacacgcacacacccacacttggcgccagatacacatactgatctcaaccccgaaaacatgcacacgcagccccctgagcgcagtactaagcggcacaatcaggacctctcaacaaagcacaccaaagcagtcgcccgcagcctggccccccgccctaagtccccccagagtcccctcaaagctaggagcgccccaggcccccagccggctctcaaaccccaaacttacacacgcagccgtggggaggggagggactcggcctctgagagtgaaggagttccggcgggagccccgagggcgacgggcccagggacagcacgtccggaggctggcggggcttacagggtaggagctgggggtagagtgcgcctcggcctcgggccctcccggctccggcccctcggcatcctccggccgccctggcgccagctgccgactcctgcacagacatgaagcgggggccgcgcacgcctaagaagcccaagccagccaatcaacgccgcgcgcctcccagcctccgcctcccattggctgcgtccgcaattcccgaaccgctggactccgggactgacccgcgggccggcccccctcagccggcgggccccctccctgcgcgctcctggcggcccctgctgccaacgcgccccaccactaagggaccctcaccccaaggcccgacccctgcagcccctcttgcgaacactccgggatccctcgatgctctgggcctccctagcagtaactaaccaccaactgccccctccccaggagcccgggccgcacaccctctggatggcctctccccgagaccctaaccccgccacgctccttcaccgctgaacgtggtcagtccgagcgcagttacctacccagaccgttccctcccctagctcgggcgctgtctgggtggactgggggttgggatggttcggacgacagcggcggaacagcaggagccgagaggggcagagaggggcaggaactacagggctctagagggcacctgggcctcggacacgcggccgctcagggctgtgcttgacccagt

SEQ ID NO: 1727 - DNA, 8500 bp, Homo sapiens
gggcattcacaaaaagtattttattattcttaacagtactcactttaaaggaataagaggatagcatacattttttacagacaatatataaatgttgtacataattaacaataacttagttcactaatccaaaataaaacaagccaaataaaacataaaaacagaaaatactgccgattctttttcttatgcggacactagtacaaaataagttacttctggccgtggtgctccctgcagcgactgcccgcccatattgcacttggtcactacatcagcacaatcctcctcctgggccaggggcccctcacaggccaccacaccccgccgtcaccgcatacagaatctaagctcgggacacgtttatatacagctgtaccttgggaaggatccagacagccacagtaaagctggacctgagaccccagcagggacacagcctctccctgggtcctggtcctgacctgcccccaactcctgccttcaccccctgccaggccagcaaatgccaaccagcccccagaaaccaagggcagcaaaggcccctccccacccccagctttcatactagggctgtgggatcccagctcttttccaaaaagaattgcaaagctccaaccttgtgtgtaggttttattcctttcatagcagggctcctgtggctacgtacaatcaactggacccaaaaagagtttaaaaataaaacaattaactcatcagcgagttaagcctatgcatttttttaatattttttcttttgtctcagagtaggaggcgagggggttgaagggttagcagaaaaaggatgtatttacagggtccacctgacaagacaggctgtggcttgcgctcagtaaggggacacagtcacagcagcttcggcctcaaagccaagggagcgatctgggagacgtttcccctttcaagaaaatgttgtttccttcctgtgacccagccctggcctgggaatctgtgcaggaccgcccgtgattgtctctgccctccagggcctggcccgtcaaagcaggcaccagctcaccctccctgggccgtggccactctggctttggctcagcccagcctggagttcggctatttcagagagggaagccagaggagaagagggtgcaggctgaggtccccacaaatctgcccccagagccctggcaagtggacccgccaatcccgaggaagaaccggaggacttgggacagctcagaccaccaagtctccaagtccttgttagaaacaagagcaaaataaattatttttgcctaatcctttttccttctaaaaatggttgccttcgtctgtcccgtcccctccttttctctacataaagttgtccttgttgttctccaaacaactgtccatgcaggaaaccccacctgggcagcggtcaggtgcggaggcagcctctcagcggtggggaacattcacagtaactgctggcaggctgctgggcgccctccaggagagggggtgctgggccgagccgggctggcaggagtggtgtcggccttcgggaaatgctgggctgctaagggtttggtccacccatcccgggagtgcccggtcctcgacgtccatctgttccctagcccatggcggtcaccatgctggacgggtgggggtggccgaaggagaggctggaggaggggtggatgggcgtcggagtgggcaggatgtgtccggagtggctgaagggcgggaggtggcccacaggtgccatgtgtccagccagggcagctgcactgaagggggatgacttctcctgcatgcactttgacagctcctcgaagcactccgcccctttcttgctcttcttggacttgttggacatcttccggttccgagtctggatcccttccttcttcatggtcagtggcctgttaacctagaggcaaccaccagttttcagagggccagttccttcctccagcaacattcctcccaccccgccacagcgtggaccagaggcaggtcaagctgagggtcccaggaagccaggaattgtgcccgaccttcatagtcccatcaccagatggctaccattccaggaagggcgggttctggcatatggggctgacccacaccctccctggctctgcccaccgcatgccagcactgcccagccaactgaagtcctcccccccaccctgaccctttttaagcagagaaaccacttccctagtccgagaccctgtcctagccagctccacctcctgagcagaggcaaggcacccctcttacgggaagcccttctggcgctcactcagggcagcagcttcccaagccaagccaagctggatattgtggctggggcctcttgcctggcagcacaaagcgcagaggtcccctgggaggggcggggtggccggggcggggcgcactcacattgtgcagcttgtagtagaggccacaggcgttgcagacagggtccccgttggcgtttcggcgccataaggtggtggttgtcgtctgacaatttgcacaacaggtgccggctcttctggcggccgactgggagggcaaggcagcgtcagcaggctggactcccacgcccacctcgacccccctccctgaccctcgctccacccccagtccccaccagctcagtcaaggagggctaaatctcacatgggaatcaaagcatctcagaaccatggaattttagaatttgagaacgaaataagtcaagactcacagaactttggaataaagaactctcagaagcctgatgttagaatcaacgggattgcaagagctacagaggagaattagctacctcccccaactaccctgcgctctaactccataaatggggaaactgaggccctgagaagggctctctagtagcacaggcatcctgaggctgagccggcttggtccccctcgagcccctggatctggggccgattctgtgtctcctctagcacgactccgctcaaaatccataatcctgggtgagtcagtgtcgctgaggccagcgcaggtttacagagtgcagagctgcaccgtccaacactgtagcagctggccacaggcagccatttaaataagatctaactacaaattaacaaaattaaaaacccagttccctcaattgcacgagccacatttcaagtgatcaatattcacatgtggccaggggctaccacagtgggcagtgcagacacagaacttttccatctctccagctgatgtgagtgctgatcccccccatccagccccccataccccaacccttagagctttaaccaccccgcagcccctctgagtcctagtccctcaggaaatgcctggcagaggtagggtctggaaatgagcgcctggtccttgcagagagaagctagagggaggctttacccaagaaaacagatcccctctcccggttccaccaacgccagccccacagtgacagagggggtcccccaacacttcccagagaactgcaggcgggagtgcaccaggtggtgagtgtggggggctgggggctgaggcctgcagagcctggaacagccccaggcccaagcctggtcacagaagggacagagggactgcagccgcgggggcagggaggggtgagtaagcagcctgaagctggaattctgactcaggggccaacgccgcgtcctccacctctacccccacccgggcctcaccccgccctcgctccaggggaaaaaaaggcccccaaagcagggaacgatttaagcctcataaatcacttcgccctgaaaaaatatatttattattcttagcattttacgcattatttgcagagtggagggtattagaaatttcaaaacagcccagcgagaggcaggactgagctgaggagactctaaaaactcgcagagtccggaaacagatacacgaagtttccttatcttcaggctgcagatgtccggataggaaactccggcaggagatccgaaagggcatttttttaaaatcactcaaatgaaaatacacagtataggtgactccatggaaaaataataaagggcaggtttttttagtggccggtgtgagtttgtgttttatttaaataagcacgaggagcttgtgagcggggctgtcggggagggctgagccacaaggaaaagtacttcatggccctatttttaaaaaagagctaagcagaggccagaggacaggagtccggcccgtggacactcaacttcggggatcccggagcagagtggggtggcgcaagggtgcccggtgggctccctatacccgaggaggaaatctggcccgaaagaatctggccagaaagagagacgaccccaactgacatcccagtgcttttcatgataaaagaggatttcaagcggcaaagcgtctgcatttgaaggagtttttttcccctgtaattaaccgccagctcctgcccagcagccccctcccagccacctgtgcccgctcctaccagtcttcgcttgggcttgatgagtggtcggttctgcccattcatcttgtggtagaggccacaggcattgcacaggtagtggccggtgccgtcccgccgccagagaggggtggctgtggccccacagttgacacactcccggccttctgcaggggaacagggagagacacgggggcctgcttaaccggcaagttctcgggagggagtccagggcaggaaagcagccagccgagcagtgccggtgcctctcaggcacacggttggcctgggcctggctgcaacagcctgggcaggaagagggacgagagggtctcccacatgggagggggcacaggtccagagtcgtttaaagccaaatcccctgcttccaatcctcaccaggagggatggaaacgaaggaggaggggaggaggggcccagggccccaggcgttctggagcaaccaggagggtatttactgcaaactttgccgagggtagggtggtggcaggagtcacccagctcaacctggctgggcccaggaggctctctccttcccgctctggcgcgtctctccccctctcctcttttgtccctctcctttctacccaactgtgtctgccccaccccgtctttctgctctaagtccagaagcatttccctctttctccccaacttttctcctcttccaccaaagctctagaatttttctgagtcctggaaataatggatcgaagttgttgttctttaaaataaaataaataataagctctttcttttttagataagtggcctgggttttttttgtttgtattttttttttcaattaaaagaccatctggaattcaaataaaatgcaaaacaaacaggagaaaggaccaagaaaaggcaagctgacgggtctgagcagaactaggaccctgagccggggctcagcgggtgctggggccagcgggggctggggctggggaccaagttgagcaggatcactggctggcatcgtgttccccaggaagttattcttgatttagtttaaactaaatgaggagtacagcctggcaagagaaggtggttcctgcactcaggagtaactgttttaaaaaccttccccctctgtggctcaaagggattcgggaaagagacatggacagcaagaactccacactagccacgagtttctgggtttatgctctgtggccagattcttggacaaacccagtttggccccagccagctgcgggaaaaggggcgggggcactgcagcttcatcccctcactccagccctcagggagggagagggaagggcctggcgagggcagggagcaggagcaggtcctgggaattttgctctggggaaaatctcccgaggagatcagggagccatcgaaatcccaagatcagactgattgagttagagacccagattccttaatggtctggaacctccggagtgcctgaaacatgcacacacaacatgcacacagacacacgtatacacatgcacacacgctcccaaacacatgcacatacagagtcacttccctcgcttcacatactaagtcctgaggtggcttgaattttcacttaagattcagggagggaaagggggaattcctgttctatgttctggtcaggcagtgaccaaccctggggcaaggaactgaactttgggggtacactggaagcacttaagaaaatggcaaaagttttagagtctcctctccctgacccgggggtctcaaacatctgctgggggctattagagcgagacatcacccatccccagatctgggaaaccaacactgccacctctcccaagtcacagctccccaccacaaaaacgcaaatgctcccctcttccacgaagtccccagcacctgcctttacctgaacaggaacgagccttgctgcgctgcttaggggtgaagctggaggccggtccccccaggaagcctccggggtggaagagtccgctgctgtagtcgtgggcagccgccggcacataggaggggtaggtggggatggggtggtgtgtagcaggctgggtgcccatagtagctaggcctgggcgcaggggactgccactttccatcttcatgctctccgtcagtgacacctggtacttgacgccgtccttgtcctctcctcgggctgcactaccccccgcggaagatgaggctggagacgcagcccccgtggtgctagggtcaggagacacttctttgggtggcgtgggtgggaagccgaaaaggtgggagccagagtgggctgctgtaggggtgagggaggccactgagctcccgctgcctcccccgctcccacccccagcccctgggtacacagagagtgggcctccagggcctccagcagctgaggggtgcagtggcgtcttggagaaggggctcacggtccaggggttgtggtggtgggccgcagcggcagagagggctgctttgcccccgtccagccagggcaaacccgggctgtgcaacaagtgtgggcggcacatctggcctccggtcaggcgggctgcgggcaaagagagagaggatcagggtgggcagaaagatcagggtaggcagagctagggacgcccctgacagacattgagatcacgactcccagaaccagcagtcatcccctccccaaagaaagccagaaacataataccccaccggtaataatcaggaatgtcagtccaagctgaaggacaagtggcatagaaggaaccccaccggacagaccctacagggaaccctcacaggccagctggaagtgggcagaaaccctgtgggtcccagaccctccccaatcggccgctgctcccacctctcccgccccaatttttcagcagctcgattcctgcggatcctacatccgggaagcaagcagacgggccctcctcccctccctcgcctggcgcgcggcgcctgggttctcatcaccacgggcccagtgctcaccgtgcgcggggctgtaggagacgcgcgcccgcgcgtgagcggggttggcatagtaggggttgccctgcgagtcgaggtgattgaagaagacgtccacctcgtctggaggcagcagctgcgcgggttccatgtagttgtgcgccaggcccgggtggtgtgagtcggggtgctgcgcattcagcacggccgggtgcgccatccagcgcggctgctcgggcgccacctccatggccggcggcggcggctcagggtctgggtgcagacggcaacggccctgcgcgaggaagggggagtgaggcgtgccgccagcgcctgacaccccccaaagtcccaccacgaggtgtcccgcacgccacggagccccagcccagatccggcgagaaagagcaccagtcccgggtgggaggaaagcccaaggctcaaaacgaaaggaaggcgggggagggggttcagccacgcacactcacgtggtgacccgcggctccagaatcacacacccgtgcacatggggtcacgcccggggacgggtcccgacaccagtgaccccaacaaacgcacagagcagcacttcagtcagacactcacactgagcccccccgcccggtagacaaacacatgaacacagactcaaaagttggagacaggcgcccgggcacccagtgtggcacttgatcccagcgacacgcacacacccacacttggcgccagatacacatactgatctcaaccccgaaaacatgcacacgcagccccctgagcgcagtactaagcggcacaatcaggacctctcaacaaagcacaccaaagcagtcgcccgcagcctggccccccgccctaagtccccccagagtcccctcaaagctaggagcgccccaggcccccagccggctctcaaaccccaaacttacacacgcagccgtggggaggggagggactcggcctctgagagtgaaggagttccggcgggagccccgagggcgacgggcccagggacagcacgtccggaggctggcggggcttacagggtaggagctgggggtagagtgcgcctcggcctcgggccctcccggctccggcccctcggcatcctccggccgccctggcgccagctgccgactc

SEQ ID NO: 1728 - DNA, 13766 bp, Homo sapiens
gggcattcacaaaaagtattttattattcttaacagtactcactttaaaggaataagaggatagcatacattttttacagacaatatataaatgttgtacataattaacaataacttagttcactaatccaaaataaaacaagccaaataaaacataaaaacagaaaatactgccgattctttttcttatgcggacactagtacaaaataagttacttctggccgtggtgctccctgcagcgactgcccgcccatattgcacttggtcactacatcagcacaatcctcctcctgggccaggggcccctcacaggccaccacaccccgccgtcaccgcatacagaatctaagctcgggacacgtttatatacagctgtaccttgggaaggatccagacagccacagtaaagctggacctgagaccccagcagggacacagcctctccctgggtcctggtcctgacctgcccccaactcctgccttcaccccctgccaggccagcaaatgccaaccagcccccagaaaccaagggcagcaaaggcccctccccacccccagctttcatactagggctgtgggatcccagctcttttccaaaaagaattgcaaagctccaaccttgtgtgtaggttttattcctttcatagcagggctcctgtggctacgtacaatcaactggacccaaaaagagtttaaaaataaaacaattaactcatcagcgagttaagcctatgcatttttttaatattttttcttttgtctcagagtaggaggcgagggggttgaagggttagcagaaaaaggatgtatttacagggtccacctgacaagacaggctgtggcttgcgctcagtaaggggacacagtcacagcagcttcggcctcaaagccaagggagcgatctgggagacgtttcccctttcaagaaaatgttgtttccttcctgtgacccagccctggcctgggaatctgtgcaggaccgcccgtgattgtctctgccctccagggcctggcccgtcaaagcaggcaccagctcaccctccctgggccgtggccactctggctttggctcagcccagcctggagttcggctatttcagagagggaagccagaggagaagagggtgcaggctgaggtccccacaaatctgcccccagagccctggcaagtggacccgccaatcccgaggaagaaccggaggacttgggacagctcagaccaccaagtctccaagtccttgttagaaacaagagcaaaataaattatttttgcctaatcctttttccttctaaaaatggttgccttcgtctgtcccgtcccctccttttctctacataaagttgtccttgttgttctccaaacaactgtccatgcaggaaaccccacctgggcagcggtcaggtgcggaggcagcctctcagcggtggggaacattcacagtaactgctggcaggctgctgggcgccctccaggagagggggtgctgggccgagccgggctggcaggagtggtgtcggccttcgggaaatgctgggctgctaagggtttggtccacccatcccgggagtgcccggtcctcgacgtccatctgttccctagcccatggcggtcaccatgctggacgggtgggggtggccgaaggagaggctggaggaggggtggatgggcgtcggagtgggcaggatgtgtccggagtggctgaagggcgggaggtggcccacaggtgccatgtgtccagccagggcagctgcactgaagggggatgacttctcctgcatgcactttgacagctcctcgaagcactccgcccctttcttgctcttcttggacttgttggacatcttccggttccgagtctggatcccttccttcttcatggtcagtggcctgttaacctagaggcaaccaccagttttcagagggccagttccttcctccagcaacattcctcccaccccgccacagcgtggaccagaggcaggtcaagctgagggtcccaggaagccaggaattgtgcccgaccttcatagtcccatcaccagatggctaccattccaggaagggcgggttctggcatatggggctgacccacaccctccctggctctgcccaccgcatgccagcactgcccagccaactgaagtcctcccccccaccctgaccctttttaagcagagaaaccacttccctagtccgagaccctgtcctagccagctccacctcctgagcagaggcaaggcacccctcttacgggaagcccttctggcgctcactcagggcagcagcttcccaagccaagccaagctggatattgtggctggggcctcttgcctggcagcacaaagcgcagaggtcccctgggaggggcggggtggccggggcggggcgcactcacattgtgcagcttgtagtagaggccacaggcgttgcagacagggtccccgttggcgtttcggcgccataaggtggtggttgtcgtctgacaatttgcacaacaggtgccggctcttctggcggccgactgggagggcaaggcagcgtcagcaggctggactcccacgcccacctcgacccccctccctgaccctcgctccacccccagtccccaccagctcagtcaaggagggctaaatctcacatgggaatcaaagcatctcagaaccatggaattttagaatttgagaacgaaataagtcaagactcacagaactttggaataaagaactctcagaagcctgatgttagaatcaacgggattgcaagagctacagaggagaattagctacctcccccaactaccctgcgctctaactccataaatggggaaactgaggccctgagaagggctctctagtagcacaggcatcctgaggctgagccggcttggtccccctcgagcccctggatctggggccgattctgtgtctcctctagcacgactccgctcaaaatccataatcctgggtgagtcagtgtcgctgaggccagcgcaggtttacagagtgcagagctgcaccgtccaacactgtagcagctggccacaggcagccatttaaataagatctaactacaaattaacaaaattaaaaacccagttccctcaattgcacgagccacatttcaagtgatcaatattcacatgtggccaggggctaccacagtgggcagtgcagacacagaacttttccatctctccagctgatgtgagtgctgatcccccccatccagccccccataccccaacccttagagctttaaccaccccgcagcccctctgagtcctagtccctcaggaaatgcctggcagaggtagggtctggaaatgagcgcctggtccttgcagagagaagctagagggaggctttacccaagaaaacagatcccctctcccggttccaccaacgccagccccacagtgacagagggggtcccccaacacttcccagagaactgcaggcgggagtgcaccaggtggtgagtgtggggggctgggggctgaggcctgcagagcctggaacagccccaggcccaagcctggtcacagaagggacagagggactgcagccgcgggggcagggaggggtgagtaagcagcctgaagctggaattctgactcaggggccaacgccgcgtcctccacctctacccccacccgggcctcaccccgccctcgctccaggggaaaaaaaggcccccaaagcagggaacgatttaagcctcataaatcacttcgccctgaaaaaatatatttattattcttagcattttacgcattatttgcagagtggagggtattagaaatttcaaaacagcccagcgagaggcaggactgagctgaggagactctaaaaactcgcagagtccggaaacagatacacgaagtttccttatcttcaggctgcagatgtccggataggaaactccggcaggagatccgaaagggcatttttttaaaatcactcaaatgaaaatacacagtataggtgactccatggaaaaataataaagggcaggtttttttagtggccggtgtgagtttgtgttttatttaaataagcacgaggagcttgtgagcggggctgtcggggagggctgagccacaaggaaaagtacttcatggccctatttttaaaaaagagctaagcagaggccagaggacaggagtccggcccgtggacactcaacttcggggatcccggagcagagtggggtggcgcaagggtgcccggtgggctccctatacccgaggaggaaatctggcccgaaagaatctggccagaaagagagacgaccccaactgacatcccagtgcttttcatgataaaagaggatttcaagcggcaaagcgtctgcatttgaaggagtttttttcccctgtaattaaccgccagctcctgcccagcagccccctcccagccacctgtgcccgctcctaccagtcttcgcttgggcttgatgagtggtcggttctgcccattcatcttgtggtagaggccacaggcattgcacaggtagtggccggtgccgtcccgccgccagagaggggtggctgtggccccacagttgacacactcccggccttctgcaggggaacagggagagacacgggggcctgcttaaccggcaagttctcgggagggagtccagggcaggaaagcagccagccgagcagtgccggtgcctctcaggcacacggttggcctgggcctggctgcaacagcctgggcaggaagagggacgagagggtctcccacatgggagggggcacaggtccagagtcgtttaaagccaaatcccctgcttccaatcctcaccaggagggatggaaacgaaggaggaggggaggaggggcccagggccccaggcgttctggagcaaccaggagggtatttactgcaaactttgccgagggtagggtggtggcaggagtcacccagctcaacctggctgggcccaggaggctctctccttcccgctctggcgcgtctctccccctctcctcttttgtccctctcctttctacccaactgtgtctgccccaccccgtctttctgctctaagtccagaagcatttccctctttctccccaacttttctcctcttccaccaaagctctagaatttttctgagtcctggaaataatggatcgaagttgttgttctttaaaataaaataaataataagctctttcttttttagataagtggcctgggttttttttgtttgtattttttttttcaattaaaagaccatctggaattcaaataaaatgcaaaacaaacaggagaaaggaccaagaaaaggcaagctgacgggtctgagcagaactaggaccctgagccggggctcagcgggtgctggggccagcgggggctggggctggggaccaagttgagcaggatcactggctggcatcgtgttccccaggaagttattcttgatttagtttaaactaaatgaggagtacagcctggcaagagaaggtggttcctgcactcaggagtaactgttttaaaaaccttccccctctgtggctcaaagggattcgggaaagagacatggacagcaagaactccacactagccacgagtttctgggtttatgctctgtggccagattcttggacaaacccagtttggccccagccagctgcgggaaaaggggcgggggcactgcagcttcatcccctcactccagccctcagggagggagagggaagggcctggcgagggcagggagcaggagcaggtcctgggaattttgctctggggaaaatctcccgaggagatcagggagccatcgaaatcccaagatcagactgattgagttagagacccagattccttaatggtctggaacctccggagtgcctgaaacatgcacacacaacatgcacacagacacacgtatacacatgcacacacgctcccaaacacatgcacatacagagtcacttccctcgcttcacatactaagtcctgaggtggcttgaattttcacttaagattcagggagggaaagggggaattcctgttctatgttctggtcaggcagtgaccaaccctggggcaaggaactgaactttgggggtacactggaagcacttaagaaaatggcaaaagttttagagtctcctctccctgacccgggggtctcaaacatctgctgggggctattagagcgagacatcacccatccccagatctgggaaaccaacactgccacctctcccaagtcacagctccccaccacaaaaacgcaaatgctcccctcttccacgaagtccccagcacctgcctttacctgaacaggaacgagccttgctgcgctgcttaggggtgaagctggaggccggtccccccaggaagcctccggggtggaagagtccgctgctgtagtcgtgggcagccgccggcacataggaggggtaggtggggatggggtggtgtgtagcaggctgggtgcccatagtagctaggcctgggcgcaggggactgccactttccatcttcatgctctccgtcagtgacacctggtacttgacgccgtccttgtcctctcctcgggctgcactaccccccgcggaagatgaggctggagacgcagcccccgtggtgctagggtcaggagacacttctttgggtggcgtgggtgggaagccgaaaaggtgggagccagagtgggctgctgtaggggtgagggaggccactgagctcccgctgcctcccccgctcccacccccagcccctgggtacacagagagtgggcctccagggcctccagcagctgaggggtgcagtggcgtcttggagaaggggctcacggtccaggggttgtggtggtgggccgcagcggcagagagggctgctttgcccccgtccagccagggcaaacccgggctgtgcaacaagtgtgggcggcacatctggcctccggtcaggcgggctgcgggcaaagagagagaggatcagggtgggcagaaagatcagggtaggcagagctagggacgcccctgacagacattgagatcacgactcccagaaccagcagtcatcccctccccaaagaaagccagaaacataataccccaccggtaataatcaggaatgtcagtccaagctgaaggacaagtggcatagaaggaaccccaccggacagaccctacagggaaccctcacaggccagctggaagtgggcagaaaccctgtgggtcccagaccctccccaatcggccgctgctcccacctctcccgccccaatttttcagcagctcgattcctgcggatcctacatccgggaagcaagcagacgggccctcctcccctccctcgcctggcgcgcggcgcctgggttctcatcaccacgggcccagtgctcaccgtgcgcggggctgtaggagacgcgcgcccgcgcgtgagcggggttggcatagtaggggttgccctgcgagtcgaggtgattgaagaagacgtccacctcgtctggaggcagcagctgcgcgggttccatgtagttgtgcgccaggcccgggtggtgtgagtcggggtgctgcgcattcagcacggccgggtgcgccatccagcgcggctgctcgggcgccacctccatggccggcggcggcggctcagggtctgggtgcagacggcaacggccctgcgcgaggaagggggagtgaggcgtgccgccagcgcctgacaccccccaaagtcccaccacgaggtgtcccgcacgccacggagccccagcccagatccggcgagaaagagcaccagtcccgggtgggaggaaagcccaaggctcaaaacgaaaggaaggcgggggagggggttcagccacgcacactcacgtggtgacccgcggctccagaatcacacacccgtgcacatggggtcacgcccggggacgggtcccgacaccagtgaccccaacaaacgcacagagcagcacttcagtcagacactcacactgagcccccccgcccggtagacaaacacatgaacacagactcaaaagttggagacaggcgcccgggcacccagtgtggcacttgatcccagcgacacgcacacacccacacttggcgccagatacacatactgatctcaaccccgaaaacatgcacacgcagccccctgagcgcagtactaagcggcacaatcaggacctctcaacaaagcacaccaaagcagtcgcccgcagcctggccccccgccctaagtccccccagagtcccctcaaagctaggagcgccccaggcccccagccggctctcaaaccccaaacttacacacgcagccgtggggaggggagggactcggcctctgagagtgaaggagttccggcgggagccccgagggcgacgggcccagggacagcacgtccggaggctggcggggcttacagggtaggagctgggggtagagtgcgcctcggcctcgggccctcccggctccggcccctcggcatcctccggccgccctggcgccagctgccgactcctgcacagacatgaagcgggggccgcgcacgcctaagaagcccaagccagccaatcaacgccgcgcgcctcccagcctccgcctcccattggctgcgtccgcaattcccgaaccgctggactccgggactgacccgcgggccggcccccctcagccggcgggccccctccctgcgcgctcctggcggcccctgctgccaacgcgccccaccactaagggaccctcaccccaaggcccgacccctgcagcccctcttgcgaacactccgggatccctcgatgctctgggcctccctagcagtaactaaccaccaactgccccctccccaggagcccgggccgcacaccctctggatggcctctccccgagaccctaaccccgccacgctccttcaccgctgaacgtggtcagtccgagcgcagttacctacccagaccgttccctcccctagctcgggcgctgtctgggtggactgggggttgggatggttcggacgacagcggcggaacagcaggagccgagaggggcagagaggggcaggaactacagggctctagagggcacctgggcctcggacacgcggccgctcagggctgtgcttgacccagtggaggtggcccggccggtggctccagaaagggggagggggcacccctccccgggcgtggccttcgcaggccaacgggcccaattgcctggggcgaggccgtggagacccggactggcgccggcgccagctggagggagacgcccccgggcaagaggtggcattttttttcctccggggggggtccccgaggtggcctctggtgagggggaggcggtggtctgaggtctccgtcttctaagtcacctggaagtgctccccactcacttctagcccggagatcggctctatggttcgtgtgggccgggcgcacaagtcttcctccctcccattgtacagactggggagacggaggctcgaagggagccccgggccgaggagggaggtccaggacaaaggcattttgggggacctagacaggtgccgagtactggggggactcaacagcgtcctccagccctcttccctgttgggcccgaggctcccggggtagatgtccagagggcccccaggtgggtcgggggcaggaggagggctggggtcccggccacccccgggagagtgggggaggggcggcgggattgacagtcggtaattgggtaactggaggcggcttctccggccgggcggccccgccaccgcgacgccgagcccctgacgtcacccgattcgccaggaaatgaactttttaataatccgaggagggaggaaagccctcggtcccctcggctccgggggcgcccggctgggcccagctccgcgggcgcgcccccgtcaccccctcccaggccagttcagggcagcgccaaggggccgcgggctcaggctgaggcctcctcctgcctaggcgtctggcgtccgtttgtctgtccgaggcctcagcgcaggtaaagcgcggggctggggggcgcagagctccattgggctgggaaccagcgcgtctcgtgcccttgggggacccgcctgcccgagccgcctgctaagcctcccgctcccctccacgctggagcgcgcggagcccggtctgctcggaactccactctgcgggagcggaggccggcgccagcccgggaagccgcgcagggggcgggaggccgagcgcgaggcccttggcgccgggcctccgcggccaggccgggcaggtgagcagtctccgtgcctcccggttggcgttcccctcaacgcgtgcggtcccgccggggcccactgtctctccgtccgtctgtctctcaacttttcccatcctttagcttacgattcttcatcaactcgtaaaatgagatcgccgcggagctcgagcctatttggcgtctccggagactagcaagaccctctgaaagacaccgcgtccccagggataatcccccgtgtccggcaaagctgccccgctcgagcgcgaaccctgggacccagcgcgggaggcagaccagcagctggccgctgggctgtgaacgccaggaccgagcggaagcttcccgcccggccgcgatcggtgccgcggctctcagggaagtggctacgcgcgtccctcgggaaagcaggtaattcgcctttttctcccaccggcgcggtaaaaattaccctccccctccccgttccgtgtgtattcccagtttcagcgcagcgagctcggcgtctaacccctccgcggcagggtcccggccactgcggtagtggaggtggccagcctggctgagtcccctgcccaaacgtcagccctgtgctgccgcctgcctgacgcagagcggagcgagggaggggatttaattaccccgctcggcagctcagaaaatcgccgcacagaggggcttagcaggacggttaaggagtgcttgagcaggggcctcgggagacccgaaccagcctccttgcccgcaatccggtgtagaggaaaaaaaggaaacaggagttctgccaggtcctttcaggccttggggttgccttcctcgacaacgcaggcaggagccggcttgaccgaagcctccacctcggttgcaggtcctgcgtaggatgcgggactgctgcattctctggcggaaacgaacccgcctgggagagagaaatgcgacgccaagtagcagggcgcccagctggccaataaagagggacccgcgctcgacaatgtctgtgtgtgccaggcagaccgagggacaccaaccgggcccctccccattaggccgaagacatggtcctcccaccttgggccccaaacaaactcccggggagggtcaacgcagcccccagaatctgctggggtcttgaggcgctgttccaggcctggtgagagcagatttactccaatttatgggctggaactttggggtccccaaaacacctttagagggacgcgttccctttttcagtactttgttcgttcgggagtatagttggaaatgctggcgctgcctttgatcacattaagaagctgtcactttccttacttgggaacaagatttctctgaggactggagaaggtcagccaggaagcagaattttcgaaggacccttttggcccgagaactcacagcggcgatcgccaccatttgacctgggtgcttctgcctgggagctggggaggtagcagatctggtgcccggttctagagtgcttctcaggcctctactaagccgcgggtgccaggtggggacacagagatgcccaggtctccccggccgtccagcccccccccccctctgagccctttgtttaaagttagctcatccgaggcggcccctttgggaccataagtttgccctccctttgtaacctaattcttctcgccttttccttatgggcagctaattggcccgcggtgtggggctgggggtggggtgtcaaggaaacccatttgctaagggactaccttccatagagaaatttaattcgcaacccagcggcctcccagccccacactggcaataaaccttgaggggtacggggaggaagtggggtgccttagcagatgggttcagaagttcccttaaagccggggcattagatctcaggccagcagccatccctccgggggggttcccaagggggggactactgctataacggcccctcctgctccttgaggttcaattccagccccttaaagcagaaggctccctccctcggcatcagtgcaggctctcccacctcattactgttctgtgtctttgggaatcgtagagtctgtggcccccacgtcctaggtgtctcggcaccctggacccaggcgcctccgagattctatatcgcttctgacccctaccttcaagcctggcaggctccccgcggaaccctgctgagacccggagacaatcgggccgtgcttctccctcctccacgaacagccacggtttatttggagcggccggggccggcggcctgacaactggtaaatccgtttcgttaggcacaatttgtctgcaatttgtcagcccggctgggaaacgctccccagacgcctcggctgccgcacgggccctacctggttctcgaatcctgcctgctcataaacgaatcctagcacggggtgcctgcgtagacctggagctcaccaccagatgttcccgacctcgggagaggaggctttttccaaaacaacgaatttccttccttgttttccggtaaaggagcgttcgccacacacggggtccctgaacgcggggcctttcccctcgtggttggagcaacgcggagttcaagcctggccgccacagaataattttaaatgccccgttttcagacagatccagaacgccgtctacgcctaccggcggcagatcttcaagcccgcggcggccccattcttattgaaatcccactaaacggattccgactccggcttggggcggggggagacttccagacccggcgctctcccccacacgcaccccagtcacacaggataaagggctgcggggcgcagcgcgcgggggcgcaagcaggagcgagctgggttaagccgcgaaaagccggcgcacgggaccagccggcaggtgcagccgccgctcggcggcccggctcggacgcatccgccgcggtggcctggggattgggggcggccgagacaaaggccccagttcgggggccgggaggcgggggtgctttgcgaggctctgggaatgccagggtctcgtggcctgtggctccgagaaatgggaagacaagaggcccgaggcgggcctgctgtgcccaggtaaccaaatactccctctggttaaagtccctataaccagggtttccggtctctggcagggccaaggcgagccccaaaggtaggggccacagggcaaacggaccaagcgattcgggtgccaggcgggccgggccgggggcgggaagggccgggcccagggaaggtggaagtggaagaaactcaccgagcgaggcgcggtgggcggcgcccccgggcggacggggcctggagtagagctgggagcagggcgaggtgcgcggcaggcgggctcgcgggacctgggcgcggggtggcggcgctcaccagcagagcctgggcggcacgccgagcggccgcatggtgttcagcggaccgcttttgtccgcctggtgggcgacggggccctgctaggatggatgtggcggcaggcaatagacagacttgagcagcgagtcccggggcgacgctggcctcgctaccttcctggcgctcac

SEQ ID NO: 1729 - DNA, 12116 bp, Homo sapiens
taatactcttaatactttattaacttaaaacatcactctaataaatatgtattaacaaacataatgcttaccagaagatctaaaaacatttaccaacctcatcaaagtgaaaataccacctttcccccctctatggtacacatggagggtcaaagagttgaagacagagccttccttcccacatgcctgctagctcagaaatctttaaaatatcagcttaacaataaaaaactgaatatacacacatatctttgaagtaactgttcagctttttgtttacacctgataaaatccaaaagggtcaaaagggaaggtttacaattctgtgctgtcttctcagaattccctccaagagtaagaacagacccagccacttggaggtgcaaccgttagcttttgaggagcagtcaggggttgtgacttcagtctctcttccccaatacctagcatggtgcctggtaccttggtagccggtgatccatgaacatttgctgagtgaatgaatgacatcttgtccacaggcattgcttgtgcttttacctccagtgatgaggttttcacagccctactgaagggaggacctctaatcccctctcattaccaacttctcttctgcttcttcttgggggtagcctcgatggtgcatctcatgacttcaaagtattaaattccttccccaagtcagtttctgaatcagtttttgaggaggagaaatgattcctccaagatttataggcagcacccaaaagaaaggagtcaacagaccccccagaaggaaaaaaataaaagttaacactcactcttctttctagataaaaatattagcatttgtccaccttgtaaatggtgattcctcctcttccacacaaatatctggggtaggtcaagaggggggagggaagaaacctgaagggcattcctgtctgtagattagggctggaaatgggaaggactgtggggtctaagatttattctggtccccatttgactttgcctttgtcttcaggtgtagaggagcctatttgtgtccgaagcctagagagtcacttggttctcactctcggctgcactttgaaaaggtacctcatttcttctggcagctccaggaggtaaggcgaaggaggagcaacctggtaggatctgcagactggacctggggtctggaaagtcagaagggagtggaggcaagcagggagcagagtggtggcaagcagggaggctgccctctgtagtgttgtgtagctgctgcttgcagccagccagggtgctcatttgagcccatgctgcgtctcccggtgccttcggaggtccaccttcctctggaaacccttcccacagaggtcgcagccgaagggcttgaagcctgtgtgtttgcggctgtgggtgatgaggttggagctctggctgaatgccttgccgcacacctggcacttgtgaggcttctcacctgtggggatgggagggggaggggagaaagtatgagtctatgataaagctagaggggacccactgtgacccacatgctcttggcagcagctggttgcaccacagtctaaggccttcaagcaacttggagggtgacgtgttgcaacctgaactgactcccagcctgcaatgcgagtccctggaagcaccatgggggcaccaggtgaaagggagactttctgaaggggggttcccagccaaaggcctcaaacggtttcctgctaaacggaaacagagcaaaggccacgtgccctccccagctgaatctaccccgggaggactcccctgactttataagccatgaacactcagagcagatgttcaacaggaaggggagggggaagctgtcctaaaaccgtgtgactccgttctaattcagaggaagttttcaaatctgaatttccaagtgggtgttagtttgtatggatcagtgagcccgtcttctttcttgttcttgaaggacagcagattatatctgaaaaaacatcttaacatggactttctttctttctttatttctctctctctctctctttctttctaagttccggggtacatgtgcaggatacgtttttcaatatcttattttaaaaatccacatttgggccacaaaggattaaggcagctgatactttactgtcttgatttttccttaattttatggggttaatcacatgattctttatataccagcaattcttcaccacaaattaataaataagagaacacaagaaggttttgtcttgttccccatctcatgtgttgttgggtaaatggcatgaatttccaatagcccagcatggcattatagtcagggctcagccttggaaaaagtataaaatagatgaagtttgtttttgaggaaccctctgtcctccttgctaaaaactcttttctgttttcatgcttcagatttccttgataagaaaccacccatcaaaatgtattctatccctttagggtcaaacaaatctgagaaaacaaattctaggtataacgtaaatgtttgataagggcttaatgttttattcagtcaagatcctagttgcattttgataagtgtcctgaataccttacttataaggagtgaattacatggaaatttcaggtaagagggaatgattaaagtagaatacttttctgggttttcaatggaaatatatacattacccaagtatatttataaacatcaagggtgggtgtttagaatacactgtgatttgttctaaatcagtattcatattctgcaataaaattttcagaaattctgggtctcatgtaaatgtcttttgactattagagtgttcttggcattaaaactcccacccgcacataaagtgttagacaaacagtccaggattaaaagccagagcattacatggctacattattcattcagtcttacttctgataaatcattcactctttctgagtttcaggatggtaagagcagctccttctactttcttgagtggcaataagaatcaaatgaaatgatagatttgaaagtactttgtaaattataaagcattataataggtaaggaattatcattattatggcattaacttgcagatattttgaaaagggcaataagtgaacagaagctttctgtctaccaacctcatgactctgaacataaaatacaataaacagtggtcaagagtgaacatttgagaggtcagacctgaatttgagctctggccctgtcatttgctagcagtgtgaccctgggcagattacctagcctcatttttttcatctctaaaatggggagaaggagtagtcgctacctctcagagttgttgtgagcataaaatgaaataatgcatttaaaaaatgcttagcagagagtttaatcatatttgccattatttgttcctcttcaatcagaataagctctcagactcctgaaaatgcagccggagagtccacacgagtccctcccacaaaaggccaggtggttagggaaagtcctcaatctctaggtaagctttagagcaactctctaagaggaccctggagcttcatatttcacccagagcaggcagcaggggaagcagctgctaacctaaaggaaaatgttctttccaagtatagagtacctgtgagctgacctgctgagtggcctttcagacacaaccccaaatcaaggtggctctggggagaattatgccggtaaatgaaccaaagaacccacccctttgttttctttaacacagagcagagaataactccatcagaaaggcctcatccaccactcactggggccagaaatcagagaagatgagtaatgttggcctcagggtgtttcctacaagccaagggcctttttagctcaccagtgtggatgaaagtgtgtttcttcatgtctgacttctggtggaacctcttgccacagtactgacaggggtagggccgagtgtctgagtggataagcaggtgtgtggacagtgtggatgacctcttgaagctcttcccacagatcttacagtcaaagctccgttcctgcagagagagagagagagagagagagagagagagagagatgcagaactcctactgcagtcaactagactgctgctctcctcacccctcagctgaccctaaaatcccttgaacactttttctttctttttttgagacagtctcctctgtcgcccaggcttgagtgcagtggaacgatctcagttcactgcaccctccacctcccaggttcaagcaattctcgtgtctcagcctcccaagtagcagggactacaggcacacgccatcacacctgactaatttttgtatttttagtagagatggggtttcaccatgttggtcaggctggtctcaaacacctggcctcaagtgattcgcccacctcggcctctcaaagtattgggattacaggcgtgagccaccgtgcctggcccttcaacactttttctaccaaaacattcttcacccacaaccttccacaccccatggcaaatacatatccacaccctgctttttttgacacccattagcacacacttctccaccctcctcaacaggaggcttagacctcagtcacttgagatgccacctccccccagccagtgtgggtgctgggggagatgggctaatactctttttagccttcgtaagtaggcattctcctgagatagctattggcatatttacttgctcatctactctccatctctcagctaaactataatcttcatgtgggcatgctgtcaaggacctgatgtgttataagattcttaagtacttggcacctggaagttagccaacaaatatttattaatgaatgaatgaataaatagcggcggtggggcatggtggctcacgcctgtaatcccagcactttgggaggcccaggctggtggatcacttgaggccaggagttcgtgaccagcctggctaacgtggcgaaatcccgtctctactaagaacacaaaaattagctgtgctgtagtggcatgcgcctgtaatcccagctacttaggaggctgaggcacgagaatcactttaacctgacagggggaggttgcagtgagctgagattgtgcaactgccctccagcctgggcaacagagccagactctgaaagaaaagaaaagaaaaaagaaaagaaaagaaaggaaggaaggaaagaatgaatagcggggtgaatatgctactagatgctctaaatgagctgagattcctgccttttcagtcgagaggggtcaatgcaaattaagtgacaaccatttggtgaaaagaataggcacaaagaaacagagctagtaagtctgatatatcagcagcacgaatcagtgcatacaaacctacctcaagcccaaagtaacaatgaggatcacactctcgaggctcacagtggtgtgacaccaaaatccagggctgcctcaaggcctgagccggccacaatcctcctttccctacacacctgcaccagggcaaggggacgcagcggagggcttgggggaggaaactgggggaagtcgaggagaaaacttccaggcagagagtggctggtgctgcaccgaggagatgcagaagatccccgagcagggccgcgcgcggcggtgcgccccgcgcttacctgcgagtgcacggctttgtgctgctccaggctcaccgcgtgcccgaaggtcttgccgcacatctcgcaggcaaagggtctggtaccgctgtgggacctgcgcacgtgcacctcgagcccgtgcggcgtggagaacacctaaggcgggtggggccagagagaaggccgctgagaggggccgcggggcgcaggcgaggcgcgggtaggggaagcgggcgcacggcaggcgaggtggtgagctcgggagcctcaccttgctgcacttgatgcacttgtaggagccgccgcccagcagcaggcgggtgcacagcagctccgactccaccttgacgccagcgcccttgtctgcgtgcagcccgtggccacgctcggggtacagcaagcccgccgctgccgtgggcctctcatacagcccggctgccgcagacccgaagtcgccgtagagccctaggccagggccagcggtggcaccggcccctgcgctgcagctccctggcgccccggcccccgcgccgccggcagcccgcttcgggccgtacagcgcggccgggtggccaggctccggggcgggttcgcagaagaggcccaggccagcgccacgctccagggccccacacggtcggtagctctgcaccaggtgccgcaggtcagaacccgccaggccgctccatgagtacggtttgaaaggcagggggaagggctgggcttcgtccagcgatgggcacattgacttctccgaggctgtggaggcacaaggggagcgtccggtcaggcttcagacggcagagcggaggccgccgggctgcggctgcgagcgtggcgtgttcgcggactgcggggcacccagcgcttgtagaacactgcgtgcgccaggtgccaggctcgccccagggtaaaacgtggcccgggccctggggcctcgcaggccactataggaggcagaacagtaaacagatcattgaaaagacctcgggagaggaggtcgtaaattctgtgcgagtgcagcggaggcgctcggcgttccgaggatcttttctggctggacccgcgcacctggagatcctacagggaagggcgcatctataaatgcccgtagttgagctgttaagaaggagaaggtggcggccgttcggcccctcacagcactcaagggcggaagggtccagccaccagcgcaggcactctcccagcccctacatgttcccattcaattctttttcttcccagaatccaagaggaaggagggagaaggtccataaatgcggccccgaactacccgaaaggctgctgtctgaataaacccgaaggtattaagatttcacgaagttaagtgcccagtgtacgtagcaaaggagcagcaggaaaggggcttttgggcttaaattgacagccaaatactccccattcctgttacagtttgatggaggcggggaacctgaatttctcagagaataactataactcataaggtttagccaccacctgcaaggagacagctctgaattctcggcctgctacgcccccacccacgtgaattttgctaaaactagtgaccccaacgcatgtgagtgcatacggcatttacaaatgtgtgtgtgtgtgtgtgcgcacaacactccagttcaggctggccacttcagtgagaggctgtacccggagtttcgttcggaggggttcggggcgcgcccaatccttgtctggccacttgacgccctggcaggaagaatcctcccgccgccggctcccagacacacttgctggagctatggttttcgccaagtcaactcactgattgtgggacgggtggtggtatcttctaaaactagcaaacatattctggatataaccggcccttgacagaatccggctggtctgctcattccttcccccggccgggactcgagacgcccccacccaacgtgtggtcacttagtttgcctgaagctggattgctcgctggaaatgaaacccagagagcaggcccctgaggctaggttaacccggcaaaacgaaaaatgaaacaggcccccaatctgcgcctgtgaagaccaagccgcgggctgagattttcgtcctgccccctccctgccgcccagcgcctagctcctctgcctggcccgttctgccctgttctctgtttgaggtttgggggtctagattgcaggatcctagcactttataaaacagtcaggtctggtcagaaaatgaaaggtcagcgttgccgccagtcgaaacgactggtttgttttccgtcactggccagctccgcgcaaacgaatctaagcgacaagcagctagggtcctgccgcctgggatggaggcagcagccccagcgggcaagctgtccaagtcccagagaagccggatgcctccttcccctacgaatcagctcccttctcccggaaagactctccaactccccgttagcatttctacgcccaaggtcgcgccaattcccccccagcactgccgggtccctgcagctcccgcccaagaggttcccagtgggttcctacctggagacgcggagggtgacgggggcctccagaagtcctcaaactccgagctccgttcgcagacgctgccttcgcagctgtctggggatgcggaggctctgtctggggcttcggtcagctgcgattcgggggacaaacggtcccggggctccgccttcgccccgcctgcatttgaagtgctgtctgcaaagaggaggcaggtgaggggctcaggctgggaccggttgagtctgagggtgctgaaggctcccccaatcccccgaccagggcagccgagcgtcttcccctctccacccagaccccggccgggaaccctctcggatccgagggcaggcgcagagaggccatggcacctaggagacaaacccggaggaaccaggacagtaggaaacaaaaacagcagcaaaagggacgttggggcagcccctcccagctccggactaatggtgtgccgaggtgcagtaggcatccgggggagcagccccgcctggcccgcgcgcgcctcgcacctgctcggctaggcgccggtacattctctaaacggagggaatagtctggtcctggggagcgcggctggtggtagctgtgagccttcttgcttttgacgagaaatgagcgcggcatggtggtccggcactttccccactgcgccccaagagtccctggagccgctgtcacccacggtcactccgagggcttgctcagccccagcccggaggagacctgagagggaaagaaaaccaggtggagacgtgggtcagtactctccggtgcggcggactgggcacccaggcggagggagagcgcgggccagggaggcgcgcagagggcccacgggaggaggggcttgaccctgctgcgccgcgcttaccaggtggcacttggacaggtggcgcgaacccgccgtcgttgccgccgccgccactgacacagctcagcggtaaaacctgtcccggggccctgtctcaggcccctttcctcctccctgcccacgccccccagctcctcccctttcctagcgaagctcgctccggcaatcaaactccctggagagctgtagttcccatcgggtgggttaccccaactcagctactcatcgcctgcctggctgtgctttacggctggcgagggagggcggggacacgcggatcggtttaggggccggggatgcccagtggtcgaggacccggaaggggcaaggagccaagacctccaagagccagctaccaactggagtgaaaggaccggggggaggggggaacagaacacaagataaaactgtggggcggcgggaggacagcagcagagggattggggacagcagaggccagagaaaggaggtgggagagcaaagggacaggaaagtgaggggaacaacagacgaccaacccccgccccaggagaaactcgcatctgggtgatcccactcgcccctcactagtgccccacgtaggagaaactttgcccttggactcccggctgcggcgggcaccggtcgaggctgcggcgagccatcccagaccatggagacctaacctcgggaatcaggtcccgggaaaaaagcactttccgttctgctcaccaaaaaatcttgtcctagggaggtggagcccgatccacgaacgttgactgggaaatgctaggtgtcccgagtcggtagtgcaccgacaatttagcagacaaaaaagacaggacgccagagcgcgcaggctgcattagcagagagcgggggtcgggcccgggcccgggagggaactagctgcccggggcgtcgctctcattaacccccaatcagttcacctaataccaggtcgaaatctgagcgcagcgggagggcgtggctgcgcctgccgctaggctccagccggctccgggggcggtaccccacagtcgaggtggtctggagtaaacgaatctgccttcctcccggggtgaaggcgatggtgaccgggttcacacgtgagctgcagtacagcagttctccgtggcctcggctggttcagaaacgagggtgctgggaactctgggccggggcaggacctgcagtcctccggcttcgcgctgtttccactgccggactaggagcccctcggcttcctaggcaagatgcaggccacacagtctacgtctgtccgttggcgctctcagctcaaacgagtcctacaggccttggtccctgtagggtgcaggccccctgctccagatccccagccccattgtgtccccttctccggaggaatgggaatagacctgggagaaaagacgcctgggacgtgtcgcggggctcccgcgaagtttcccgctacccaagcgccagaatgcccctaggggtgagagtgccatccgcctccctccggggtggctcctagggctagagctttgtcgcttcctgcacttctcgtccgtacaattagacgccacaaaccccaaacccaattctttaaacagccacgaaactcggaagaaaagaaaaacggagtggcgttgtcccgagggtcccgctgcagcttggacccacgttggctgggagcgggacagatgggggcggggtaactgtcagcgccggagctgggtctgggctggcgccaccagagaccaggcggacgcggaggccgcctccccacccgggctgtaagcccacgcctctctcgcaccccggcccgctttgctggttcctgtggggagcgacagagtttggaggagataggggccccggggcctgggccgagcgcgtgggaaggcaaccccgcgctgcagctggcgcgggaggtggggcggcccctccgcgcgctcaggcctctcctcaccgtccgggcccaggaaggagggagccgagggcgctaagggggcgtcctcccgagcgcagctgccgccgcctccccaccagatgtttccttccctggtggatttggctcccctgccgaaccaccagaccgcctgctgcgcgcccccagctccagatttccagtcacactgcgcgggtcgcgccctaacccagctgccggagctctctgggctcccgcacggcggtccgcagcaggtgggaaaccgcccgcgccctctgatcgcccccgcagtgccagtgctctgcgagtccccgcggccgcccccaccagggcaggaggcgcagaacaggctcggcggacctacctgcggagtcacggcgcgggcaccgcgctaggagagttttcaaacggaatcttgctttcgggagagaccgctctatctctctgacttaaaaaaaaaaaaaattctccttccgagctcagcccccaaaaccacaagcttcacttcctgagcgttactgagtcgctcgcatagccctcccagacctgctcccaacccccgtcgggcggccgggcgcgctcctttgcgcaagtggccaggcggtggggggcctggcctttccagcccgtcccgcgcgccccttagtagtcctcccagttctctccctgtgggtcggcaggggatgggggaaattggaggtccggacacttaggcactagaaatgacttgaaagaaaatgaactattcttggctccagggagacttccgcagcgagagaagccacagattgaggacacagattgactggcgagagaggggtggggggcgccccgctccgaggaccctccccgcccctcaggcctcggtcacccgccccccccacccccgaccccgccgcctcctagggctgcaccacccccgggtcgggaccgtgaatcaccggcccgcggtgccgccggcctggagcccggcgagtggccacggcgtccgcagagcgaaacctgccccgcaggccccgaaatagcttgttgtggaaacacttggggataaatacgcccaacgaggctgaaaataccttgacacccaatccgagaggtttgctcatttcccttcggatttaggtaatggttaaatttggaagaggtgggcgagcgccgagcccccggcggagagggccctggcggcgcgtcccgcgggcgcccggcgggaccggtgggcgcaccctc

SEQ ID NO: 1730 - DNA, 9039 bp, Homo sapiens
taatactcttaatactttattaacttaaaacatcactctaataaatatgtattaacaaacataatgcttaccagaagatctaaaaacatttaccaacctcatcaaagtgaaaataccacctttcccccctctatggtacacatggagggtcaaagagttgaagacagagccttccttcccacatgcctgctagctcagaaatctttaaaatatcagcttaacaataaaaaactgaatatacacacatatctttgaagtaactgttcagctttttgtttacacctgataaaatccaaaagggtcaaaagggaaggtttacaattctgtgctgtcttctcagaattccctccaagagtaagaacagacccagccacttggaggtgcaaccgttagcttttgaggagcagtcaggggttgtgacttcagtctctcttccccaatacctagcatggtgcctggtaccttggtagccggtgatccatgaacatttgctgagtgaatgaatgacatcttgtccacaggcattgcttgtgcttttacctccagtgatgaggttttcacagccctactgaagggaggacctctaatcccctctcattaccaacttctcttctgcttcttcttgggggtagcctcgatggtgcatctcatgacttcaaagtattaaattccttccccaagtcagtttctgaatcagtttttgaggaggagaaatgattcctccaagatttataggcagcacccaaaagaaaggagtcaacagaccccccagaaggaaaaaaataaaagttaacactcactcttctttctagataaaaatattagcatttgtccaccttgtaaatggtgattcctcctcttccacacaaatatctggggtaggtcaagaggggggagggaagaaacctgaagggcattcctgtctgtagattagggctggaaatgggaaggactgtggggtctaagatttattctggtccccatttgactttgcctttgtcttcaggtgtagaggagcctatttgtgtccgaagcctagagagtcacttggttctcactctcggctgcactttgaaaaggtacctcatttcttctggcagctccaggaggtaaggcgaaggaggagcaacctggtaggatctgcagactggacctggggtctggaaagtcagaagggagtggaggcaagcagggagcagagtggtggcaagcagggaggctgccctctgtagtgttgtgtagctgctgcttgcagccagccagggtgctcatttgagcccatgctgcgtctcccggtgccttcggaggtccaccttcctctggaaacccttcccacagaggtcgcagccgaagggcttgaagcctgtgtgtttgcggctgtgggtgatgaggttggagctctggctgaatgccttgccgcacacctggcacttgtgaggcttctcacctgtggggatgggagggggaggggagaaagtatgagtctatgataaagctagaggggacccactgtgacccacatgctcttggcagcagctggttgcaccacagtctaaggccttcaagcaacttggagggtgacgtgttgcaacctgaactgactcccagcctgcaatgcgagtccctggaagcaccatgggggcaccaggtgaaagggagactttctgaaggggggttcccagccaaaggcctcaaacggtttcctgctaaacggaaacagagcaaaggccacgtgccctccccagctgaatctaccccgggaggactcccctgactttataagccatgaacactcagagcagatgttcaacaggaaggggagggggaagctgtcctaaaaccgtgtgactccgttctaattcagaggaagttttcaaatctgaatttccaagtgggtgttagtttgtatggatcagtgagcccgtcttctttcttgttcttgaaggacagcagattatatctgaaaaaacatcttaacatggactttctttctttctttatttctctctctctctctctttctttctaagttccggggtacatgtgcaggatacgtttttcaatatcttattttaaaaatccacatttgggccacaaaggattaaggcagctgatactttactgtcttgatttttccttaattttatggggttaatcacatgattctttatataccagcaattcttcaccacaaattaataaataagagaacacaagaaggttttgtcttgttccccatctcatgtgttgttgggtaaatggcatgaatttccaatagcccagcatggcattatagtcagggctcagccttggaaaaagtataaaatagatgaagtttgtttttgaggaaccctctgtcctccttgctaaaaactcttttctgttttcatgcttcagatttccttgataagaaaccacccatcaaaatgtattctatccctttagggtcaaacaaatctgagaaaacaaattctaggtataacgtaaatgtttgataagggcttaatgttttattcagtcaagatcctagttgcattttgataagtgtcctgaataccttacttataaggagtgaattacatggaaatttcaggtaagagggaatgattaaagtagaatacttttctgggttttcaatggaaatatatacattacccaagtatatttataaacatcaagggtgggtgtttagaatacactgtgatttgttctaaatcagtattcatattctgcaataaaattttcagaaattctgggtctcatgtaaatgtcttttgactattagagtgttcttggcattaaaactcccacccgcacataaagtgttagacaaacagtccaggattaaaagccagagcattacatggctacattattcattcagtcttacttctgataaatcattcactctttctgagtttcaggatggtaagagcagctccttctactttcttgagtggcaataagaatcaaatgaaatgatagatttgaaagtactttgtaaattataaagcattataataggtaaggaattatcattattatggcattaacttgcagatattttgaaaagggcaataagtgaacagaagctttctgtctaccaacctcatgactctgaacataaaatacaataaacagtggtcaagagtgaacatttgagaggtcagacctgaatttgagctctggccctgtcatttgctagcagtgtgaccctgggcagattacctagcctcatttttttcatctctaaaatggggagaaggagtagtcgctacctctcagagttgttgtgagcataaaatgaaataatgcatttaaaaaatgcttagcagagagtttaatcatatttgccattatttgttcctcttcaatcagaataagctctcagactcctgaaaatgcagccggagagtccacacgagtccctcccacaaaaggccaggtggttagggaaagtcctcaatctctaggtaagctttagagcaactctctaagaggaccctggagcttcatatttcacccagagcaggcagcaggggaagcagctgctaacctaaaggaaaatgttctttccaagtatagagtacctgtgagctgacctgctgagtggcctttcagacacaaccccaaatcaaggtggctctggggagaattatgccggtaaatgaaccaaagaacccacccctttgttttctttaacacagagcagagaataactccatcagaaaggcctcatccaccactcactggggccagaaatcagagaagatgagtaatgttggcctcagggtgtttcctacaagccaagggcctttttagctcaccagtgtggatgaaagtgtgtttcttcatgtctgacttctggtggaacctcttgccacagtactgacaggggtagggccgagtgtctgagtggataagcaggtgtgtggacagtgtggatgacctcttgaagctcttcccacagatcttacagtcaaagctccgttcctgcagagagagagagagagagagagagagagagagagagatgcagaactcctactgcagtcaactagactgctgctctcctcacccctcagctgaccctaaaatcccttgaacactttttctttctttttttgagacagtctcctctgtcgcccaggcttgagtgcagtggaacgatctcagttcactgcaccctccacctcccaggttcaagcaattctcgtgtctcagcctcccaagtagcagggactacaggcacacgccatcacacctgactaatttttgtatttttagtagagatggggtttcaccatgttggtcaggctggtctcaaacacctggcctcaagtgattcgcccacctcggcctctcaaagtattgggattacaggcgtgagccaccgtgcctggcccttcaacactttttctaccaaaacattcttcacccacaaccttccacaccccatggcaaatacatatccacaccctgctttttttgacacccattagcacacacttctccaccctcctcaacaggaggcttagacctcagtcacttgagatgccacctccccccagccagtgtgggtgctgggggagatgggctaatactctttttagccttcgtaagtaggcattctcctgagatagctattggcatatttacttgctcatctactctccatctctcagctaaactataatcttcatgtgggcatgctgtcaaggacctgatgtgttataagattcttaagtacttggcacctggaagttagccaacaaatatttattaatgaatgaatgaataaatagcggcggtggggcatggtggctcacgcctgtaatcccagcactttgggaggcccaggctggtggatcacttgaggccaggagttcgtgaccagcctggctaacgtggcgaaatcccgtctctactaagaacacaaaaattagctgtgctgtagtggcatgcgcctgtaatcccagctacttaggaggctgaggcacgagaatcactttaacctgacagggggaggttgcagtgagctgagattgtgcaactgccctccagcctgggcaacagagccagactctgaaagaaaagaaaagaaaaaagaaaagaaaagaaaggaaggaaggaaagaatgaatagcggggtgaatatgctactagatgctctaaatgagctgagattcctgccttttcagtcgagaggggtcaatgcaaattaagtgacaaccatttggtgaaaagaataggcacaaagaaacagagctagtaagtctgatatatcagcagcacgaatcagtgcatacaaacctacctcaagcccaaagtaacaatgaggatcacactctcgaggctcacagtggtgtgacaccaaaatccagggctgcctcaaggcctgagccggccacaatcctcctttccctacacacctgcaccagggcaaggggacgcagcggagggcttgggggaggaaactgggggaagtcgaggagaaaacttccaggcagagagtggctggtgctgcaccgaggagatgcagaagatccccgagcagggccgcgcgcggcggtgcgccccgcgcttacctgcgagtgcacggctttgtgctgctccaggctcaccgcgtgcccgaaggtcttgccgcacatctcgcaggcaaagggtctggtaccgctgtgggacctgcgcacgtgcacctcgagcccgtgcggcgtggagaacacctaaggcgggtggggccagagagaaggccgctgagaggggccgcggggcgcaggcgaggcgcgggtaggggaagcgggcgcacggcaggcgaggtggtgagctcgggagcctcaccttgctgcacttgatgcacttgtaggagccgccgcccagcagcaggcgggtgcacagcagctccgactccaccttgacgccagcgcccttgtctgcgtgcagcccgtggccacgctcggggtacagcaagcccgccgctgccgtgggcctctcatacagcccggctgccgcagacccgaagtcgccgtagagccctaggccagggccagcggtggcaccggcccctgcgctgcagctccctggcgccccggcccccgcgccgccggcagcccgcttcgggccgtacagcgcggccgggtggccaggctccggggcgggttcgcagaagaggcccaggccagcgccacgctccagggccccacacggtcggtagctctgcaccaggtgccgcaggtcagaacccgccaggccgctccatgagtacggtttgaaaggcagggggaagggctgggcttcgtccagcgatgggcacattgacttctccgaggctgtggaggcacaaggggagcgtccggtcaggcttcagacggcagagcggaggccgccgggctgcggctgcgagcgtggcgtgttcgcggactgcggggcacccagcgcttgtagaacactgcgtgcgccaggtgccaggctcgccccagggtaaaacgtggcccgggccctggggcctcgcaggccactataggaggcagaacagtaaacagatcattgaaaagacctcgggagaggaggtcgtaaattctgtgcgagtgcagcggaggcgctcggcgttccgaggatcttttctggctggacccgcgcacctggagatcctacagggaagggcgcatctataaatgcccgtagttgagctgttaagaaggagaaggtggcggccgttcggcccctcacagcactcaagggcggaagggtccagccaccagcgcaggcactctcccagcccctacatgttcccattcaattctttttcttcccagaatccaagaggaaggagggagaaggtccataaatgcggccccgaactacccgaaaggctgctgtctgaataaacccgaaggtattaagatttcacgaagttaagtgcccagtgtacgtagcaaaggagcagcaggaaaggggcttttgggcttaaattgacagccaaatactccccattcctgttacagtttgatggaggcggggaacctgaatttctcagagaataactataactcataaggtttagccaccacctgcaaggagacagctctgaattctcggcctgctacgcccccacccacgtgaattttgctaaaactagtgaccccaacgcatgtgagtgcatacggcatttacaaatgtgtgtgtgtgtgtgtgcgcacaacactccagttcaggctggccacttcagtgagaggctgtacccggagtttcgttcggaggggttcggggcgcgcccaatccttgtctggccacttgacgccctggcaggaagaatcctcccgccgccggctcccagacacacttgctggagctatggttttcgccaagtcaactcactgattgtgggacgggtggtggtatcttctaaaactagcaaacatattctggatataaccggcccttgacagaatccggctggtctgctcattccttcccccggccgggactcgagacgcccccacccaacgtgtggtcacttagtttgcctgaagctggattgctcgctggaaatgaaacccagagagcaggcccctgaggctaggttaacccggcaaaacgaaaaatgaaacaggcccccaatctgcgcctgtgaagaccaagccgcgggctgagattttcgtcctgccccctccctgccgcccagcgcctagctcctctgcctggcccgttctgccctgttctctgtttgaggtttgggggtctagattgcaggatcctagcactttataaaacagtcaggtctggtcagaaaatgaaaggtcagcgttgccgccagtcgaaacgactggtttgttttccgtcactggccagctccgcgcaaacgaatctaagcgacaagcagctagggtcctgccgcctgggatggaggcagcagccccagcgggcaagctgtccaagtcccagagaagccggatgcctccttcccctacgaatcagctcccttctcccggaaagactctccaactccccgttagcatttctacgcccaaggtcgcgccaattcccccccagcactgccgggtccctgcagctcccgcccaagaggttcccagtgggttcctacctggagacgcggagggtgacgggggcctccagaagtcctcaaactccgagctccgttcgcagacgctgccttcgcagctgtctggggatgcggaggctctgtctggggcttcggtcagctgcgattcgggggacaaacggtcccggggctccgccttcgccccgcctgcatttgaagtgctgtctgcaaagaggaggcaggtgaggggctcaggctgggaccggttgagtctgagggtgctgaaggctcccccaatcccccgaccagggcagccgagcgtcttcccctctccacccagaccccggccgggaaccctctcggatccgagggcaggcgcagagaggccatggcacctaggagacaaacccggaggaaccaggacagtaggaaacaaaaacagcagcaaaagggacgttggggcagcccctcccagctccggactaatggtgtgccgaggtgcagtaggcatccgggggagcagccccgcctggcccgcgcgcgcctcgcacctgctcggctaggcgccggtacattctctaaacggagggaatagtctggtcctggggagcgcggctggtggtagctgtgagccttcttgcttttgacgagaaatgagcgcggcatggtggtccggcactttccccactgcgccccaagagtccctggagccgctgtcacccacggtcactccgagggcttgctcagccccagcccggaggagacctgagagggaaagaaaaccaggtggagacgtgggtcagtactctccggtgcggcggactgggcacccaggcggagggagagcgcgggccagggaggcgcgcagagggcccacgggaggaggggcttgaccctgctgcgccgcgcttaccaggtggcacttggacaggtggcgcgaacccgccgtcgttgccgccgccgccactgacacagctc

SEQ ID NO: 1731 - DNA, 11311 bp, Homo sapiens
taatactcttaatactttattaacttaaaacatcactctaataaatatgtattaacaaacataatgcttaccagaagatctaaaaacatttaccaacctcatcaaagtgaaaataccacctttcccccctctatggtacacatggagggtcaaagagttgaagacagagccttccttcccacatgcctgctagctcagaaatctttaaaatatcagcttaacaataaaaaactgaatatacacacatatctttgaagtaactgttcagctttttgtttacacctgataaaatccaaaagggtcaaaagggaaggtttacaattctgtgctgtcttctcagaattccctccaagagtaagaacagacccagccacttggaggtgcaaccgttagcttttgaggagcagtcaggggttgtgacttcagtctctcttccccaatacctagcatggtgcctggtaccttggtagccggtgatccatgaacatttgctgagtgaatgaatgacatcttgtccacaggcattgcttgtgcttttacctccagtgatgaggttttcacagccctactgaagggaggacctctaatcccctctcattaccaacttctcttctgcttcttcttgggggtagcctcgatggtgcatctcatgacttcaaagtattaaattccttccccaagtcagtttctgaatcagtttttgaggaggagaaatgattcctccaagatttataggcagcacccaaaagaaaggagtcaacagaccccccagaaggaaaaaaataaaagttaacactcactcttctttctagataaaaatattagcatttgtccaccttgtaaatggtgattcctcctcttccacacaaatatctggggtaggtcaagaggggggagggaagaaacctgaagggcattcctgtctgtagattagggctggaaatgggaaggactgtggggtctaagatttattctggtccccatttgactttgcctttgtcttcaggtgtagaggagcctatttgtgtccgaagcctagagagtcacttggttctcactctcggctgcactttgaaaaggtacctcatttcttctggcagctccaggaggtaaggcgaaggaggagcaacctggtaggatctgcagactggacctggggtctggaaagtcagaagggagtggaggcaagcagggagcagagtggtggcaagcagggaggctgccctctgtagtgttgtgtagctgctgcttgcagccagccagggtgctcatttgagcccatgctgcgtctcccggtgccttcggaggtccaccttcctctggaaacccttcccacagaggtcgcagccgaagggcttgaagcctgtgtgtttgcggctgtgggtgatgaggttggagctctggctgaatgccttgccgcacacctggcacttgtgaggcttctcacctgtggggatgggagggggaggggagaaagtatgagtctatgataaagctagaggggacccactgtgacccacatgctcttggcagcagctggttgcaccacagtctaaggccttcaagcaacttggagggtgacgtgttgcaacctgaactgactcccagcctgcaatgcgagtccctggaagcaccatgggggcaccaggtgaaagggagactttctgaaggggggttcccagccaaaggcctcaaacggtttcctgctaaacggaaacagagcaaaggccacgtgccctccccagctgaatctaccccgggaggactcccctgactttataagccatgaacactcagagcagatgttcaacaggaaggggagggggaagctgtcctaaaaccgtgtgactccgttctaattcagaggaagttttcaaatctgaatttccaagtgggtgttagtttgtatggatcagtgagcccgtcttctttcttgttcttgaaggacagcagattatatctgaaaaaacatcttaacatggactttctttctttctttatttctctctctctctctctttctttctaagttccggggtacatgtgcaggatacgtttttcaatatcttattttaaaaatccacatttgggccacaaaggattaaggcagctgatactttactgtcttgatttttccttaattttatggggttaatcacatgattctttatataccagcaattcttcaccacaaattaataaataagagaacacaagaaggttttgtcttgttccccatctcatgtgttgttgggtaaatggcatgaatttccaatagcccagcatggcattatagtcagggctcagccttggaaaaagtataaaatagatgaagtttgtttttgaggaaccctctgtcctccttgctaaaaactcttttctgttttcatgcttcagatttccttgataagaaaccacccatcaaaatgtattctatccctttagggtcaaacaaatctgagaaaacaaattctaggtataacgtaaatgtttgataagggcttaatgttttattcagtcaagatcctagttgcattttgataagtgtcctgaataccttacttataaggagtgaattacatggaaatttcaggtaagagggaatgattaaagtagaatacttttctgggttttcaatggaaatatatacattacccaagtatatttataaacatcaagggtgggtgtttagaatacactgtgatttgttctaaatcagtattcatattctgcaataaaattttcagaaattctgggtctcatgtaaatgtcttttgactattagagtgttcttggcattaaaactcccacccgcacataaagtgttagacaaacagtccaggattaaaagccagagcattacatggctacattattcattcagtcttacttctgataaatcattcactctttctgagtttcaggatggtaagagcagctccttctactttcttgagtggcaataagaatcaaatgaaatgatagatttgaaagtactttgtaaattataaagcattataataggtaaggaattatcattattatggcattaacttgcagatattttgaaaagggcaataagtgaacagaagctttctgtctaccaacctcatgactctgaacataaaatacaataaacagtggtcaagagtgaacatttgagaggtcagacctgaatttgagctctggccctgtcatttgctagcagtgtgaccctgggcagattacctagcctcatttttttcatctctaaaatggggagaaggagtagtcgctacctctcagagttgttgtgagcataaaatgaaataatgcatttaaaaaatgcttagcagagagtttaatcatatttgccattatttgttcctcttcaatcagaataagctctcagactcctgaaaatgcagccggagagtccacacgagtccctcccacaaaaggccaggtggttagggaaagtcctcaatctctaggtaagctttagagcaactctctaagaggaccctggagcttcatatttcacccagagcaggcagcaggggaagcagctgctaacctaaaggaaaatgttctttccaagtatagagtacctgtgagctgacctgctgagtggcctttcagacacaaccccaaatcaaggtggctctggggagaattatgccggtaaatgaaccaaagaacccacccctttgttttctttaacacagagcagagaataactccatcagaaaggcctcatccaccactcactggggccagaaatcagagaagatgagtaatgttggcctcagggtgtttcctacaagccaagggcctttttagctcaccagtgtggatgaaagtgtgtttcttcatgtctgacttctggtggaacctcttgccacagtactgacaggggtagggccgagtgtctgagtggataagcaggtgtgtggacagtgtggatgacctcttgaagctcttcccacagatcttacagtcaaagctccgttcctgcagagagagagagagagagagagagagagagagagagatgcagaactcctactgcagtcaactagactgctgctctcctcacccctcagctgaccctaaaatcccttgaacactttttctttctttttttgagacagtctcctctgtcgcccaggcttgagtgcagtggaacgatctcagttcactgcaccctccacctcccaggttcaagcaattctcgtgtctcagcctcccaagtagcagggactacaggcacacgccatcacacctgactaatttttgtatttttagtagagatggggtttcaccatgttggtcaggctggtctcaaacacctggcctcaagtgattcgcccacctcggcctctcaaagtattgggattacaggcgtgagccaccgtgcctggcccttcaacactttttctaccaaaacattcttcacccacaaccttccacaccccatggcaaatacatatccacaccctgctttttttgacacccattagcacacacttctccaccctcctcaacaggaggcttagacctcagtcacttgagatgccacctccccccagccagtgtgggtgctgggggagatgggctaatactctttttagccttcgtaagtaggcattctcctgagatagctattggcatatttacttgctcatctactctccatctctcagctaaactataatcttcatgtgggcatgctgtcaaggacctgatgtgttataagattcttaagtacttggcacctggaagttagccaacaaatatttattaatgaatgaatgaataaatagcggcggtggggcatggtggctcacgcctgtaatcccagcactttgggaggcccaggctggtggatcacttgaggccaggagttcgtgaccagcctggctaacgtggcgaaatcccgtctctactaagaacacaaaaattagctgtgctgtagtggcatgcgcctgtaatcccagctacttaggaggctgaggcacgagaatcactttaacctgacagggggaggttgcagtgagctgagattgtgcaactgccctccagcctgggcaacagagccagactctgaaagaaaagaaaagaaaaaagaaaagaaaagaaaggaaggaaggaaagaatgaatagcggggtgaatatgctactagatgctctaaatgagctgagattcctgccttttcagtcgagaggggtcaatgcaaattaagtgacaaccatttggtgaaaagaataggcacaaagaaacagagctagtaagtctgatatatcagcagcacgaatcagtgcatacaaacctacctcaagcccaaagtaacaatgaggatcacactctcgaggctcacagtggtgtgacaccaaaatccagggctgcctcaaggcctgagccggccacaatcctcctttccctacacacctgcaccagggcaaggggacgcagcggagggcttgggggaggaaactgggggaagtcgaggagaaaacttccaggcagagagtggctggtgctgcaccgaggagatgcagaagatccccgagcagggccgcgcgcggcggtgcgccccgcgcttacctgcgagtgcacggctttgtgctgctccaggctcaccgcgtgcccgaaggtcttgccgcacatctcgcaggcaaagggtctggtaccgctgtgggacctgcgcacgtgcacctcgagcccgtgcggcgtggagaacacctaaggcgggtggggccagagagaaggccgctgagaggggccgcggggcgcaggcgaggcgcgggtaggggaagcgggcgcacggcaggcgaggtggtgagctcgggagcctcaccttgctgcacttgatgcacttgtaggagccgccgcccagcagcaggcgggtgcacagcagctccgactccaccttgacgccagcgcccttgtctgcgtgcagcccgtggccacgctcggggtacagcaagcccgccgctgccgtgggcctctcatacagcccggctgccgcagacccgaagtcgccgtagagccctaggccagggccagcggtggcaccggcccctgcgctgcagctccctggcgccccggcccccgcgccgccggcagcccgcttcgggccgtacagcgcggccgggtggccaggctccggggcgggttcgcagaagaggcccaggccagcgccacgctccagggccccacacggtcggtagctctgcaccaggtgccgcaggtcagaacccgccaggccgctccatgagtacggtttgaaaggcagggggaagggctgggcttcgtccagcgatgggcacattgacttctccgaggctgtggaggcacaaggggagcgtccggtcaggcttcagacggcagagcggaggccgccgggctgcggctgcgagcgtggcgtgttcgcggactgcggggcacccagcgcttgtagaacactgcgtgcgccaggtgccaggctcgccccagggtaaaacgtggcccgggccctggggcctcgcaggccactataggaggcagaacagtaaacagatcattgaaaagacctcgggagaggaggtcgtaaattctgtgcgagtgcagcggaggcgctcggcgttccgaggatcttttctggctggacccgcgcacctggagatcctacagggaagggcgcatctataaatgcccgtagttgagctgttaagaaggagaaggtggcggccgttcggcccctcacagcactcaagggcggaagggtccagccaccagcgcaggcactctcccagcccctacatgttcccattcaattctttttcttcccagaatccaagaggaaggagggagaaggtccataaatgcggccccgaactacccgaaaggctgctgtctgaataaacccgaaggtattaagatttcacgaagttaagtgcccagtgtacgtagcaaaggagcagcaggaaaggggcttttgggcttaaattgacagccaaatactccccattcctgttacagtttgatggaggcggggaacctgaatttctcagagaataactataactcataaggtttagccaccacctgcaaggagacagctctgaattctcggcctgctacgcccccacccacgtgaattttgctaaaactagtgaccccaacgcatgtgagtgcatacggcatttacaaatgtgtgtgtgtgtgtgtgcgcacaacactccagttcaggctggccacttcagtgagaggctgtacccggagtttcgttcggaggggttcggggcgcgcccaatccttgtctggccacttgacgccctggcaggaagaatcctcccgccgccggctcccagacacacttgctggagctatggttttcgccaagtcaactcactgattgtgggacgggtggtggtatcttctaaaactagcaaacatattctggatataaccggcccttgacagaatccggctggtctgctcattccttcccccggccgggactcgagacgcccccacccaacgtgtggtcacttagtttgcctgaagctggattgctcgctggaaatgaaacccagagagcaggcccctgaggctaggttaacccggcaaaacgaaaaatgaaacaggcccccaatctgcgcctgtgaagaccaagccgcgggctgagattttcgtcctgccccctccctgccgcccagcgcctagctcctctgcctggcccgttctgccctgttctctgtttgaggtttgggggtctagattgcaggatcctagcactttataaaacagtcaggtctggtcagaaaatgaaaggtcagcgttgccgccagtcgaaacgactggtttgttttccgtcactggccagctccgcgcaaacgaatctaagcgacaagcagctagggtcctgccgcctgggatggaggcagcagccccagcgggcaagctgtccaagtcccagagaagccggatgcctccttcccctacgaatcagctcccttctcccggaaagactctccaactccccgttagcatttctacgcccaaggtcgcgccaattcccccccagcactgccgggtccctgcagctcccgcccaagaggttcccagtgggttcctacctggagacgcggagggtgacgggggcctccagaagtcctcaaactccgagctccgttcgcagacgctgccttcgcagctgtctggggatgcggaggctctgtctggggcttcggtcagctgcgattcgggggacaaacggtcccggggctccgccttcgccccgcctgcatttgaagtgctgtctgcaaagaggaggcaggtgaggggctcaggctgggaccggttgagtctgagggtgctgaaggctcccccaatcccccgaccagggcagccgagcgtcttcccctctccacccagaccccggccgggaaccctctcggatccgagggcaggcgcagagaggccatggcacctaggagacaaacccggaggaaccaggacagtaggaaacaaaaacagcagcaaaagggacgttggggcagcccctcccagctccggactaatggtgtgccgaggtgcagtaggcatccgggggagcagccccgcctggcccgcgcgcgcctcgcacctgctcggctaggcgccggtacattctctaaacggagggaatagtctggtcctggggagcgcggctggtggtagctgtgagccttcttgcttttgacgagaaatgagcgcggcatggtggtccggcactttccccactgcgccccaagagtccctggagccgctgtcacccacggtcactccgagggcttgctcagccccagcccggaggagacctgagagggaaagaaaaccaggtggagacgtgggtcagtactctccggtgcggcggactgggcacccaggcggagggagagcgcgggccagggaggcgcgcagagggcccacgggaggaggggcttgaccctgctgcgccgcgcttaccaggtggcacttggacaggtggcgcgaacccgccgtcgttgccgccgccgccactgacacagctcagcggtaaaacctgtcccggggccctgtctcaggcccctttcctcctccctgcccacgccccccagctcctcccctttcctagcgaagctcgctccggcaatcaaactccctggagagctgtagttcccatcgggtgggttaccccaactcagctactcatcgcctgcctggctgtgctttacggctggcgagggagggcggggacacgcggatcggtttaggggccggggatgcccagtggtcgaggacccggaaggggcaaggagccaagacctccaagagccagctaccaactggagtgaaaggaccggggggaggggggaacagaacacaagataaaactgtggggcggcgggaggacagcagcagagggattggggacagcagaggccagagaaaggaggtgggagagcaaagggacaggaaagtgaggggaacaacagacgaccaacccccgccccaggagaaactcgcatctgggtgatcccactcgcccctcactagtgccccacgtaggagaaactttgcccttggactcccggctgcggcgggcaccggtcgaggctgcggcgagccatcccagaccatggagacctaacctcgggaatcaggtcccgggaaaaaagcactttccgttctgctcaccaaaaaatcttgtcctagggaggtggagcccgatccacgaacgttgactgggaaatgctaggtgtcccgagtcggtagtgcaccgacaatttagcagacaaaaaagacaggacgccagagcgcgcaggctgcattagcagagagcgggggtcgggcccgggcccgggagggaactagctgcccggggcgtcgctctcattaacccccaatcagttcacctaataccaggtcgaaatctgagcgcagcgggagggcgtggctgcgcctgccgctaggctccagccggctccgggggcggtaccccacagtcgaggtggtctggagtaaacgaatctgccttcctcccggggtgaaggcgatggtgaccgggttcacacgtgagctgcagtacagcagttctccgtggcctcggctggttcagaaacgagggtgctgggaactctgggccggggcaggacctgcagtcctccggcttcgcgctgtttccactgccggactaggagcccctcggcttcctaggcaagatgcaggccacacagtctacgtctgtccgttggcgctctcagctcaaacgagtcctacaggccttggtccctgtagggtgcaggccccctgctccagatccccagccccattgtgtccccttctccggaggaatgggaatagacctgggagaaaagacgcctgggacgtgtcgcggggctcccgcgaagtttcccgctacccaagcgccagaatgcccctaggggtgagagtgccatccgcctccctccggggtggctcctagggctagagctttgtcgcttcctgcacttctcgtccgtacaattagacgccacaaaccccaaacccaattctttaaacagccacgaaactcggaagaaaagaaaaacggagtggcgttgtcccgagggtcccgctgcagcttggacccacgttggctgggagcgggacagatgggggcggggtaactgtcagcgccggagctgggtctgggctggcgccaccagagaccaggcggacgcggaggccgcctccccacccgggctgtaagcccacgcctctctcgcaccccggcccgctttgctggttcctgtggggagcgacagagtttggaggagataggggccccggggcctgggccgagcgcgtgggaaggcaaccccgcgctgcagctggcgcgggaggtggggcggcccctccgcgcgctcaggcctctcctcaccgtccgggcccaggaaggagggagccgagggcgctaagggggcgtcctcccgagcgcagctgccgccgcctccccaccagatgtttccttccctggtggatttggctcccctgccgaaccaccagaccgcctgctgcgcgcccccagctccagatttccagtcacactgcgcgggtcgcgccctaacccagctgccggagctctctgggctcccgcacggcggtccgcagcaggtgggaaaccgcccgcgccctctgatcgcccccgcagtgccagtgctctgcgagtccccgcggccgcccccaccagggcaggaggcgcagaacaggctcggcggacctacctgcggagtcacggcgcgggcaccgcgctaggagagttttcaaacggaatcttgcttt

SEQ ID NO: 1732 - DNA, 86569 bp, Homo sapiens
tcttcattctgaaaataattttattattttacagttgttcaggaaacttcccaggatgttgtaaccaagatttaatcaccacagtagatttagagcagatcagtcagcccacttgtcttctctcttctttagggagaggctaggcagtgaacacatcacgtatgcaatgagaaaataaccaactggtaggatgggggaggggaggggaggcagggaataggcacaaatggaattctatcctggctgtccttctcaggtctatctatatttaattttgtcttctctatattctccttccattgccacagagggcagagacaatggggctgagaaactgtaataactgtcactaacagcaaagtagcttagtacttcaagaggtcaggagttgcagtgtggtgttagaccagtcagactcctggctgagagtcaatgcctaatattggctcccagtggcccctgagcactgtctcagggtccacattccaggaatattcagatattcctggaatgacaagaattggaaccctgctgtccatagacacttctccctgccctttggtgaaaggaaagacttgggccacttaataccttagtatacatgtgatcaagggcaaaagcaaagggattctatccttatagtctaagacctgaaattctccctccaattatatctgaaattggcagggaagaagatgctgtcctcccatgtgatctaacagctaaaacccctagggagttccttcagctttcaccaccctattctgcaagagacctaaatcagatgtcctatgaggtgacatgttcatttccctgaactctgtttatggcagagccaccttccccctgaaacaggagaaaatacaggcaaacaaggcaaagaaagttatcaatcaaaatgatactgaacttcagattattaggtttattgaaaccatcctcttggcttggctgaaagacattcctcagtatcttttacaggaccacaaaagatcagggtcctgcaaaatctcaacaaatattaggctcaacaaaccaaatgtgattctcagattaagcagaagcgttcaggctcagggcagtagaagaaagcagactcgccagtccctgcagctccaacctgtcctcgtatccacctctgtttttgcaggcactttccgtgaagagttggagagaagacctgtaaatgggaagactgttccactggaattgatgttctgatgttagaggtgagagaattccaagttttgaggggagtggtccaaagagtaacaactaagtctatagatggcccgtaaaacacagaatgagcaggacatgaatcattagaaagtagatggctgctagaagtggcactcgggtccgtgaatgacagagtgaacgcaggactcgcttccatccaacgccactccgggtctgaaagaaaaatgtgaaagtcagagagttttcaccctatagggctatgttgctttccctcctactagtcttgcacttaagcaaagctgacccaaccactgtagaaaggggtattctgagaggaaagttgcctcagagtcaacaacttggcaaattccaccaggttctaatcttccacgcccttccagccttagactcattcgctgctcagtggctggacttccacattccttctcctcagctccttgcccccagtatagccagccctgtcagataataaaacaccctctctttatccttcttcctcttacccttcgacaactgttgcttgtaagatctattaacagtgcctgctcctgagtgccacaggagccaatgataggagtccgggaagagtcccattcactgtgctctaacctgagttgagaaaaaaaagaggcatagcattggttcatagcatgagaggctgatcaggcccagtcttcccagtcatcctgccacacaatgcagcacaggaggagacttgcagcaaaagctgctcccataaacccaaacccatgcaaggggggtaccagcagatacgtttccttcagcagcagcaaaatgtgacaataactatcaggaattgactgcctactcactatgtatcaggctctaggctgggtgctttacatacatttaatcctcaggttctgaggttggtcttattatcttcaaagtgctaaggcttacagaggttaaattacttgcccatggcggcacagccagtaagcggcagagccagaattcaatacccaactttgtctttcaagcctcacgttcttttttccaccacaccacacctgacttggagaaactcattacatttttttcttttattaaaggctaataggcaaaagcatccaaagaagatttctgtggggttttaaaaattaaattgaactaaaaaaaattaaattgaattggcagtctccactgccttctggctcagtttttgctgatttgcttatttaatactggaacttctccatttaatgaagaagctgccattactcactcaatggttatgtcaaacaaacaaaggagctgcatgtaacacagcacgtttgatcaagcatttgcctatagggatgaactttttcaatagggaagagaggatgaaactcttgcctctactctttgtgttttctccttctgaaaggatatctattagtttaatattcttgggctctctgcaggacacattcttttccccgggagagaagaaacaccttaatccaatttgtgagtctagaaagagaactgagcatgcacagcctagctccttctttcctgcttccctcctgagagccaggctgactaaaaaatacaccttctgtgtctattcctccatgtgataagcttttcagaagcagctttgatctggaacagcatggtctgttactatggaggtcagtctgtcaatgtaggctatgctgaggaaggatgagaagtctgtaggtattgatgaggaagatggtactggctgcctttaaactggagggccactgagttccacctgctctttagagtacatgtgagattctaacattacaatggcagtacctggactaggcaggcagcccttaattagctaccccaacttccattctgcatcagagctaaagagggaattgtggcttgaattaatacggcttgcccacaggctcaagagtcatcatcccacacatgcagtctcagttggtttgggacaggttagttacacaagagggagatcaacctccccattggccaggtttcaccggtctaaacaattcaatagcaagtagaagagaaacagtcatgagggcacaggcctgaaaatgctcggcagagatggcaagacaccacacaaggcattaagcaaagctggcccaccctcaaagctgcatatcaaggcctgaataggtgatgaaaattaagaagttgtgaatatgttggattggaaagaaaggtatctcaagtaagacctgctcaatggggctgtcacctctgccacataaactttacaagaaagcattaatatcagaaatgtcattctctgaggaaagtgatcatatacataggtggctttctcccaaaatataataaaagtgcctgcttttaacgatattttccgtggaaagggacttccagcagcaaaatacttgtagcaactctctatcctctcatgcatagtgattcttttgatgagaataaggaactagggatgtgtagctctgcccttccaaattacacttggagcaaactgctcataggaagcacagttcactctgttattccaatactcttgtttggcaagagcaggattttctgtgaaggaggtctaccttggcccaacattgtctgtgactgggaggggaagttcagggttaggaagtgcatttgccaacaaataaaaagctacattcttttaacatcatttataaagcagtcttttaatctctcaatcttttaatcttttaaaaaagatttccatggattcagatctcaggtagaaaatgaggttgtcacttatttggtcctctagagaacccaacacctacctcatatagttatggttagggtgaaataaaatatctttcagtaatggtagatatcattattattctctaagaacaactgttttagaaaacactgactctcttatactccaaaagtacagtgttctcttgggtgaccacaatgttggtaaactcattgcagcaactacctcaagatgagaaaaagatcttaagaaatcctaagtctggcaggaaatgtacatgagtttgatcagaaaggatcggaagggaacagaggctatctccttcagcctttaccgtctgatctgctcctcggccacagagagagcattctcagcagccactctttggtctcgttcttcttccagcagcttccttaattcattcacttcctgtctggtgttgcatagctgctgctgagcttcagaaaagctttaggatgagaggaaaacaaaaagcatcatcagatgcagaaaacagttgctaatacaagggattcaaagtcttcataaggttgtaaagcaagaaaatccatagaagcttgtctaaacacaatattttaaaagcaaagctgtagagggattaaatgaagctgcagaaaatacctaaagaaatttcaggaactgattatctttcattttactatcatagagtagttgttagtggtgtgtgtgtgttggtgttgctctttttgttttacaaacttttcacacacaaatgttagttattattgttactatttgatcctcacatcacttctgtgaggctaataagataacaagacatattaaatccatataaaggactccagttaaatctagattactgcccaatttctggactctggtgtatgctccagggtttagagagccactcccctacctttgctgcggttcccttagttcctcagggtcactctttctgtgaactccattcttttcctggggagctcctggagcaacatctatatttagtggcccctggaagaagaataagcttagtaattcagtgatgaaagctcttaagaaagtgtatttgagcaaaatgagagctcgtttacagaggactatccccgcttataattctcaagtccaaatttagaagtgagaagcttctgctctagcagattactcacctacataaaactcttgtcttgattagatttttctcccagattctcattcttgaatttctcctcttaaaagttaagtctgggccgggcgccgtggctcaagcctgtaatcccagcactttgggaggccgaggtgggtggatcacaagatcaggagttcaagaccagcctggccaagatggtgaaaccctgtctccactaaaaatacaaaaaattagccgggtgtggtggcaggcgcctgtaatcccagcaactcgggaggctgaggcagagaattgcttgaacccaggaggtggaggttgcagtgagccgagatcgtgctactgcattccagcctgggcgacagagcgagactccgtctcaaaaaaaaaaaaaaaaaaaaaaaagttaagtctgctgtggatgcttatggcttttccagaagccactttgatccttcccttgcttgtccagcccctcccaacccccttttcctcctccgtatcctatacgtctccatactaattctcagtctcctccaacttcaatgctgtactcctctccctggctgtcaacagtgctgcctgttttgttctcagatccaaagtttcctacaattttcttataacttaaagcaaaatcaacactttctctgtttcagagtaccaaatgtctcagtcatcactgtttcctactcatgttttgatttctctcccaccatctcactgatcttttttcttctaattgcttcactgtaatttttctcagaccttattcccatctcaattaactctttcttctctcccactttcttccctgacccctaattacattaacttcttccatactgctctgtagtgcttcaccacttgcactaaatttcatcacacttctcccagtctctcaccttctctttactcaccgcctgcagctcttgaacctgcttctccaagactgcacagtgatttaaaaggtcaccatagtgctgctggttctcacgaagactctgactggtatcgcagagctgaatggaaagggtgtttttctcttccagtagctgagagaactgaaacagaggcgaggataagcatcatcctgcagtactgtaagcagtgctgaggtgaaatgttctgagttttcaggatctaattttcctatggaagacctttgtttcagcaacagcaacaatagcactttgtgtgccttcaaagttggaaaaagcataatttttttttgaccaagacagaaaacaattctggaggagtagcagaaaggtttttttgttttgttctgttttgtttttttaaatggtgcccagtacattaactgaaaaaccatgaagcagaagtccataagcaatctaattacataggctattctgggtacataagagggagaaggcagtacctcagggtcaaagttcatggtactaacaaatgactataatctccagaactcaatatggctggagagagctgtcaccccaaaatctgtgcaataatattcctaggcagattcctcaatgccataaagagttataagttactgagagaatagaataaaaaattataatatgtggtagaagggagaaacagaataaatcccaacatgtatatgtatatgtcagaaactgttgagagcatagattctcccaggtagaaacatttcagtcccttaaagcaggactctcctctactgcatgactaacaggtcatcgttcagtcttcccttgaacatgttcagtgtcagggcgcccactgcctgacaaagcaacccaaaccatttaaaaaactgaaaattcatttttatattgaatgaaaaatttacctattgtagcttctacccattgatttgaatttggtactctggaactataattctctcacttgcaggctgtcaagttttaagttttagctgtgattagcctccaggtacattaataaccatggagatgtctctccaagttatctactctaggaccatgtacattatatgagaggaacccagtataccagttgcatgttcaattttttcttgatgattcttttttgtaagtttttgtgaaaaaaagttgaaacaaacaatgttttagaggagagacgacagttttctagagacaactgtgaggaagggcatttgatgcaaatagaaaattagaacaagataatccatacatacttgtaaaagtgctctgttagctgaaaattgctcttcagatgtagggttgttttttgtgtttgtcattctgaagagcaatgttagcttacaaagtactttcaccagtatcatcttatttgagagaggtagagaaaggatttctgtccttgtttacaaatggctagtagatgtcaaaccaggactcaagtgtggttcttgattccaagtctagagctctatctactatctgatggtgtccagtctgatagtctagcaaggaaagctaagaaaatcatagggttttcttttgggggggggggtgtgggaggaggtgggaatagttaggaaaggatataaatatttgggaagtgatactaatttgaagacagttaactgggtacaatgacaactattggattctgagacagggcacaacatgttcttcccttaacctaagaggaagttaattttcctggccacaatgaacagtccaaaccataccaaaaacaaaaacatagatccttctagtttaggggttggcaaactatgatccagggcctgctgcccttttatcataaataaggttttactggaacacaaccagcccaattgattctatattgtctatggctgcgtttgtgttacaactgcaaagatgagtagttgttaacaaagaccatacagtcaacaaacctaaaatattgtctgagcctgaaggaaaagtttgctgacctctcctctagcttataagctactatatttcactgtatctatacctgtaaaaacaaaataggagggaacaatttagactacattatgtcactaatcatccatctcatgtttttaagtttctagcacattcttacattacatactaacatccaaacagctggtagaaatgcagtcatcccttgttatctatggggtattggtttcagaaccacccctggacccccaactcccagtataccaaaattcgaggacgctcaaattccttatatataatggcagggtatttgcatataacttatacacaacctcccagatacttaaaaaattttttaattcatgtataatagatatacatagtttcaggatacatgctataatgtaatatattcatataatttgtaaagatcaaatcagtgtatctggaatatccatcaccttaagtatttgtctttcctttacgctagaagcatttaaattcttctcttctagctattttgaaatatacaatagattgtggtaaactataatcacctattgatttacctaacactaggtcttatttcttctatcaaaccatgtatttgcacccattaatcaacttctcttcattccctcctctcctttatccttcccagcctttagtaactaccaatgcactctctatcttcatgagattcacttttttttttttgctcccacacgagtgagaatgtgatatttgtctttctgttcttggcttatttcacttaacataatgtcctccagttccatctatgttgccacaaatgacagaatttcatacctctaaaagctgaataatattcccttgtgtacatataccacattcttaatctattcatctgttgacgggtacttacattgattctatgttttgttttttatgaacagtgctccaataaacatgggagtacagatgtctttttgatatattgattttctttcttgtagatacgtgggttgctggatcatatggtagttctatttttagctttttgagatacctccatactgttctccacagtggctgtactaacttacattgctaacagtgtatgggagttccccctttctctgcatccttgccagaatctgttactacctgtctttttgataaaagctatttcagcaaaggtgagatgacatctcactatagctttgatttacaattctctgatgtttagggatgctgagtatttttttttatatctgttggccatttgtatgtcttcttttgagaaacgtctattcagatcttttgcccacttttaagttgagttatttgttttcctgctatttaattgtttgagtcccttatatattctggttattaatcccttgttagatgggtagtttgcaaatgttttctctcattctgtggattgtctcttcactctgttgattgcttcctttgctgaacagaagccttttacttgctgtaatcccatttgtctatttttgccttggttgcctgtactcttcaggacttacacaaaaaaagccttggctagatccatgtcctgaagcatttccacaagttttgctctagtagtttcatagtttcagatcttagaattaagtctttaatccattttgatttgatttttgtatgatgagagataggagtctagttttatttttctgcatatagatatccagttttcccagcaccatttattagagagattgtcctttctccatcatatgttcttggtgcctttgtcaaagacaagttgcccctaaatgcctggctttatacctgggtttctaattgtttcattggtggtctgtgtgtctgtttttatgccagtatcatgctcattaaacaggtagtgtgatgcttccagctttgttttgtgtgtttttttgttttttggttttttttttttttgagacggagtctcgctctgtcacccaggctggagtgcagtggcgcgatctcggctcactgtaacttccacctcccgggttcaagcaattctctgcctcagtctcccaagtagctgggattacaggcccccgccatcacgcccagctaatttttgtatttttagtagagacggggtttcaccatgttggccaggatggtctcgaactcctgacctcaggtgatccactcatcttggcttcccaaagtgctgggattacaggcataagccaccacactcgacccagttttcctctttttaatcaagattgctttggctagttaggagtttttgtggttacatacatattaaattttttttcccatttttgtgaagaatgtcattggtattttgatagggattgcatttaatctgtagattgctttgtgtagtactgtcattttaatgatattaattcttctaatccatgagcacgaaatatctttcctttttttagtgtcctcttcaatttctttcacagtgttttataaatctttcatttctttggttaaattgattcctaagtattttaaattctttgtagctattataaatgggattgctatctatctatctatctatctatctatctatctatctatctatctatttttgaaacacagtctcgctctgtcacctaggctggagtgcaggggtgcgatctcagctcactgcaacctccgcctcccaagttcaagtgattcacatgcctcagccacccgagtagctgggattacaggcgtgcaccaccatggctggctaatttttgtatttttagtagagaagggatttcgccatgttggcaagactggtctcaaactcctggcctcaagtgatccactcaccttggcctcccaaagtgcaaggattacaggcatgagccaccatggctgactgggattgctttcttgatttcttttccagattgtttgctgttggcatatataaatgctactgatttttgcctgttgattttgtctcctgcaactttactgaattcatttatcagttctaacagttttttggtggattctttaggtttttctaagtataaggtcatatcatctgcaaaaaaggctaatttgacctcttcctttccaatctggatgtgcttttttttttgttttgtttttgcctaattgctctagctagggtatctaataatatattgaataacagtggtgaaagtaggcatccttgtcttatttcagatcttagaggaaaggccttcaatttttccctgttcagtacaatgttacctgtggcctcccatatactttaaataatctctagattacttataatacctaatacaatacaaatgctatataaatagttgttatactgtatttttaaaattcatgttttcctgaatattttcaatctacagttagttaaatctgtgaatgcagaaattaccaatatgaagggccaactataaatataaaacctgaacatctgaagaaagaattagggaagtggcttagagaagaacaatctatgctgacagcccatctactacaatctcattctggggcccaagaagcaattctcctatttagctgggactcattcagagtgaggctaagctcatgaaggaatatgtatatcctcagtatctagcatatagccaggctcatggaagacaaataatagttattgttttaatgactgaataaggctaggaatgaggtgcctttctttttttttttttttttttttgagacggagtctcgctctgtcgcccaggccggactgcggactgcagtggcgcaatctcggctcactgcaagctccgcttcccgggttcacgctattctcctgcctcagcctcccgagtagctgggactacaggcgcccgccaccgcgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcctgaggtgcctttcttacagttgagttctaaaggaaaaactgtttctcactcagaatgacagtgacctatgcagtgtttctcacactttaagtggaattacatatctcaataaaggtgttaaaaaacacaactttatgacttagaacccagtatataaatatatacaattaaaactaaagttttccaaagacagacatattctttattatatattacatacgtgtttttacctcatttcttttttttgtaaaaacaccaactgcactatttgtaatagccccaaactggagaagcccaaatgtccttcaacagaatagagattgtggtatatgcctaaaatgcaatactacacagcatgagagtggaaaaatgacactatatgcaacgacatggatgaatctcacaaaataaatgaagcaatataaaagaaaaggtatgactccatttatatgtagttctaagtgggtaggagtgaacagaagacacaagggacttctggagttctggtatgttctgattctagatctgggtgctgattatatgggtatcttcactttgtgaaaatatatcatgctgtacttatgatttgtttacttttctgtatgttttacttcaataaaacattaaaaattttttttagttgttgcccaccaaaatgatttcatcatttattaatggtcctgaatttcagtttaaaacactgtcctagacagacaaatgcccaatgtgattcagagtctaatgtttggagagcaaatgtaacaggcctgagacgggagttagttgacggaaaaaagagacaggctagagctgtaaagggtggaacttccggaaatagctgatttgctggaaggggaactccatgggagctgctctggagtccctttgaaaactcccagacaaatctaccaataaagagtctacagtttaactaattcatttgggcctgcagactttaaaaactgcaaatgtctcctctctgatacttcagtgtcaattagttgaatttaactacatttaataagtaccctctacatatgcaggcactgtgcttttccacatgcatgatcacgtttatttcagactgacttcgtcctaacacctcaggcaagttacttactactccagggcctttttcctcatctgtgaaaacagcctagtgatctttttaatttttggatcacagaccccttggtcaactgatgagttcttgtgatgaaaagcttacgcacacacacactattgtgcatacaatttttgggcattcttggctctcctcaaagctaatctctggacttctgattctgattgatctctaaatatcttgtagttctatcatagactacttagctgagttcctctcaagagggcagaactagggcaggtgccactaaagaatattttgaatagtcagtgaacaacaggaggacaattcttaagagggtggggtagggagtagcctcagcattactacaagtgatacaggtcagggggaaggcttcctaaagtagttggcttctttacttttactgtctggatttatccaatcattcccaaggactcaccaagggcaaaggacaagaaatggccctgtgtccagtgctttggaataagcacccaggttctgagaaaggtgaaacttctgtaccctaagatatgctacagctgggactctatgctgaattggcttctacttgccttcttgttccagtcatggaaaaaagaaactgaattccagtctaacaagaaacacttacgttgctgttcagttgctgaattcttaactccttttggtgaatttcctttaagctgtcattgagctgggtcctgagaagttctgtctcataaaccagattttgtgacccatctggggaagctgatgtctctggggatgcctgccaggacacaaacattgatcagattctctcctaagattgcgcatgcttaattccttccctctagaaatcctgtccgccccatagaagtcataaggtggcttatgggcacttaatagtggcagatgggcacttaatttgtaggaagctgatgctttctgggtagcgtcttaaaaaaaaaacaaaaccctgcaatcatcatcatttgtttaaaaatttatctctgagtaacaatcagcattgaaattactcacctgtctttggtattgcactttgagaggctgagtctgggaggaagaagacctcaattcccttataagattctgcagatgactgagctgctgatctttatctgagatagccataaggtactgttccttcattctcctctcatgtatttcccaggaactcttctccatcctagaaaaaacatgacacaatcacaggtaaaaatatacttgtaactgggcatggtagctcgcacctgtaacctcagcactttgcttatcttcaaagttactcaaatctggaaggtaaagaaagaaaggctaagaaaaaggtggaaagagagaaaatgtgggggaaaaaacaggaatctttttttctctatctccttttctcttccctaagggtcaattatataaggaaataaggaaaataaatatccttttagattgccattagaggaaatttaaagaagaaaggctgcaggaaataagcctttagagctttgcagctcttcttaggtttacactagtagctgaacactttaatatttctgtagttctaggtgatgtggagataagatgagaggcatcaagcgatgctctgatacggtaccaatcacctttggagggccctaaattcaagtgcatctgaaggacacagcaagcacctaaacttctgatgataaattaagattctaacagaataaagctggggtgctattccctgaagaaaaatggaggttaaaatggagcaatttatcttttctcttgagattcaatttcaaaagaagaaacaaatttatatttctagagagcaaaactcagttgttttgccattttctttttacttgctctgcaatcatcatcatttgtttaaacaaaaaatttgttcttgtattatctggggaagctgccaactccatgcaatgagcttgataaatgttcacttataatcaagtccataaagatgttaaatatgaaaatcttttagatgtaattttactccataaagtttaaatcattaaattccaaaaagcattttgctatatcaatgttgcttaaggtttgaaatctcctgtgtctgaacattaagaactctcttagagatgttatgatatttatactatattgacagttgtcattctaatggccccttgtaagctggatagaaattgagattccaactcatattttctgtattcatttgcctcttgtcctctagcattggtgaaacaaagcaggtgctgcttgatcagcagcaatgtccaacatggtaattctccttttaatatcaaatcttgaaagctttttgaattttttttttttttgaaacagggtctcactctgttgcccaggttagagtgcagtggcatgatgttggctcactgcaacctccacctcccgggttcaagcaattctcctgcctcagtctcccaagcagctgggattacaggcgcacgccaccatgcccagctaatttttgtatttttggtagagatggccaggctggtctcaaactcctgacctcacatgatctacctgccttggcctcccaaagtgctaggattacaggtgtgagccaccgcacccagccaagtatgaatttattaaggcagcatgaaccatcttaagttaaacagtaacaacctcccaaaaatgaggctgcaacaactagacctgtttttatacactaagtgtttaatcttgggattaaatttgtcagaaaaactgaattaaaaaaaaaatcagaattatagctcctatcttaatttcttctgccatgatagcattattattgttctgttccttaaaaagaaaagagctaggatttctggttctagacaaaataaaatagacacatttctccttattcttccaactaaggctgagcaaccctaatcagaaaatcagaaatacttcaaaatccaaaactttttgagcactgacatgacactcaaaggaaatgctcattagataatgcaaatattccaaaatccaaaaaaatccgcaatccaaaacacttccaatcccaagcatttcagataaggaatacttaacctgcatagataaaactcttgggccttataaataaaaacaaacataagaaaatttagaaagatggtggcaaaccagctagggatccccagacttgaggaatgacatggtggcaagttctttggtttaccatttgtattctgcatatcccaaaccggatactggagaattccatgacccggaaacaccaatgagtaccaagtttactcagtcttgccaaaggaccaggaagggacagtctagctagacagagccattaatgatactaaccaccatactccaggcaaacaacatggaaaaaacacagtatctcaccactcccattaacaaagacctggtagataagctaggtacattcttggctggtggtaacaaggtacacctcaccctccttactggagtagtgtcagaaaaggccaggtatggagcttggactcttacaatcacctagtgctaagaaggtgcctctctccgactgcccctcctcccccactcccactgtggtatcagtggaggcaacatgtggggcctggacatccccctccaccataacaaggttaataaggcactcttccttgtccctgcagaggtggtatcagaagagatcaagtggggattctggactttgagtactacccagtggtaacaagatgcccctcttaaccattccccatagtgtcagtggaggctaagcggatagcctggacttttaccaccacctggcaataatgaggtgcccctctccactccttccagcacagtatcaatggaggccatgtggggagcatggacttccacttcctcctggcagtatcagggcatcccttccttttaggggtatcaacgaaagttgaatggggtgcctggagttcaccatccacctagtgtcttccttcccctgccggtgtggtgtcagtgaagcctgctaacacagaagattcaaataagactgaaagtcttataatctccaaaatgtccagaatgtaactaaaaatcactcatcataccaagaaccaggaaaaccacaacttgattaagaaaaggaaatcaacagtttataacactgaggtgacacaaatattagaattatatgacaaggattttacagcagctgtcatagaaatgcttaaacaagcgattactaacatactggaaaaagtatagaaagcttcagcaaagaaatagaagatataaagaagaactgaatggaaattttagaactgaaaaatacaatatccaaaataaaaagctaactcactgggtgccatagcagaatggaggtaggaagcagagaacttgaaaatcaaatagaaaataccaaatctgaatgataaagagaaaataataaattggatttcatcaaaattaaaaagaccctgttgagggagatgaaaagataaactgcaaattgggaaaaaatatttgcaaaccgcaaatcaaacacagaatgcatacctataatatataaagaacgcttaaaacttaacagtaaaaaattaacccaattagaaaacggacaaaagacatgaacagatatttcatcaaagaggatatatggatgtcaaatacacacattaaaaagatgttcagccattatgcaaagtggttttgcagtttcttaaaaaacaaaacattcacttattgtatgagctagcatttgcactcctgggcaattatcccaaagaaatgaaaacttaggtccacacaaaaacttatacacaaatgttcatagtagtattattagaatagctaaaaattaaaaacaatatgcatgtccttcaacaggtgaatacagtggtatattcataatatgaaacattatttatactgaaaagaatgaactattgatacatacaacaaaactgatggatctcaagggcattatggcacatgaaaaaagccaatttcaaagggttatatactgcaagattccagttagaaaacattctcaaaatgacaaaattgaacacagattagtggttgctaggggttaaggatgtgaggaaggtagggaagggaggaatgtgactataaactagtagcacaaaggacgtatttgtggtgatggagtagctctgtattttggttttggtggtgcttaaatatacatgtcacaaaattgcatagaaccacacacacagatagtcaaatcagtgcatgtaaaactggtggaatctgaatgtggtccgcgaattgtaccaatggcagtttcctggttttgatactgtgctacagttatgtaagatgtcaccactggaagaaactgggtgaagggtacatagaagctctctgcactattttcccaaatctacaattatttcaaaataaaaagttaaaatgaaaagagttgaaaaggagggattatatatagtacctgagctgatgcagctcatgctgccaggagaggttttcctgcctgagctcttcttgcataatctgaaatgcttttgtcttatcttgatactcctgaagttgagccttcagtggatgtaactcagtgatctcttgattaatctgtaagtattgctgctgcagattcttcaattccttcagctttaaccaaagggaaagtaaaatgattatttgtcacatctcattcatctaactgtaagtcattggtagctccctactaagtagtcagacaccacaacatgaaaccagcacctaacagtccactgatgacatatcactgcaacataagtctctaaagtagtgaaatacatgcagctaggctggtggaaatcacccatggagctgccatcaaggctacagggtgtgactattcctgcaacttctactccttcccctggctcctaaggtcctaagttcactttagggctacaattctgacgtggggtagacttaagagacctagagcttcactgtgggtggtcacatcctaaaacaagaactagtcatgtgtccttgttagggttcttaactttcctacagggctatcaatcttaactgtagcttagcggatactgattataaagaaggcagtgctgctcagtggttaaggacacttaggctctggagttagatatcctactacttcttggacgtgtgacccaatgcatgttcctcatactcttcttttttttttgagagggagtcttgctctgttgcccaggctaattttcctcatctattaaatgaagataattatagtacctttttcataagaatatgagaagtaaatgagcaaattaatgcacttcacacataaagttagtgatgatgacagacttgcctttaattaacaacactgcctacctacatttcagatatattttcaacttctttatctccaatactcattaaaagcttagtaagggagaaataatatcaggacatctgggcaaagatgggggtcttgttcacatacctctttcacccacttagagacatcgctaaagctaaaataatagcattttttaaagcacaaaacacaagaacaggaaaaacaatagaggaatcagcagcaataaaattaattttggaagctgaaaagcagatgagtaagtggtaactgacttaacagatctgagaaagcagaatctaaagctggtagtaagaaaatccaagaatcagtggaacttactctgcagaatcttcaaaaggctcaggaattaacagcatcaggcacctctggaaaagatggtgatgggggtgggagggaggtgatagctgagataaggaggtctagatgaaagctgcttaagaagcaatttcttttaatttttttttttttttttttttttttttttggagagacggagtctcagtatgttgcccaggctggtctcaaactcctggactcaagtgatccctccaccttggcctcccgaagtgctgggattacaggcgtgagccactgcgcccggccagaaaacaacttcatttataggtaccctcttcagctccacactttttgttaccccaacagacaactaattttattctctggacaggtaaaagaagtctctgtggactatggcacctgaggcacagttacaagtaagggtattgttccaaataaagtgaatgcatgcttcctgagtgcttgaagtctttcccctactgagcttgaagagtgctggtaaaaggccttttccctccacaaaggaaatgaaaagtcttctcttgaaaatctgaccagcccaagaaaaactaaagatactgagataagggctaccaataagctcaataagatcatcatgcaatgaaactccgttggtaagtcctacccacaaggttttagaccctccccttaaacatgaagagtacattgaggattaaccttcacctgaagaatggctaacattaaggaagggaagaaaaccaactagagaaggtaatttagaagagattatcaggggagaaaatgtaatgtactcaaagatttaagagataacattgtaaataagaaacattacagcataaattaaaaattataaagaaaaactcattataagaaaacgtcaaaaaacaaaactaccaccattagccttagaaagagaagaaaatctaccggccggggacggtggctcatgcctgtaatcccagcactttggggggccgaggtgggcagatcacgaggtcaagagatcgagaccatcctggccaacatggtgaaaccctgtctctgttaaaaatataaaaattagctgggcgtggtggcgggagcctatagtcccagctactcattaggctgaggcaggagaatcgcttgaattcaggaggcggaggttgcagtaagccaagatcatgccattgcactccagcctggatgacagagcgagacgccgtctcaaaaaaaaaaaaaaaaaaaaaaaaacaagaaaatctgtctatgagacacagaaaaaaaatccttagaaattaagaatataatggcaaaaatgaaaaaaatgttggaatcaaaagacgaaggcaagaaaatcttccagaaatacagcaaaaaaaaaaaaaaagggaaaagttaagaaaattagagaagcaatcaagaaggtcctacatctaaataacaaacatttcagaaataagacaacagagaaaaaggatagaggaaaatggtaaaaaataatttaatgaaatttccaaaaagctgctagtatgatttcttagattcaaaggactagttagcatgatgaagaaaaaaagacctataccaaattatactatcaaaaaatttcagaataggggagaaagggagggaaggtggggtgaggggaagggaagtgagaaacagatcacatacaaaggatcaggaatcagaatagctttagacttgtgaaccacatataagctaaaaagcaataaaccaatgtcttcacaattttgaagggaaattattttcagcctagaattctatatccagcaaaactatcaatcagataagagagataaaaagacattttcaataaatttaccttccacataccatttcttagggatctactgaatgatttattccaggaaaaagatggcacaaaaccaagaaaaggaatacatagaatagacaaaataggagatctaatataggagaaaggtaaagggaaatattctgggatagaaagggtatcctaggagtacagggccactggttgatataggagcaaatcaggtactccaggagaattttcttcctgaagatgaaattgatgggaataaacatcttgaaaggagatgtggacaaatggcagtaaatctgaggttaaattacattaagtacaaagaaaactaaggaacaacaataacaaaaacttattaatctgggaaaaacagaaagactcaggaaaataaaagtaacatgtctctaacgctctagtagcatttgtagtcataaaaaatgtaactctgaattgatttaaccaaaattaaaattaaattacatcaagaaaatgaggaaggggtttgtattaaaatgtgcacacactggccgggtgcagtggctcacgcctgtaatcccaacactttgggaggctgaggcaggtggatcacgaggtcaaaagattgagaccaccctggccaacatggtgaaaccctgtctctactaaaaatacaaaaattagccgggcaaggtggcgtgcacctgtagtcccagctactcgggaggctgaggcagaagaatcgcttgaacccgggaggtggagggtgcagtgagctgagatggcgccactgcactccagcctggcaacagagcgagactctgtttctaaataaataaataaataaataaataaataaataaataaataaaaagtgcatacactaacagggtttactgtgaaagcagggagagtacagagagctaaaccctgttagtgtaaagaaaatcaatagttgatgcaacaaagagccaaaaatgcaatataagcatgatatttacatacacaggaaatactgaaagaataagctaaaagggttgaaagcaaattgcctcagaagaaatggggttgaggtagtgctactcttagcttttcccaccaaacattgtagaatttagtgactaattaaatatgggtcatataactttatttttaacccaaaccccaaaacatatttttgttttgatttaaggtaaaaacatattcctttatgcaatccactcactcctctagtctagatactagactagaggtatcctagaatggaccatcagaaagctgtgtgcctgggactgcattttagctccttggagtggtagttttagtgaactggacgtaattcttttgctctgcacttacattaagggacagctaaataaaaaccctaaaaaacacattattatatttactgtagagaagtaatggatgtttcacaactgcacagtgttctctttatgggaacacagaagaaatttcttacaggcctcaatacttaaagactattcttgtcttgagtaggtgatttttctttctccttttctcctagactataaatactgcagttcatgcatgcggttttcattccctctttctgatggctaatagaaacctcagagcaaactatggatccctctttctaacacagtacaggatatggtgacttccccttgggacactaaccttactcctggtttgatctttttctagcctatcctctttttctcctccttctcagtcccttttattttatcttgaaaaattgtttatatctttatatgctaccccaagtcattttcagaatgaggagagtatagataaatacaggcacccctagagatatgtcatctgcttagtcagttctatgctaaagatgtacaaataagtataagacatgacacttaccaggagtttgcaatctaattggggaaataaaaaatagtgtacagaaattaaacatatacacacacacacacacacaataaggcaatatgggacaaatgataagtaaaatactagggaagtacaaaggcaaaagacaatcaggcaatcacgaaatgtaagaagaggatctgagctctggaatgacctttaaatagtgggaaatagacactcaaaaaaggaaagcaattgggagaacattttggctgctgaagataatatgggtaagtaggaagtaccaggtgtgattattgcatactgagtagatcagtttggtgtgaatgaagggtatgagtagggagcagtaaaagggaacgctggaaaggtatggataaattacagggtcttggccaggtgtggtggctcacgcctgtaattccagcactttgggagccgaggcaggtggatcacttgagaccaggagtttaagaccagcctggccaatatggtgaaaccccatctctactaaaaatacaaaaattagctaggcatggtgtagtcccagctacttgggaggctgaggcaggagaattgcttgaacctgggaggcggaggttgcagtgagccaagattgcaccactgcactccagcctgggtgagagagcaagactccatctcaaaaaacaaacaaacaaaaaaacagggtcttaaatgccagactaaagggggtttgaatactaagtctattctagagatagtacaacttttaaatatttttgagtagtgcagtaatacagtagagtttcagaaagacttatatggtgatggtctgaaaatactggtgagatgataacctggaagcaacattattagaacagtttaagggtaaagtgttagagcttatcttaggatgttgaagatggaaaataaaaatacttgaggcacactgtgaataaaggagtgatacatcttgatggttaaaataaaatcacagttatgagcatttgggaacagaataatatgactctgaattacagaaacacgaaaataaaaaagttggcttggctgtaactatccagcagacaaaaatgtgcaaagtttagtgcctagtgtttataacagataagaataataaagcaattcactgaattaaacatagttagctaattcagaatctatcctaacagctccatgaaaaaagattttgacttagaagataatcaataccagcatatcataaattacagctttgaggcacataccatcctgatgaatagaaccttttgcatttacggtctgaaaagacagacaaaaggccaagctcccagggcaaagtcagctaaactcaaattatttaaaaaatataaacaagtatgtgtatgttggaagtaaaaaccataactgaacagagaggctttgttcggattacaaaaggggaaagactgtctataaatatgggatattaagtgagataggaatgaatacaattacctacaataaaaaggaaaaactcactctacagttaggggtaataatcttttcactagagctcatcttaaaaattagaattttcgctctccctctccctctccctctctctctccccatggtctccctctccctctctttccacggtctccctctgatgccgagccaaagctggactgtactgctgccatctcggctcactgcaacctccctccctgattcttctgcctcagcctgccgagtgcctgcgattgcaggcgcgcgccgccacgcctgactggttttcgtattttttggatggagacggggtttcgctgtgttggccgggctggtctccagctcctaaccgcgagtgatccgccaacctcggcctcccgaggtgccgggattgcagacggagtctggttcactcagtgctcaatggtgcccaggctggagtgcagtggtgtgatctcggcttgctacaacctccacctcccagccgcctgccttggcctcccaaagtgccgagagtgcagcctctgccccgccgccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgtctctgcccggctgcccatcgtctgagatgtggagagcgcctctgctccgccgccccgtctgggatgtgaggagcgcctctgcccggccgcgaccccgtctgggaggtgaggagcatctctgcccagccgccccgtctgagaagtgaggagaccctccgcctggcaactgccccatctgagaagtgaggagccccttggcctggcaaccaccccgtctgggaagtgaggagcgtctccgcccggcagccaccccctccgggagggaggtgggggggtcagccccccgcccagccagccgccccgtccgggagggaggtgggggggtcagccccccgcccggccagccgccccgtccgggaggtgaggggcacctctgcccggccgccaccccgtctgggaggtgtacccagcagctcattgagaacgggccatgatgacaatggcggttttgtggaatagaaaggggggaaaggtggggaaaagattgagaaatcggatggttgccatgtctgtgtagaaagaagtagacatgggaaacttttcattttgttctgtactaagaaaaaatcttcggccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaattaaaaaaaaaaaaaaaaaattagaattttcagattctgggtatgggtcacatttcaaaatggaaagcctagcctttcaaaactccatttatttcctatttggcctattttcctacaaatacaaagccttgatagagttaacagactatcatgaaagtgaagacagtaatgttgccaagtagaatcccctaacaagccaagagtggtggctcatgcctgtaatcccagctacttgggcggctgaggcaggaggactgcttgagcctaggagcagtagaatcctgacaacctggcttggctcatacagttccagttttgcccctgaatcttgggagacctggattaaactcctgactcctactaaaagctgtcaaatgtcagcattaggaagcctctttagctttttctcccattggaaatgttgggtattaaaaggaagtgggtaaatggttcagcctgcaaataaaactttactaaaaagtcatttcaacttatttaaaggaactctttttacgtcacttttttttatttttgacaaattagggttgagttacccatgagatgaactgagtcctttctgctccaaattctaccagataatctattgctaaattgtaaacaagacactaaatgatccttatacttcactgtaagaaggcactaagtgatccttttactttctttcagttaagctatgacaaattctggaaacatttacacatgtctttgtgtatataaaatatataaaacagttctccacctcttagtccttttataaccaatggagagttttgtgccaaggaaatttctgattttttttctaatggtattggcaggtttagcaatttaaatcatgtttctgtgcttctctaagaccaaacagaacctgtgggatacataatactttccctgcgttcccagataatatgtataagaatgtgtttatccttttctataaaaataaatttaaagaaaggttcaaaaactcttaaacagatcagaaagaaagaactagctactcactagtctgtctctgtcattttggagtgaagacatagctttttttaaactctgtacttcagctgggctggtggaaggctgagctgcagacctctgcttcccttcctctgactttcgaaatttctccagctcattccacaggtgatctctctcattctgcagactggccatagccttggaaaaggactgcacttggttataagaatcttctagttgtgaggacaagtgaagcaattgctcatctttggataggagctgttggttaagtttctcaaggtgagacaagctattctcctcagtggagttcattgaaaaggcggtttcagaaagaagagcatctctctctctgtttaagagtccctgttctttcaactgtgccaattccttcagactggcatcatatttccttttcagttcatcaagttcctcattggcatgatctctactattttgcaaggaactcatagaccttccaaaagactgaatttgtgctgtgagacctttattttctttggtgaccatgagtaatttctgttccatctccaccaaatctcttgctagctctgccactctctcttctgctgtttcagtttcatttctcattatccctgcatcatgatgaagatgctttaattctttcttcagtttatcttcaatttcacctaccttcttggcagcttccttttgaacacaaaccaattcttcttccagttctgcaattctcttttgagaggaggaaaacaaagcacttaacctgtgtacctcttcttcttttacttttaactgggcatgatagagtcctaaagtaccttcttcttgcaaggctgttacttgtcttgttagctgggatatagatactttcaaactctcaatctctttagataaatcttgtttctcttcttgtagggcattaaaggacctccgcagatcctcatttgcttcctcagattccttcagcttttcttctaatttagcatatttattttccagctccttattttgctgaagttgaacttcaagaagctgcttttgttggctgtcctttattgttatcacttggttcaggtcttctctatattggatcagttctgcatctagcttggcattctcagaattgagatcatccatatgacttctcaagcctcgtatttcttctttaagcttattattctctgcagcagcctcttggatgagttggtctttttccaagattatagagagatgtcgctcttccagctgttgatagtcacccactatgcggtctcgatcattttggagagaagacatggatttaacaaaggaatccaactgtgccttttgctgaatgttttcctttttgatggttttcagtgtttccataagctgattggttttatcaacagcctttttgttctcctcttctaaaacaatattctcctcttcctcctgggacagcaggttttccagctctttaatttctttatcatgttgctgacgcagttcagcaatagctacttggattgcctcttccttgccagaaagcaggcttataatcttttgctctttcatatttatttcttcatgcagcctactggtcagttctctggaggcctgaagatcagtctccagttgttcataactgaacttagaattttgaatatcagcctcttgctgccttatgatcccttccaagtttcctttttgttccttacatttttctaaagagttacttaaatcagtcaactggtctttgagactcttaagttctgattccaacttagctaattcattctgagaactgtggtataggtggcgtgtctcttctagctgggacaaaagttctttgttttccccctgtagagtatcacagaccttctgctgaagctggacctctgtctgggccttggactcccaaatctgcttgtcatgttcaagcctgaaacagagagaaggtcattagttacagatttcaagaaaaaaactgtgtttcccaaggaacaaatactataacatgtactcaatagatttacaaatgaattaacattcataacaggtgttaaatattttactgaagaggtattaattctctgcacctacatgtttatctactgagtgctatgtattaaaggtatatcatacttaagggttcatatatttaagtcataaactccaaaatatgtcacttattttagtgacatggttttcaacactgaaaagtaacattttctcctattttattctactttgctccagacaagctaacgtttggcttctctaagggataatcttgatatgaaagacagtgagaaaatctgttttagaacagaagggtcctattggaagtaaggaatacaaaggatgagagacattattagttctatagattaaaaagtgacagaaaattgaaatttgagaaaaaataactctaagaggtatatgcagtatgaattaatgtggactaaaggaagaagaaaagacgagactagacaattaatttgagagtactgtggtaaaaatccaggcaagagtagttgaaatggaaatgaaaagaaatacagaggccaggtgcaatggctcatgcctgtaatcccagcactttgggaggccgaggtgggtggatcacctgaggtcaggagttcgagaccagcctggccaacatggtgaaaccccctctctactaaaaatacaaaaaattagctgggcgtgttggtaggctcctgtaatcccagctactcgggaggctgaggcaggagaattgcttgaacccaggaggcagaggttgcagtgagccaaaatcgtgccattgcattccagcctgggtgacaagagcaagactccatcttaaacaaaacaaaacagaagtacagaaatctctcaatagaaagatgggaagagaagatgcgaacttttcatgttcatgcagttgtagcaggattgttgtttgccaaaaaaaagtcagaagtgagagagaatatatcttccatggacatttatgccaaaattagtcccattgtctaaaaggaaacagaaatagtttagagactttctttgcttgaagttacctctggaggaggaaaaattcactactcatttacctggaaatgttaatctttaattcttccatatggatggacatctgtctaagttgatcctttagaacactgcaattatcttctttgagtctaatttcttcttctttgctttgaatcgcatcactaaacttcctctcccatttcttagcttcatctatcaccctgtcacgatcatcctggagggaagacatgctcttagtaaaggctgcaagctgggtcacagtactgtccaagttttcctgaagttgctgaacttccttgtctttcttgttcaaagtaacctgaatctctccaattgtctcttccaagtggactttttctctgcgcaaagcatccagtttctcttgcatattcttcttctctttcaggtgcttctcttctgcctgttccagtcttcgctcaagatcttcatccttttgtttcatctggcttttaactgattctttatttgactgaagttcctttttcaacttgagattgtctgctaggacccttgctgcttcactttgagtgtcatctagcaggactttgaagctagctaattctgcttgtgcctttttgcggtgttcaactgcttgagccagattttctttggttatttccaaatctttttgagattcagtttgaacaaattctagagctttaacagttctctccagagcactaattttctcttgatacctgatgcagtccttctgtagctgctttacttcttgttgtttttcttttaacagttcctgaagttcctttgcatggcttttatttccgggttctttctgagcaccttgtattttctccaaatattcctttcgtatttctgattccaccttagttttttccttgactaactgctgcttttcttcttccaattcactcacacactttttaaggttcttcatttcagattccaatagctcattttttatttgggcatctgtaacatcctgacagtaattcccaatgcttccattaagttctgctaattgattcataagcctctcttccaaatcatctttctcttcttctgctgtctcctttagtttggtaactctggagagttcttcttggatttgctgatttaacaggttcattttggttacttcctcctgaagcatttttagttcaccatcctttgttgatatctgactcagtaaggtatttttctcattttctaaagtctggctaaattccttgtttttctgcttctcctcctctaatccagcaattctttctttgagctgatcaatctgctgtaggtagttattaatttcatcatgtgagctgaaatccttacttacagcagggttggcactcttcgctgatggaaccgattctgaacatgtaggtcttgtgctcatactcagagagtcttgctcttcagtctcacctggtatagactgtgttccctcttcagtgacattcgtttggttatcatgtttctcggtggcctctaggttagcttgtttagatacattaccttctatctgatgctttaaatcttgaacctcttcacttagagagtctttctcagacattaaagactgaaacttcttagaaagggtttcatactccattttgaccctttcaagttcttccttcatgctggcattggaagaaagaagtgtttccatacactctttagctgtatctcctgcagggtgcacctctgccctaagccggtcattctcttcttccagctctaggattttctgctgtttagatttagcaaactttctcatcttttctttcatttcctccatttcttgctcagcttcctgcaactgcttttctgtctccttcttgtttgcctctgtgcttcttaacttgccatacagttcttgtttctcttgcctcacagcttccaccacatgctgaatcctttctgcttcattactaacattctcataggactgcagaagaatttcatactctttttgtagctccttgtgtttctcttgccactcagtactttctgcaatcttagaagatttcaaagattcaatttccttcactaacttttccttgtcttcagtaagaccctctagagctagttttagactttcacaggagctgctgagactctgattttccaataaagacctgtccatttctgtaatgagtttgtctctttcttcttgaagaagagctaaccttcctaagaccgtatctttttctttattttgagcagaaacttggctttccacatctgccagagacttggtgagacgttcaatggtacctctggccaaagacaattcctcttggagacttttgttttcttttagtgcttcttttcgggaaataagggcagcttgcagtttcctttgtatttgttgctttgctctactttcttctccaatctcttctggtttttgcttcatttcacaaagttccacctgtagctgctttatcctctcatcatgctctttggcttgcatttctagctgtgtatgcagagccttaattaaatcttcttgttctattatctctgtctgtattttagtgagagctgcttctttctcactaagttgtccagaaaggtagctaacgtcttcttcctttttgcttatgagtttttgcagttcatccagtttaggttgcaattctcttagatgttctaggccagcaatttgtagttggctgctttccaatttctgctgcaggctttcggcatggacttcagcttcatgggatactgtctttagactctcgatttctaaaccctgtttatttatctgctcttgtaactgaaatacctcttctgattttttagtaagctcacttgttgtagaactaactttcaattctaactctactttctcagcctctatttccttcagctgggccttaatctgggcaacagaagttccgccctgcagagcactcgcatcttcagaatgagaaggccagtctgggcacaagttggactctaaaacaggttgagtgtgatgctgttctgtggctttgaataaaggttcttctaaacctggagtggaagaacacgattcctgctggtctgtgcttgggagttttccgtctatggattcccttacttgaatctggagttgccttagctggtctccaatattctcattttccttgctttgctcatcaaactgttcttgcaagcgattatagtcatctttctgttgctttagctcctccctgagatgtctttctttctcctgtgcctttttaagaattgccttgcgggaggttaaggcttcctgtagcttcttttgaagttgctccttttctttttcaagggccagtatcttttcttctagttctggtttccagtgttcactactacctgtacaaggtggacttatcaccactgtttcctttacaagtgctacggagtccccatcacttgcatccgtgttacttgtgattaacttctggataattgcttggttttcactgatttctgcttggagcaaatctatttggtttgttttatcttgcaaggtctgattcatctgtttgaccagagcctggaattgctcttcagctgccagcttttcttccaaatccttccttatatgctgtagttccacttctttctcagatattgtctgttttaaataaatttctatttcttggcacttagaagtcacacatttttctgagtattctttgttttctttatcttcttccacttctcccctctcagtctcactgagtgggatttctttcttagattcatctttcaagttggctaattcttcttccaatctactgactctttgcagaagctcctttctgttaataagagctgcctggagctttctctttctctgctcattttctttcttcagaaggtcaaattcatgctgaagttcttccttacttatttgtcctgctgggctcatctcatcataattttgtttaaggccagaagaaacttcattatcttcttccacctgctctttttttgcttcctcagctctggataataaatttagctgttctttaagagtcttaatttcaaccccaagagaaaacttctcttcattaagctgaaccattttctcagtcatactaaagctgatttctgtcacttgttgatccttctcctcgatggtttgttggagggtttccacatctctctttttctctagtaagagctgatccatttttgttatttcaagttccttctgtgaaagagcctgggacagttcttccactttacttgagatatgccttacacgttctgccccctcaagcacttcactttccttattttgcagctggctttgcaggcttcttatcagggtactctgctcagaaaactgaagctgcacatcatccagttcattctgtaaaacttcaattttcacatctttagatttggcttctatgctgagactatggatctgttcagtgagcaggttgtcatgggcagtttggctttcataatcaagtcttctttgcctttctgcttctgcaaggttcatttccagttgctttacctgagccctcaattctgttaccatgctaagttccttcacctgagagagaagctggtctctttcttcagacaaagcagtgaatgcactgctgttgttgtcagcatttttcttaaactcctcaatcaactggtttaggttgctaatttccttagctttctcatctaaatttttctcatagatttcttgtgctttatgaaagtttagctcgagctccaaaatttgactttttaacctttccaactcatcctgatgacactgaccaatatctggtacagcagaaagggatttatcaccatcctgctttgttgatttcaattctactccagcatcatttaaagatatttcctcagatgttctactttgatgttcagtgctcgcctgttctttttcaactgctggaagactgctctcttcatttggcattaagggaaaatcttgccctgtatcttcaagaaatactttcattttaattggagctattccctcaccctccatctgtttcatttctttctggtcaaggacctcatgatctgcttcctcagccctttttccctggagctgtaatttaagaaatgcaatttcctcttgagcttctttcatttccaacaataaaactgataattctttatgtttctgagaaaatgtgttttctagaacatcttgtccactttcctcagcagaagagctcctcttgttggcaatatcaacaatgctgatctatttttaaaaaagaaaaaaaaagctgtaatcaaatgttttataacattaaaaaaatagcccaactaaaaacttgtatttcatcttctaaaacttcagactttttggtcaaaaccttctttgtaccataacactgctaaatccttttaaaatcagtttgtatctcccagctggacctccaagggcactctgccaatcctgcactgaagtcaagccctattcataagacctaaggaaattgggaattcattttctagatattccttacataagaagctttttttccttcagaataaaactcctaattgattttttttaaaaagtaagcagatacttttgttaggaagccacattactcctcaagggcatgtataattctatcactgacttactgattagaaaaacacagctaactaaacaaaacgcagctaacaatactcttaaatcaacagaatgatactaagcaaccatacccttcttatagtaattttcagattattaaaaggatcattctccaaagatccctttttatttaatcttagtaaaactatgccagtcttatctaatctcttcactgagaaacttttctgagatgaacaaagaagttgagatagatgataacccagtataaaaaaatgtgttatcaaatcccaaattagtagctactgtatttgtgttgctttagaacaatgaattttaatattcagaaacaagtaacaataaatgagatataataaccattatgaatctctttaatagatcttactctataggtaatgtacttctctggcaacactagaaaattatggacgtattttcatatgaagctaccttctcttaatctagctcatgttctggttatattaagaacacatcacttacctcactgacttctctgtctgcctccccagttctattctgagcctctaggagagtaatctgagaagacagtttttctgaaagtcacaaaataaatatctttagaagatatatgtggagtgtgtgaaaaaacaggattgcatgtgaagctatttgaattgtatgaaataattttttaaaaaataaacaaaatagcttgggagaggtgaaagccttattaaagaagtggcaagaggatatgattacatgagatataagatagaacagtactaggtgatgataatgaacctgaatgaagtatactaaatagtggaaggtttgaaaggagaaggatgccaggatgcaggacataaagcagctatttctgtggcataatctggaacttctaggacaatacatataatttatccataatcctactatgtttgtaatatatattttgcattaatatagcacttacaatgttcttcaatgttcataaagatatcaaattttagcactaaaagggagctatcctatctcctcaatgatcatataaggaaacaaagaaatgacacaacccgaaaggttacgcagctagttcagggagctgggattagaatccaagtcttcagagttttaacccaagttctgtgacaatgtgtatatattgagcatcaatatcaatatcctcaagaagcttatattctttctgagaagataacacagatacaccaaaggaaaaaaatatatatattttttacactgtatccaaatgtcttaatgtgacctacaggaaccctcatgctttgaccctactaattctccaacctcctcttcttgtattgccccctttttgttcactctgctctaaaaacactggtctgttttctcttctgcaaacttatcaagttcattcacacctgagaacatttgtactgcttttttctctgcctggaatgctctctgcttagcctctttgcatggctgtccccttttcatcattcaggtttaaagtcctcagaaaggcctactctcactactccaattctgcgttcctcttctccaaggcatacttgaaatactctgttttattttaagcctaatacttatcattctctgaaattttcttatgtgtataaacaggtttgtagtctgtcttcccctccaatatgttcatagctatatacccagcaactggaatagtgcctggcacataggaaagccaccatagatgagacaagggaattcaagacagtatatatgttcagacatttcacaagattacttgaaaaaggagtacagtggtagaaatgtcagtgcaaaaggtgagttgaaaacaacatgacatacaaggtaaaagtaatctatgaggccagacacaaaaaccaatacagaaaaccttaaggtcagtgatccctgcaggaaagagcaaaggaatggaacccatataatacctccaaaccatgtgaagccacatggataggatacagactgtttgcaaaactgcaaaataagcatcatggataaggtctcaaagaagtgctctgaatgggttaaataatgagctgaatttgtggtgttctttacttattagaaatagtgggaatcgtctaatacaagtgcataagcttccatttagatctaagtggaaaactgtaaaatggttaagttagaaatactggctctagagtttaataaaagttttacaacctttacttgctattcattctcactcctagatgataaagtgtagtagtcagttaaagatgaattagatcaataaagcattaacgacacgctactaaatccataaagtctacatgaagcatatgataagtggaaggagacacgtcttcattctcactaactgttcacacacaatccaataggataaaatgctaagttcagttcaatccaacaaaactttattcagtagccattatttgccaggtggtatactagttttgggtaaagcaaagatggaaaaaaaaatggcccctgcccttgaagagcttatatttaaactttgaagagcttataatatagtaaaaaagacaaacatataaacagatcattttaatacaatgttaaaagtatacaaggatgttatggaagcacaaaaaaatcatttaacccaacttttggggaccaataccaaattcctgaaaaagataatatgctagtcgaggcctgaaagatgagtaacaatcatccagactaaaggaaaggagcaggattctaagcagggtacagcacgagcataaaccactcactcacaacatagtttctacctttaaacctttatactgatctctgttacctcatcccacaaatttattaccagaatgtcctttctttcttcattttacctattttaaaaatcatcttattaaggtcctgttcaagccatacttcctataggatacgatgaccattccaaaatgattatgagttataaagaaatcctgcagcatgtatagtccatattgcaaaatgttatacttatgtaaacactgatactatgctctaattgtttaatgtgtattatctttgatagttaccagctctattatctaaatctttattatcacggaatcagagaattctacatgttatacataattagtgataaaagtagaggcacttgtgggataagaagacagagaattatggttttcttttatacataccattctcagctttcagctcctccagctctatagaactaaggagcaaggctcccttttcattctctagttctaccactctcttctgcaaagaagcaatattctcctcagtgactgcctaaattgtagaaagacaacaaattaatgattctccagcagaaaattctcacactaacgcccagatagcctccagcatttttgtcttctagaagttctccagccatgaaaatactttaaaaataacatctacttatctgcctaggtaatctttgaagaaaagtgttttatctaaagatttagaaaaagaaataaaatatttcacacaaatatcaagttcattggcttttaaatttaagattgaagcctggattacaaagatagaaatcccaagtctatagcataagaaagaacattttcaggttcacaaacaaatagtattacaagattagattaatgtcaccaagtaacatggtctctctcctgaaggagaatgaacatgaagagaggttccacaaagaggaatagaggcaaaggaatatgtacctcttaagaaaggaagaagatttataaaattgttttttgttttccaagtataataaaaattcccttggcttaatttatacatccagaatttttggttttcctaaggataggcatatatctaattatgtcacatctttagttttatgtctttgtatatattttttattctccatggatattattctataaaattttcatacaattgtagaatttttaagccatgagggtctttacagcatatttgaccccgaaatcttcattcaatgtttaaaataaatagcatgggatgaatttagggtttttatggcttttatcttgagggaagttcccagtttgcagtatgcagggcaagtaaaattccaatagaatagccacagatatttctggcttgaagaatgagaagagtttgggacaaacatagctgccaggatgtgaggagggagatcagagagaagaaaaagagttaggaaggaggagccctgaattctgtgtataaacttagctgaaatttctgactgaacaatggcacaatgtatttgttggactgacttaaagcagcccagctaaggcaaaaataactgaactgagttttgatgcctctctatcataggccagagtttggggtttgagtccaacttactgtctgataaaaagtaattgaaattttagaaataacaaaataaaatcttgagaacaaaacacgacatccagaattcaaaacaaaaccattcacacataaagaaataggaaagagtgacccattctcaaggaaaaaaaatataatcaacagattctagccataaaatgatgcagattttgtaagtagcaaacaagaattttaataaagaagctattatatctatgcttaggacataaatgaatatgctcataatgaatgagaagaaaggaaatcttagtaaaacaaacaaaaaaaaataatgaaccagtttgaaattccagaactaataaacataatatctgaaatgaaaatttcaatgtgataggcttgacagtagaatatagacgacagaagaaagtcttggtgaattgaggatgataaatcaactgaaattatccaatctgaagacagaagaataaaaaaaattgaaaaaaaaaatgaatacaacctcagggacatgtgggacaatattaaaaggttcaatatacgtgtaattggagtaccagaagagacgagggacagaatgggaagaaaaaatattttaagaaatggccaaaaatttctcaaacataacgttatatacgtaagaaactcaacaaaagcaagcaagaaaatgacaaagaaaactataactaagtacttcatagacaaggataaaaggaaagtcttaaaatttccatggaaaaatgatactttacatacagagaaacaataattcgaatgactactgaccaattgttagggaaaaaatataggccagaagagggaaacaccttctttaaagtactgaaagaaaggctggacacagtggctcacgcctataatcccagcagtttgggagggcgaggcaggtggatcatctgaggttgggagttcaagaccagcttgaccaacatggagaaactccgtctctactaaaatacaaaattagccaggcgtggtgactcacgcctgtaatcccagctactcaggaggctgaggcaggagaattgcttgaacccaggaggcacaggttgcggtgagccaagactgtgctattgcactccagcctgggtgacaagagtgaaactccatctcaaaaaaaaaaaaaaaaaaagttctgaaagaaaaattgtcaatcgagaattataatatccagtagcaaatatcattcaagaataaaagtaaaataaagacatttttagataagaaaaaaactaagaaaattttttcacagacagacctatactataatattataggttgttgtagaggctgaagaaaacagtatcaaatagatatctgatcatcagagaggaaagggcattacaaatggtaaatatgtggataaatgttaaggtcaatattttcctcttaatgtctttcaaatatatataaccattttaagcacaaatattaaaattgtgtgctgaggcttattacttttgttaatataatacatacaacaactgtggcatcaggaatagggtgagggtatatgattatgaagattctaccttttaagtgaagtagtacagtattaactcaagaagactgaaaaattatggatatatgttatacttcctagaataaccacttaaaaaatttttgtaaaaagatacagctcaatacccaatagatgacttttgcttctgctaaagactgagtaacatggaacagatttaacctcctacctgaaacaataacaaccaaaaccagacaaaataataaataatcattttcagaatactggatatcaagcaacaaaggataattatctctgagagaggcagaaaacaaagtgatccctaaaactgaccaagcttcatgccttaagagagttttcaggctgtggtccaagaagggggaacataggctgagcctggtagactccctaagttcatgagacagagctgacagtcaagaaagagcaagatggctgcagttcgcagaatagaataccagatgggaaaaagtcacgtaaagagaaaaccctgcagatctgcaaagggactgaacaagtgttcagtgaagtacagggcaggacatgaatgtgaggaaagcatccaaggctatctgaactacccctacctatctgaagagattaaagaatagcacttggtgctcacacaaaacccggaagtgtcagttatatagccaaatgtgaaaaaacacttctcagggcattgagtagaatactcagcaaggtcttgcctcaggagtatcgaatgactgagcactgattcgaaccctcctaacaaatcaaagcagcaggatctgaaaggaccaagtttttttcaaagaatttaactgagtcgcataaaaaaagctccaaaatatgttaacaaaacaaatatagaaacaaaggagaatcacttgaaccccggaggcagaggttgcagtgagctgagactgcatcaatgcactcctgcctgggcaacagagcaagactccatttcaaaaaaaaaaaaaaattaaaagcccattaatgagttttggaacaacttcaagtaatctaatataaatgtaattggaattcccaaagaagagtagggagtcagaaaaatatatatatttgactaattcacggcagaaaatcttccaaaactataaacacagagattgaaaaagctcaatgaaccccaatcacaagaaacatgctatgtcaaggtacattataattcaagtgctcaaaaacagtggtaaaatcctaaaagcaagcaggaaaaaagagagaagcatgacagcagatttcttattaaaaacaaaatgcaagggccgggtgcagtggctcatgcctgtaatcccagcactttgggagactgagggggtggattgcttgagacaagagttcgagactagcctggccaacatggcaaaaccccatctctactaaaaatataaaattagccaggcgtggtggcggttgcctgtaatccaagctacatgggaggctgaggcaggacaatcacttgaatccgggaagtggaggttacagtgagttgagattgcgccactgcactccagcctggatgacacactgagactctgtctcaaaaaaaaaaaaaaaaaaaaaaaaaaccaacaaagaaaacaaaatgcaagaaagaagacagtagagtaatacacttagagaaatgaaagaaaaaaaaactttcaatgtagaattctagtcagcaaaaaataatctttcaacaacaatggtgagataaagatgtcttcagacaaaaagtgttattagaacccatgactggccaggcacggtgactcacacctgcaatcccagcactttgggaggccgaggcgggtggatcatgaggtcaagagattgagatcatcctggccaacacggtgaaaccccgtctctaccaaaaatacaaaaacaaaacaaacaaaaaaatagccaggtgtggtggtgggtgcctgtagtcccagctactcgggaggctgaggcaggagaatcacttgaacccgggaggcggagattgcagtgagtcaagattgcaccactgccctccagcctggtgacaaagtgagactccatctcaaaaaaaaaaaaaaaaacaaaaataaaaacaaacaaacaaaaaaacccatgaccagcagacttgcacacacatccatgtacacacagacacaaaaattaaaagaagtccttcagagccaggtgcagtagctcacacctgtaatcccagcactctgggaggccaaggcaggaggatcatttgagctcaggaggttaaaaccagccagcctaggtaacttagcaagacctcatctctactaaaagcaaaaaaaaaaaaaattagctgggtagcatggtgcatgcctgtagtcacagctactctggaggcaaatatggaagaatcgcttgagcccaggaggatgaggctgcagtgagccatgatcatgccactgcactgtagcctgggtgacaaaatgagaacctgtctcttactaaaaaaaaaaaagaaaaaaaaaaagtccttcagatagaagaaaaatgataccagatggaaatatgaagccagggtttggcaaactttggaggcctgcataaataaagttttattggaacataaccacaaccatttgtttaccttggctctatgtctgttctcactttacaatggcagagttgagtacctgcaacaaagactgtatgacccacaaagcctaaaatatttactatacataaaaggattggcaatctctgatctacaaacgaagaatgaaaagtaccagaaatggtaactgcaatggtagttaagatttattttcttattttaatctccttaaaacataaacataaatgctttatatgtattagccaaaaactgtccacaacccaaattatccatcaatgagtcaatggttacacaaattgtgctgtttacaacatactcaacaatacaatggaatgaattattactaaacaaacattaggatgaatctcaaataagtatgctgagtaaaataagccaacaaaagtgcatatacaacttatataaactttttaaaaatctataatgacagaaagcagatcagtggttgtctaggtagggaaagatgtgagggaaaagattaaaagaggacatgaaaaaacttctagagatgatgaatatgttcattttcttgatagtagtgatggttttatatgtcatcaaattgttctgggtgctatggcttatacctgtaatcccagcacttcgggagacaaaggcaggaggatcacttgagcccaggagttagtttgaggccagcctgggcaacatagtgagaccttgtctctacaaaaaaaaaaatttgccaggcatggtggcacatgcctgtggtcccagctattcaggaggctgaggtgagaggattgcttgagcccaggaagttaaggctatagtgagctgtgatcatgtgactgcactccagcctgggtgagagaacaagaccctgtttcaaaaaacaaatgaacaaacacacaaaaccctctttaaactgtatactttaaatgtgtacacattactgtatgtcaagtatacctttttatacttaatagagctgtttaaaagaaaaagttgtcaataaatgaaaattaaattcaagaaacttctaattatcgaatagaaggcaggaaaaaagaagaagggaaaacagaggggaaaaaacagaaagcaaaatggtagacctaaatccaatcacatcaataattacattaaaaggactaggcactccaatcacaaagaagagaagaaataaaaaagtataacccaactatatgttgccttcaagacatttactttaaagaaaaacaagttaaaagtaaaaggatagaaaagaatataccattcaagcaataaacataagacagaattattttattaatgccagatacagagaaatgtaaataaagaagtattactacagatagagtaacattttgtaagtgaaaaaaggaacactttatctgaaaaataaatgtgtatgtactaataacagagattccaattaccaagaagcaaaaaatgactacattaaaaggagaaacagacaattccacagtcatagttggagatttcaaccccctcttagcaaatgtttcaataaccagacaaaagtcaaagacaaagataacgtgaacaatactatgatctaagtgctatttgtagaacattacatccaataactacagaatacacactatttacaagtgtacaaggtatgttcaccaagacaccatatgctgtgtcataaaataggtctcaataaatttcaaaggattgaagtcacataaaacatattctctgatcataatgaaattatattagaaatcaataagatatctagaaataaaaccaagtatctggatattctacaacaacgtgtttatttagaacacacttctaaacaatccatggtcaatgaaaaaatcacagagaaacttagaaaaatgttcaaaaactgaaatgattaaaaaaccacaacataacaagctatgcttagagggaactgtgttaactttaaatgttcatatgagaaaagaagacttgaaatctttgatacaaagtttcaccttaagaagctataaaaagaagagcaaagtaaatccaagtaagcagaaagaaatactaaagagtagaaatcaatgaaaatgaaaataatcagcaacagagaaaattaacaagaccaaaagtggttctttgaaaagatgggggaaaaaagctgaataaattctagatagactgatgaagaaaatgaagcacaaattaacaacagcagggatcagcgcttacaggcattaaaaggataaaaagtaaacattgtaaccaacattatgacaaaaatagaacattagaacatcttcaatgaaatagacaaaaccccaggaaaaaaaaaaaaagcccaaacaaaccaaaactggcaccgggtggaaaaaaaaaaaaaaatcttattattagccttatatctgtaaaggaaattcaattcattatcaaaaccttcctaaaactccagactcagatggtttcattggtgaattcttttaaaaaaaagtatttaaaaaattattttcaaaaaccgaaataataccaatcacatacaaactctcataaaatagaaagaaaggaaacactcccagaaaatagaaaagggaacatattatgaggctgccatacccttaataccaaaacctgataaagatatcataaaacaagaaaactgtagactaatatccttcataaataagaacacaaaaatccttcacaaaatattagcaaatcaaattcagtactatagaaaaaggataatacagttaactcttgaatatgggtttgaactacatgagttcacttatatatgcacatttttttcaacaaatgtattggggttgggtgtggtggctcatgcctataattccagcattttgggaggccaagggagggggattgcttgagtccagaagttctgtaccagcctgggcaacatgatgaaattccatttccaccaataaataaacaaacaaacaaacacataaaaatagccgggcatggtggcatgtgcctgtagtcccaactacttaggaggctgaggcgggaggatcacttaagcccaggaggttgaggctgcagtgagctgtcatcacaccactacaccccagcctgggtgatggagtgactctgtctcaaaacaaaaaaataagtaaaattttaaaaaaagaaaaaaaaaaggccaggcgcagtggctcacgcctgtaatgtcagcactttgggaggccaagacgggtagatcaccaatggttaggaggtatggttaggagtttcagaccagcctggccaacatggcaaaaccctgtctctactaaaagtaacaaaaattagccgggggtgttggtggacacctgtagtcccaactacctgggaggctgaggcaggagaatcacttgaacctgggaaatggaggctgcagtgagctgagatcacaccactgcactccagcatgggcaacagtgaaactccatctcaaaaaataaataaatagaaaaatttttaggaggattgctacaactagacatttgttattactcatagaagaatcacatagcctagaaatataaaaaaaaaattaagagaaagtttattttaaaaattaagaaaaaattaagaaatatcaaaaaaactaagagaaaaattcctctacaagattgaggatgatctgatagaggaaattccttaaaaacctaaaactagtatcacagccaatggtaaattatggaacactttcctcttagattagaaacaatgcaagaaagtccagtctcaccacttctattaaacagtgtactggaggcataaaaattagaaagaagtaaaatttgtctttattttcagatgacatgattgcttacatagaaaatcctagagaatctacaaaaagagactaaaaccaataaaattaatttgtttatcaaggtcacagaatataagcttaataaaattcagttgtatacttacatattagcatacattggaaaatgaaataaaaataattccatctataatagtatcaaaaatattaactacttcagaataaatgttataatgtgcataatttctccaatgaaaactacaaaacactgctgaaagaaattaaagatctaaataaatggagagatatactatattcgtagatttaaaagtacagtagtgttgtcaattcttaaactgatcaatagactccacacaataccaattcaaaatctcatctgtctttttttaaaaagtagaatttgagaagctgattgtataatttatgtggaaaggacctggaatagtcaaagcaatcttgaaaagaagaacaaagttggaggacttatactattaatacttgacttcaagactaacaacaaactacaataatgaagaccgtgatactggcatagggactgacagatagatcaatataacagaacagaaaattcagaaatagatgtattagtctttgatttgcaacaaaggtaccaaaagaatccaatgaggaaagtaaagtctccttacgaaatggtgctgaaacaacgaaatatccgtacaggaaaaaacaaaacaacttgaccttcaccttacaacacacacaaaaattcatttgagattcagagacttcaaatgaaaactaaaaccataaagcttgtggaagaaagcataagagaatatcttcataaactggggctaagcaaaggtttcacagacaggacacagaaaaaaaaaacaataaaaaatgataaataattaagctcatcaaaatttaaaagtgtgtgctaatgaaaagatatcataatgaaaatgaataggcaagccacaaagccacagcatgggagaaaatattcaccaaacatatatgataatagattggcattcagaatatataaagaattcctacttgataataaaaagacaactcaaatttaagaatggggaaatgatgtgaacagacacttcaccaacagaaggtgtacatatggctaagaatctcaagaaaaaaagttcaacataatttgtcatcagggaaatgcaaatttaaaccacaatgaaataccactacatacccattagaatggctaaaatgttttaaaactgacaccaccaaatcttggagaagatgtggaacaaatggaactctcatatattttaggtgggagtataaaatagtacaaccacagccaggtgcggtggctcatgcctgtaatcccagcactttgggaggccgaggtgggcggatcacgaggtcaggagtttgagaccagcctggccaacatggtgaaaccctgtctctactaaaaatacaaaaattagccgggtgtggtggcgggtacctgtaatcccagctacttgggaggctgaggcaggagaattgcctgaacccgggaggtcgaggttgcagtgagccgagatcgcaccactgttctccagcatgggcgacagaccaagactccgtcttggaaaaaaaaaatagtacaaccactttgggaaaagacctggcagttccttataaagctaaatacataggtactctatgacccagcaaagcaattcctcaactagtatttactgaagataaatgaaaacatatgtccacataactatttgtatgagaatgttcacagcagtttgattcataatagccaaagcatgaaaaagtccaggtgtccatcaataggaaaatgcagtacaatcatgcaaaaggaaaattcagcatgttcataaaataaaatacttctcagcaatattaaagattaaattataatacatgcacaatatggatgaatctccaaatatgctgagtaaaagctttacacataagaggacctattgtatggttaaatgtatatgatgctgtgaaacaggcaaaattaatctatggtgaaaaatcagtagttgtctttggaggggaagggtgaggatgactgtaaaggggtatagggatactttgtgaggtgatggtaatgtgatatatcttgaataggagtttgggtaacacaggtgtatgcatttgacaaaactcaaggaatggtatacttcagatctgtgcatttaaaggtttgtaaatcttacctcaaaagaaaaagaacaattataaataaatattaaaatatagtcaatgatatgaatgctgacaaatttagagagaaatgtactgatgtccacaacttacagtgaaatgtattataaatttaagatgaactgatggatgggcagagggatgaataaatagatagacatttgataaagcaaacgtgctaaaatgttaatgatagaattcagatggtgggtatacagatgttcgctacaaaactcttgcaacttattcgaatggttggaaaacgtcttaacaaaacattggaggaaaaagtcgagaatgggagaacagaagagactggaaagcctagatgctagaaaccaagaggcaaaaatttttatcagtggacagcatagcccaggaatgacaggactctgctgaccaatatgtttgtgagtttggaagggtataatcttacaatggagatgactgaatctagttatctcaacttgacattagtcaattaagaacatcaaactaactgccttcattctgatattcaggctcaatcagcctgaatcagccttcgatgattacaatctagctctctacagagatttttgtagatgaaagaaagaatatactggccaataagaagctacttggccattatatacttttttactgttaattaattaatgggaacaatatgatttccatagtagacttttaagtttgattagactgactcgtgttcactaaacctgatcaaatcttagtttaccaaaaaaaaaaaagacttccgaactgggaaaattaactacagaagcaaaagtaatgattcatctccgatacaaattgttaagaccttagaatcagaaaggcttctgagaccatggtatttgttatctattattttctcattctttattgttgaaacactgcattaatgcctttcatgattcctttcaaatagaattgtcctcaaaaaagtattttttcaggcagaaaaaacagaaggtttatatagctctctggaataaatcctcattagagcaccgaagtacagatacagcaaagacaaacagttaatattcataagaagttcacatttaattacctgtgtgccctcattataaacatctgggaaagaagtctgagatgctgtttcatgttgttgcaagggcagtctatttagaaattggctaatttctttggatttttgctggagctgatctaaggaaaagaaaaaaaataaatgtaatatttgcttcaagtctgaaatgtagttattattatcttctaaagatacactgtatgctgtttactagtttagtttccttagttaaaattatgatgccaatgacaacattattattagctaaatgttaaatgttctcaagaaccaaaggacacctcagtaaatcacttccttcaaaagtaaaataaaataggcctaggcactttttttttttttttttgatacggagtctccctctgttgcctaagctggagtgcagtggtgcgatctcggctcactgtaacctctgactcatgggttcaaggattctcttgcctcagccttccaagtagccaggattacaggcatgcgtcaccatgcctggctaatttttttttttttttttttgtatctttagtagagatggagtttcaccatgttggccaggctggtctcgaactcctgacctcaggtaatcccccccaccttgacctccccaaagtgctggaatagcaggcgtggggaggcctagccctaggcattttttacaagttcattttccctttcccccttgaaaatggctttagggtttttgttttcttcactctcgacttaggtattatggatcccaccaagattccaccacatggttttaaacatcagcatgcttaagagaacagcttgctcatgtaacaccctggtcttgtgtgatgcccttcaaaactgtctggctagggcacaatggctcacgcctgtaatcccagcactttgggatgccgaggcgggcagatcacctgaggtcaggagttcgagaccagcctgaccaacacggagaagccctgtctctactaaaaatacaaaattagccaggtgtggtggtgcatgcctgtaatccaagctacttgggaggctgaggcaggagaatcacttgaacccaggaggcagaggttgcagtgagccgagatcatgccattgcactccatcctgggcaacaagagtgaaactctgtcacaaaaaaaaaaaaacaaaaaacaaaactgtctggctaacattcagttattcaatacaaattttcaacttaattgtttctaaaatctttcctttatgtctatgtcaatatattagtaaaggttataatttggggaagaggattggtgagatggagtattggtgttgaggaagtttcactttttaatttataaagttctaaaatgttcaattttttataggcacatattacttttataataacacattttttaaaagtttcctttataccttcataaaggataaattttcacctgtaagacaagaaatcaggtgaaaagagattttcacctataagaaaagcactgagatccatccttcttcagatttatggataactccatgcaatttagtctcctaacctatgcacctagatctggcctgagttttccaaaaactaattcaaatccttctcgtttcagtcattgaatccttcagatcagtcatatttaacatagcattctatttaatatctggaacatcactatcacatttttagtattgtaatgataattataatattaagaaagattatagccagtcagaggcaagaaaaatgcatcaagaagttcagaagagctgtttttctcagtccttctattggttcaattggtttgagtacagatttcattaacagatccctgaaaatatgaaatacaagccactcagatggtagagatgtggacttcaaaagcaatcagctactgaccttccagttgctgaatggtctgggctgactgaactgcttgctcattcttatcttggagaagctttgaattttgatcctttagagcatcacaggcagactgcagctcttgtccagtcttttgaagactcaaaatatgagaggtcttctcttccatttctgctttgtgcttctgctccaaagcactataccgagactctagttcagcctgggcttggcctgcttgctcaaactgttctaaaagatgatgcatttcttcctgcagattatggaaggataattttctctctgccacttcaagttccatcttttccagtagaatcttggactcctctctttctgtttccacagtgttcctcaaagtattatgctcagcttccatctgctgtaactgctgagagagaatctaagaaaaaagacaaagtctcatgagccataaatacattatttcatttcaacaagcattgtaaagtgctttttcttataggatggaaaaaaatgggaacatgtttctatgctagagagaaagcccttctcaagaaggagagttgaaaattaagaagagaggagatggctgactccccagcagcacacaggcacccagaaaaacaaacagagaatgtggactatagcaccaattctgcattatgatgagactacttggatgtgacaggataggaacacaaggaatccaaggggtagaaaaaaggtagttcaaactgtcaagcatgggtccatataggacacagaaaggagcaagggtaaggaagaattaacatactagagaagcaaagtggaattcaatggaattcaatgagaatgaagatcaggacaatatgagaaagaaaatggcaggatggattatagtcagatcagcattactgattaccttcatactcaagagaatattgcagaacgagatcatttcaatctaacagaaggtcaatttacaaaaacaagaaaagatgggctgtacataaagcacaaaaaccattcaagacagagaagagtaactgatgaaaaagaaactcactaaaggataatacaggtcaagtatcccttattctaaatgcttgggaccagaagtattttagttttccatttttttcagatggtggaatatcttggatatcttgggataggacgcaagtctaaacatgaaattcatttgtttcatatacatcgtatacacatagcctaaagataattttatacagtattttaaatgattttgtgcatatttgcctttgatctgttaccctgttccacaaggtcagttgtggcattttccacttgtggtgtcatgttggtgctcagaaaatttcagattttgcagcattttggattttcagattaggcatactcaatctgtatgacattctagataaactaggaccctagatctaaaatggcaaagggaaagagcaacaataaagaagtgcaatgtatgctccatgagggaaagaactgtatttagttttgctcataattgtactgcatccccaccacttaagtacgaggtatttgttgaaagaatgaataaatggcatcaattctctgaagactttaaataggcttttatatctactgcctggcaaacgaaagtggaaatgaataccctccaaggcaggaagtaaagattaaaaggcagtacctggtttctctgctcagcagcagtcagctcctgttgcagcaagtcaacgacctgagcacggcccaccaaggattcttcgtgttcctcaagcttcctttgcagcaccctcaatttctgagaagaaaacattttagacataatatgctaacaaatgagtgcttgtatttgcttatctttcaaaatgtcatgtagatttgtatacttaaattttggggtgttgaaaatgacagtttaaagagtgggagaccagcatgccatgctccccccatccagcagcaacgaagagtctccaaaatgtcttctccagagcaccaacaacaaccagacccagacacaagcaagtccctgaattagggagtctctttaaaaattagaaaaaacaataacacatatctgccttcaaaatcatacagttaataacctgtacctagatagcataggtacatgtacatcttacccacccaagagaacattctctgcaggcaagaatcatttctcttctcctagtttcatgcactgggcaggcacttgaaaaaaaattgttgaataaataaagcaatgatacacatatacaattagtattctacttaataatatgttgtattctaaaactttatttagtggtgcattctgaaagattgcttagaacttaaaagtttccgttctaattaattctaattaattttcaatctaattaaacagatcaaacataaagtatcactgaagtgcctttcagtaccacaatgcactacacactaagtgaaataaaatactttgagttagtagatggtgaactcaaatacaatgaagccaattttcaaaatctactcaaatttttttaaaaaagaattactgatctaataaaagacttcatgtcttcaaaatcattctttgtcttctctaattttttaaatatttaaaactgacttcattgatttgaagctttgggttaggtgtgtaatgcacaaaggtagctataatcagaaaactgaagagaaaccaatttttgactaccacataaattcaccaactaaactcagcttttgagcaccaacaacctgattagaggggtaaaaggcaagaaaaggataagaaaaaataaataatttttatgcaacagaagacaaggacacaaaagaggccaataaggaaaacactaacaccaagtgaagagcagtgggtaagggtaggaaattggctgtgatggattaaatattaaccaaaatgacagtcattctaccgagttttagcaacacacctgttgcatctctgtttccacatctgcctgggttactaactgaagaagctcatcttcatgaagacgaacttgtgtttcaaagcgggcatctttctctcggaccacctgctgcatggaactcaactgaagacacataccagagaaactatgcaagttacactccccgaatattgcacaaataaaactcacagactactttccaagacagacactgagacttgatagtagctttttaaagtgaaattttgattgtcaaggatgaggatgttggaagagagataggctggacagtaactatgaaatgcgagagaaagcctattttcaaattcagaagttagcctaaacataaattttgatcaaaaattatatgttcatggttactagaaatgttttaaatatacaagaagtgtattttttaaagttctaaaaagattaagatattaaacacataaggtgaagttaagttagatttctattaaaccctggacacttcttgctcatggctgaaaagctttcagtaaaattctcatgccctataaatgaaaattcaaactaacatatcatttattcaagattctctacaactggaaataccaatctatctttctagtcttattttcaaagaattgcttctaccaaagaacctcatgtgcttctaaatccacaccacctccccagacagctgttttcagctgtcattacttgcagccttctagatcatgctcatttttaactggctctgaacagaatgaaatggaaataaatggactgatggtgagctgctcagtatcagtgcttctgtcttgtttttaggttgtgagtgtgtgcatctgcttattcatctccttaagatctatggtggagcatgctgcttagctgttagcttgcctattttgcattggtcctttactgctgatatctcagtttgtgacaccttgaatcaaactttggctttcttttttggtaggagaaaaacaaatcctcagaatgtttttattatctgaattgtgacctcactaggaatttggactcttgtgtttcaagtgtgtaggcactggagtctttcattagccaaacatctctaactcctttcccataactgttccatattcttttccttctctgcagttttgctcacaccgttccccatcactgaaatatctcccccagcttgtctggaatattatctatatatcatggttttgcctaaatcccaacttttccgtgtaattttccttaactgtcaaactcacagtaacctctttcgccttccaaaatattttgtttgtattgctgcttgctttggcacttattcggaaagccttaaattacgatgaatctcttaacacatgtatgtatcttggctttccatattttagcaacacataggttaaaaaccatattttgtatttcttcatcctgcactgtatatagtgcttatacataaaaaggacacaataaaaaataaataaaaaatttaaaaaggacacaataaaagctaataggtaaaaccaagaatttcaggatatacaattttaactgtatacatagcagtaggccaaccacagagagaaggcactactaatactacaaattattaataaagtaaacacctaatggataattagctatgtacaaaggtacttcagggaaaaaaatctttcatgattcataagcattcccccaccgctgcccccaccccccaaaaaaaattacagtgcctgtaatcccagcactttgggaggccgaggtgtgaggatcacttgaactcaggagtgcaaggcctgcctgggcaacatattgagaacctgtctcttcaaaaaatgtaaaaaatttagccagatgcagtggcacatgcctgtagtcccagctacttgggaagctgaggtgagtgagaggatggcttgagcccaggagactgaggctgcagtgagctatgattgtaccacttgtactccagcttgggcaacagagtgagacccaatttcaaaaataaatatgtgggagtgcgtggccaaccaagaaacctagaaaaatagaaaaagttgaggatgccaatccaaatggtctggtcttgacagatgaaaaaaatgggaagaagaatgtcacatactggtgccatttaacataaaatcacatgacctacaccactttctcattacaggctcactaagtaatctaactataatttatttcctattaagatagatattattttgggaaagaatgaacctaattatttttatttcttttggtttacttattggtctcttttgaactcagcatgagtccattcccaaaagactgaatctctgtctgctattaaaattaagtttctggacatgcagaactaagaaacagtcatcaattaggctatagaaaattcatcaaggtaaataacacattgtgaggttttctggtgttccctaatgacacacttacctaccacacatctcctaatctcttctactacatatccttctaatttctagtgcaacacccatgctactatacttttatctactaggattttttaaagtgactcactgaattgacttgtgcgtaataacccactggacttcatagctctttatcctaattttgtgaggtccctacctgtgcagcttgctctgcctgtgtctggctgagctgggcttgtaaagtgctaatgaattcttccttctcctggagctgttgcttcatcattacaaattcttccatctctgtagaactcttatcaaaccgaagacatagaaggaaaaaaaattatttaagcaaaagaatgagcattattaattctttgacctccctttcttgcttaacctaaatgcctaccatatttccttctagtttccattgaacccaaaaggaaattgcatgcattatcaaaattttatttgtcagaagaagacagaagcagtagtggcaatttttcaatttctctgactcctcacatagagacagcacaagatagtaaaaccaaaaaaaccacagataacatttacagttaaattaggcagaccgtcctaaaaaccctaaaatataagctaataaggacaaaccaccaaaacccacaagaactacattgtattagagtcttacattgtgtaagaaaaagaaggcagcaaaagagtgaaatctgatgggtctgagaaagggacagccctaaacagccaatgtatttatttgctggaatgaacagctggccaattttagaatagtggcagggctttgccattctttaatactaggtaaatgcaaggggtgcacagtaaggtaagaaggactaaaagggctagagcaatctaggccccctgaactctcacaactgactcatcatggctcccttctgagacatgaacctgtactaagaagaaactgcgaggagtgaaataaaaattatgcagaaaaggaattaaagagacagaagaaagaggtctacaaacgtattgtataattcagtatcaactagccacatgtggatatagagggcttaaaatgggtctgatagaaaagaaatatttttaatttttaacattatttaattttaatttgaaaactgaaatatagattatttttccattaagtacaactttgttttggcatgactatatttcatcttatctgttgcatcatgtaagttactgttgaggtgctgcacaagcaacaagtgtatatgcagttggtatcaatgggttgattcagtttaacatttttctagacccctatataacactgtaatatgtttatttgtatacttaatgcagacagcattagtaacagttgataccaatttaatcataactaataattaaattgcaatataaacatttattataattgaattattttccaagttcaaaaataaatatagacacatttcaaaatttaaaatgaaggccttctattgttgtatagttggttccttttcacttctaagtagtattccagtgtgtggatataccacagtttaaatatttccctattgatgggcatgtgagttgtttccagtctttaattattacaaataaacctattactattggacagtgctggcataaaccaagtgaagggcagaaggaagaaagccaggaaatctcagaaatccggctcccatatctttgaacacaacacaaaaacaatagaaaaaggaagtctgttaagaaaagctttcctgaatcaagcctccttccaaatagaggtttaggagaataaatttgacacaaaaataaggaacagaaaaggatgaaggtcatatcccatttaagttactattaaaaaaacagagtagcccccactagcaagaggaccctcaccagatgcagcctctcacccttggtcttctcagcctccataacttcttataaattacccagtttcaggtattctgttacacgcaagagaaaacggactaaaaaggaaaattggtattgacaagtggggtcatcgttgataatgattatttgaaaatgtggaagcagttttggaactgggtaatgggcagaggctggaaaaattctgaggaactagctcaaaaaaaaaatgcctagattctgatgagggcttagaagataagacaactacagaaagcttagcactccttggagattggttaagcggttgtgaccacaatgctgatagaaacataaatagtaaagcccattctggtgaggcttcagacagaaatgaggaacaaagtatcagaaactagagtaaagcccagccttgctataaattagcaatgaacttggctgaacttgtccagtttttgtatggccaagaactttgtagaaggctgagcttgagagtgatgaactagggtatatggcaggagaaaattttaagcagcaaactgcttgagctgctatgtggttacttctatctgcttacagtgaacagagaaaaagaaaacagagcaaaaaaaaaaaaaattggaaaatttgcaacctggccatgtggtaaagaatggagaagatttcaggatgggaatccaagaaggcacagccaccacttgctaaagaaattaacacggctaaaagggagccagtttctaacagttaagacaatgggaaaaagccctaaaggcatttcagaatgcattttagaaatctttaaggctgccccaacagcccccatcacaggcccaaagccctaagaggacagaatggtttctgtgaataggccctgagataccactgctctgtgccacttcaggatactgctccttgcagcccagctgttctggttagtgcaaagcagccgcaggtatggctcatgtcacagctcaaaaggtacgagttgtaaaacttggtaacatccacatggtgctaattctgcaggctcacagaaagcaagagctgtggaggcttggtagtctccacttacatgtcgaaggatgtcatcaatagccagggggctcaggcagaggcttgtcttgaggcagaaccaccacagagagccccactagagcaatgccaaggggaaatgaggggttggaattgccctgcagagtccccactagagtaatgcctagtggaatcacggtgtgggactaccactgccataccagaactatagagctaccagtgtgcaatgcaaagtcagcctgggaatgctggctggactaagcccagcaaagccatagggacagaactgcctgaggtcttggggacccaacccctgtaccggcagaggatgctgaaaatggagtaaaagaagattattctggaattttaaggcccaatgtctactctcttggttttcaaacttgcttggggtctgttactctctttcttcttgcctagttctcccttttagaatgagaatgtgaaccctatgcttgtcctaccattgtatcttggaggaagataatgtgtttttatttcacaggctcacagaaattggtgcaggaatgagctaagactttggggctgtggggatgcaattaatgtatttgtatgtgagaagaatatgagttttggagagccaagggtggaaggctatgatgtgaatgtcccctccaaaactcacgttgaaactgaatccccagtgtgacaagaggcctttaagaaaggactggttcaggaggtctctgaactcagcaatggattaacacattcacagattaatggattaatgggttgtcatagaaggggaactggtagctttataagaagaagagagacctgagctggcaaattagcacactcagccccctcactatgtgatgacttgcgctgccttgcgacaccactgagagccctatcagcaagaagaccctcaccagatgcagtccctcaactttagacttctcagcctccataaatgtaagaaataaatttatttaaattaaattaaatttctgttattataaattaaaaacaaaactaaggagcagaatgatatgattataggtgataaaagcataccagagccacactaaaaaaaaaaaaatcaaaattgcaatctatttcaaaaagtttttaaaaattaagaaaattatacaggccaggcatggtggctcacacctgtaataccagcactttgggaggcccaggcaggtggatcacttgaggtcaggagttccagaccagcctagctaacatggtgaaaccccatttctactaaaaatacaaaaaattagccaggcatggtggtgcatgcctgtaatcccagctactcaggaggctgaggcaggagaattgcttgaacctggcaagcagaggttacagagagctgagactgtactgctccactccagcctggccaacagagtgacaccctgtctcaaaaaaaaaaaaaaaaaaaaagaaaagaaaagaaaaaaaaattatacagagatgagagaaaaacataaatcagatttagaaaaatcagaaatgaggtgactgaactcatgaaaaatccaatagaaaagaaaaaatcattgcagtatagaagataaaaaaacagaaaaaacacaaaaacaaacaaaaaatagaaggcctaaagtgaaataaaacaacaaacaaaaaaacaaacttaaaatatgtgaaaccatatattgaaagagtatactgggtatctatgaataacaactaaaaatgacaaacaccaatgcatattctaataaaattaccagacaagaagaaatgaagaaaagaaggagactgatatatacatagataaatgcccattgtgcatctagaaaaatgtatttgtcacataataatccattggttttagtgattcattaacctaatgattatgaagtaacttccacccctacctgtgcaggttgttctgcctgtgcctgagtaagctgggcttgcaaagtgctgattagttcctccttctcctggagcttatgttttatcttttctatttccatctcttcctctgtagaactcttgtcatgctgaaaatgcaggagataaagtcattatttaaaagaattacaattaatatatatttgatattttcttctaatttttcatttacaaccatttagttataattttattaaactgatgggagcaagaaaaaccagctgatctaacaaataagaaatcttagggttgtccagtttttgtatggccaagcagttcctgttagacctaccctccctcacataatagctataaactgtgaaatacatacacacacacacatatatatatatatatatatatatatattttttttttttttttttttttttttttccctcacaccaagcatgtgaacccaaaactgtggacaatatagaaaacagctatctgaaaatactggagagcaaccaaaagcaggaagatactggaggggatgtgataattggaagaaatggtaccgagtttcccattttgacagcttttattctgagggcaaaaccagtcagtgccatgcaggactaaaccttaatagaaaacccgaagtcttgttgccttgaagaatcaaggagagagctcaggaaactatagctgttgctaagtgagaagcaacacatcagaaaagagccagtgaggggaaatccaattttttcaataatctatttttttttccaaaagctctcccttagactgagattctgcctctttgtaaatttagtccctcccaaccccctaaacaaagctatttctgcttactggaattacaaagaatacttttatactttcacataagtcagtcaagcacctgaggactgttgtcatttcttcaactatactttccacagaatacctagctctgtattgagtatataatagttaaagggttgctatgactgattgctgaaacttagaaatcatttctttaacagagaaagaaaatgaactctaagacattactgctttaaggtctcagagctaaaaatgaaattaaaaagcagagtataaaatggataatttaaaaatctgacatcatagctgaggagaagctggagggaacaaagcaatatgaggagagaggttggtgctaccacagtgaggggaagagaactgacagaggaaaaaccaaaaggaaaagaaggatcaaggtgaaattatttgagaagattgagaaaagcttttaaaataggcttcaagaagttaaataagattatcaattcagggaaagtaatgttctctgatcattaggccctgagaggaaagactaagcaggaactgggtcactaactagcgatcccaaaggttgtgcctagaaaactgattaaaatctcatttcccaagaactaaggatactagcaggtcaaagcaaaacaaaatgaaactaaaaaaataaaaagatttcttacacacggtgaagtctaggctcactctataactacagtatgcatgtgatatgcctgcctccatataatctgtatcaaactctccacaaaactgaagtttcttgttctctaaatagctgactgaatgtgaatatgtggagtttaaccatacaggaaagataatgaaaatttgagtactgggacaatattcctcacagggcagtactttccttattcctcctctgtatctccaaccttaaactgctttgttggctgcagtcataaacctagtgagcctcccttttagagagtcccaggtaattcagctgattcagcccacatgcatgaagctttaatccaccactatgtgactatatatgaggacacagaatattctgtgttaagtcattgaattaaaaagtttcagagctggaagaaaccttagagataatctagtttaatcttctaatcaatgatgaaactcctccaaaaggtatgtttccctcctctctaaatgcctcacttcagtacttatttcttcctgtaagccttttttaatccctgaaagtccaggtcacaactggcatttcatatccatgttttctgtacatctttcattctccctgtgtgtggcctacagtccagctgaactacaagctctataagaaaaaaaaaaacaaaacattatttagtgctgtatcattttagcatcctaaatgtttgtgattggtgaagatctgctgtattggtaggttttttcaacttaggaaatatacactacacccagtcaccataccttggaaagttgctcctctgactgaggttctgtaggcagaacagtccctccttgtgctttcatttcttctatgtatttattcaaagaagttaatttggccttcgcatgaagttttagttttttaattttgttatcagcagcttttctctcttcctgcccaaaaacaatgatggtaaatacataaatgtttattcccctcttatctagcacatactaaaagttatttttattattattactttcagagacagggtatctctctgttaccagggctggagtgcagtggcacaatcacaactcactgcagcctctaactcccaggctcaagcgatcctatctcagcctccagagtagctgggactacaggtgcccaataccatgcccagctaattttttttaaatttttttttgtggagacagggtctcactatgttgcccaggctgatctcgaactcctggcctcaagaaatcctcccatctcagcctcccaaaatgctgggattacaggtgtgagctaccacaccgacccaaaagttattttcagtaggcataaggttacagtactagggagataatcagattccctaataatctaagtggagacaaaaattaaagtgagtagtgtatcatctgtcctttatcaaatgctccacaagaaaggataaaaacaatagtacctgtagagcttcatctttctgctgcagttgaacatccttctgtctaataatatcttttagctccaccaccaattgctctgcataagccaggcgctcctgaacatcttcttgtgtagtattattaaattccatgtcagattcttggtgtaattcctaatatttaggaaaaaagttgccagtgcaccaggaaaaggtattagcttcccaacaggagtttcttcattccaactttttatgttttgcccaattcatattcttgttaacttaagaatctaactctgatccaataataatcattatcatagccattacaatatattaagtattttataaatgttaagcattttacaaacattatcccatttaaggtattattatcctaattttaccaaagagaaaaataaaggaaagcaaaaatcataaaccagtaagggtaaaaggccaaaagttaaaattaagagtagttaagtaaaactctcttaaccactacgcattacttcttgtcttttcagaaaactaagaagttttattaattccttatgtggacttcagaaaatataatacatactgccaatttgtatcatcttaaaaaaaaaagaaaatacaatacaaactataggagaagtggtaaatgaaattacaaagcaaacagatattctgaaacccaaaaggtgttccagtttcctcatttgtcacttagacctttcctgtggaaaaggaatagccaaggatgagaacaaaggacttaaaacactctggcaccaaacaaggcccagggagacaaatgagaaagccctttcaaattgtatccaggacttgtttcccatcactgtggcttttaagctaaaaacttacaagagaaggatcacttataaaatttcaatatttttcttaatcctcgcttcacctagtaccagggaggcttcgcacacccttctatcttaaattattttccttagaagaacacagaacatatgtcttaccagtttaaatcagaacagaactactcacagggtctaggggagccctcatattctgatcagtgtcatcatctcctgataattcatgcaaaacaacatttgctaatcctgataatcggctcagcatttctgtaggaaaagaaggggggaaaaaacctaagaatcagcaaaatgaacataggcttctcctatattgataaccatatcatccgtgaatgaaaaaagaatactgtacaggtgatttgtattagacacagtctgcagcacaatgatgtcttcaaaaaggcatttgagtacttccagtgtagtcacacgctgttcttttcagtggcaattgtacagaggttatcaccatcactaacaccatttctaaaataaaatgtaagtacctaatcgttaaacattaatacaatgttaaataccaatctataattgttaaatacaccttaaaggtagtttttatctttaatgcccttctttcatagtagtttcacttacaaacatgaatttcttttttctttttctttttttttttttgagacagggtcttgctctgtcacgcaggctggagtacagggacgcaatctcagcccactgcaacctctgctttctgggctcaagcgatcctgccacctcagcctttcgagtagctgagactacaggcacatgcccaaacatgaatgtcttattctttcttcctctgtcagactgttattctctcccacttgttcaaataaactccatgatactgcaacatttttctttttatgtgccccatgaaccccattctttcagaaagctttcttgataaaccatgtggctttgctaaaatttaaatataaactttgttcaaaatgtacagcattaaatgcatatattagaaaaggaggaaggacagaaatcagtaacctatgattcttctatagaaaattagaaaaagaagaacaaattacagccagtgtaagcagaaaaataaaaataaaaatcagagtagaaattaataaaaatagaaaaatagagaatatcaataaaaccaaaagttgattatctgaaaagatcaataaaattgataaaactctagtcaagatgaccaagaaaaaaacagagaagacacaaattactggcatcataaatgaaagaggaaacatcattaatgatctaacatacattaaaagataataaacactacaaatagccctatacttttaagttcatccatgtagataaaatgggtcagttcactgaaagattcaagctaccaaaagctcaagaagaaatagagaacctgaatataaatgagtagatatgtgtgggtgcatgtgtgtgtacagacacacacacacatatatatacacacatataaatatgaaattgaattcatacattaaaaaccttctaaaaaaagaaaactccagatcaaggtggcttcattagtaggtaacaagaaacatttaaggaataataccaattttatataatctatgccagaagatagaaaaggaaggaacaccttctaacttattttaccagactagcattgccctaatactaaaagcagacaaagatattacaagaaaactaaagaccaatgttcctcatggtcacagtcaacaaaatattcaaatagtccataaaatattagctaattaaatccagtaatatataaaaagataatacatcacaaccaagtggggttcaagaaatgtaatgctaattcaaaatatgaaaatcaatgtaattcaccatattaacagactaaataaggaaaaccacataatgtcaatagattgagaaaaagcatttgacacatttcaatatctattcatgattatgaattcacaataagaataattcattctcagcaaactaagaagtgaatttcctcaacctaataaagggcatctttaaaaaacttacagccaacatcataattaatggtgagaaactgaatgttctcaccatatgagaaacaaggcaaagatgtctcttactacttctatctaacactatactggaagtcccagccaatgcaacaagcaagaaaaagaaaagaaatacaaattggaaaggaagaaataaaactgtctcaactagcaaaatgattgtccatgtagactttccttaaaaaacaactcctagaataagtgaattcagcaaggttgcaggatacaaagtcactatataaaagtcaactgcaggccaggtgcggtagctcacgcctgtaatcccagcactttgggaggccagggcgggcggatcacgaggtcaggagatcgacaccatcttggctaacactgtgaaactccaactctactaaaaatacaaaaaattagccgggtgtggttgtgggtgcctgtagtcccagctactctggaggctgaggcaggagaatggcgtgaacccaggaggtggagcttgcagtgagcctagattgctccgtctcaaaaaaaaaaaaaaaaaaaaaaagtcaactgcattcccattacaatgaacaagaggaatttgaaaccaataagaataccatttacaacagcactgaataaacagagcaggacttgggtaaacagctaacaaaatatatgcagaatttgctgaatgctgaaaactattgaaaacccgaggaagacataaaaaatctaaataaatgtagaaataaaacatatacatgtatttgaactctataatgttaaagtatcaattctccccattttgacctataaaattagtgcaattccaaacttaatcccagcaagcttttagtaaacatcaaaaagctgactctaaaacatatgaaaaggcaaggagtgtggaaattactcactacaattacaagacagggcagcactggtgaaagcatagacacacagataaatggaacaaaatggagagcctagaaatagacacatacaaatcgagtcaactgatttttaacaaaggtacaaatgcaattaagttgagaaaggacaatcttttcaataaatggttgtggaacaattggacatctgaaaaagagtgaaccttgacatacaactcacaccttatacaaagcatatctcaaaatggatcagagacctaaacttaaattgtaaaggttttagaaataaacataggagaacatttttgtgacgctgaatttggcaatgagcttttagacaccaaaaaagcacaatatattataaaaaatattgattaaaaatttatcaaaacatacaacttttgctctgtgaagacaaggttaagaaaatgaaaagacaagtcactgaagccaggcgtggtggctcacacctgtaatcccagcactttgggaggctgaggcaagcagatcagttgaggccaggagttcaacaccagcctggccaacatggcaaaaccccacctctactaaaaatacaaaaataagctgggcatgatggcgcatgcctgtagtcccagctactcaggaggctgaggcacaagaatcggttgaacctggaaggcatggattgcagtgagctgagatcatgccactgcactccagtctaggcaacagagcaagactctgtctcgggaaaaaaaaaaaaaaaaaaacaagtcatagattaggagaaaatatttacaaatagcatatccagtaaataacttgtatccagaatctaaaacaataaaaatatcttaaaactcaacatcaataaagtaacacacctgataaagaaatgtgcaagagatgtgaatagatacttcaccaaagaagatagatggatggtaaataaatatatgaaaagatgcttaagttaatctggcattaggaaaatactcattaaaagcaaaatgaaataccactatctacctattagaattgctaaaatatgtattttttaatgctggcagggatatagagcaacaggaactttcaatgcctgcagattagaatacaaaatggcacagctacttcggaaaactgtttgacagtttctttaaaagttaaacgtacatttaccaatcccactcctaggcatctaaccaagtttatagtaggtttactcataatcacagattctgaaaatagccaagatatccctcaacaagtgaatgaataacaaactgtagcacatccaaacaatggaatactactcagcaaaagaatgaacaattgattcacacaacacaatacttaaacctaaaatgccttttgctacatggaataagctaaacattaaaagatatacatcatattattctatttatataacattttgaacaagtccagaaattaacccacacaaatatagttgtcagggcttgagggaaggagatgtggctgaatataaaagagcaacacaagggaatttttaaggtgaaggaactgttctgtatgatcttgaagtagtaaattcataaccatatgcatttgtcaaaactcactgaactgtacattccaaagagcaaacataattgtatacaatttttttaaaacctcagccaggatgtcaggagttccaaaaatggaatgcagactgtgacaaatagatctaactatattataaatatatgatataacctcactgaaggagatggggctaacctaagaaacaaaaatggtgttttgactgggtactataaggataaagacaaaaagaactgacataaacactgtactctgcttggtaaatttctttctcacagtggtatgggttagcaattctgaaactacttcattgtacactagggttaaatgagtaagtaaattgtagataatgagattcaggttttttactgtcagtgaaagaagttacaaataaggcaagaaagctaggataaaccccatggtactggattagagtcagagatatcagtatgaactcatgtttattttaatatatatgtaaatagataaatgcagaaataagtatagatatgtatgcattataaataatcagttattacagagaaatatatattctagccgtgtccactgaaaagtcctagaaacagtaacacctcagtagcaatgagcgcatccagatctcgatttctaaattgccaatctccaataaaaggaactagggctccttggagaaatggctgcctatctagggttggggcagagagccagaaagtaaggaagtgttcaaaaaagaaaaagaaaaaaaatggggtatgtgaccaggagccaatctgaaggagctcccaatgatcaaggctagaataatttgagtcacagaataaataacaataatattggattatatggattataacccaaataaaaaattaaatacccatcagtcaatactgatataaataaatcattaaataaattaatggtagagacaaatcttccttacaaaagaattccaaataatttatgtagatacgtccccctctaaaaatggagcttaattccctctccttcagtataggctggacctagtgactcacttccaaagaatagaatatgaaaaaagaaaaacagcaacatcagagtggtgagacttggcaaccaccacctcaaccaagtgatcaagattaacatcaccagtgataagtcatcgtaatatcatgtaacccctgatataatgtgatgagaagggtactttacctctggggtattcttctgcaaaacccgtaagcccagtctaatcatgagaaaacactgggaaaacctagattcagggacattctaaaaatacctgaccaatactcttcaaaactgtcaaagtaatgaaaaacaacaaaaaactaagaaacagtcacagattagagaagacaaggagacatgctgattaaatgcaaagtaggccgggcacagtgtctcacgcctgtaatcctggcactttgggaggccgaggcaggcagatcacttgaggtcagtagttcgagaccagcctggccaacatggtgaaactccgtctctactaaaaaatacaaaaattagccgggtgtggtggcatgcacctgtagtcccagctattgggtagtctgagatgggagaatcacttgaacctgggagacagaggttgcagtgagctgagatcgcaccactgcactccagcctgggtgccagagtgagaccctgcctctaaataaataaataaataaacgcaaggcagtatcctggattaggttctgaaacacaataaggacattactggaaaaaatggtgaaatctgaatgaagtctacctatagtttagtttatggcattgcacctatgttctctgttttgaaaaagctaccatggttgtgtaaaatgctaacattagaggatgctttgtgtatacaataactgtctgtctaatcttcccaagttgtatgtaaatctaaggttattccaaaatcaatttacttttataaccactgtgtaggctacatattcagatcagtgtcaactgctagtccataaagtccatgaaaatgagaagcatattaatgctttgataggaaaaatcaaaatagaactggactatgcatagcattagtttacgtgattatgcctaattttacattttgtgataaaatgttatttggcttttaaaaccctcagcaggggccgggcgtggtggctcatgcctgtaatcccagcactttgggaggctgaggcgggtggatcacgaggtcaggagtttgagaccagtctgaccaacatggtgaaatcccgtctctactaaaaatacaaaaattagccgggtgtggtggcacgtgcctgtaatcccagctactcaggaggctgaggcagacgaatcacttgaacctgagaggtggaggttgcagtgagccaagattcgcaccactgcactccagcctgggcaacagagcaagaccgcgtctcaaaaaaaaaaaaaaacctcagcaagaagaaatataaaaactattgtacaaaataaacacttaaatgaaactaggctctgctacagttttcttctactggggataataatagtgtttagggcagccatggttcttaagaaagaagtgatgagagatacctgtttttttaatagattgtcttgggtaatctaagtagcacatcacttggaaaagatacgtgagacagaaatagaaaaagtgaactgttccctaggaaggcagcgcaggatcatatataacttcatatctaaatactggaagggcaacacagtgtcatacatgagtacatagggccatatataactatttattcaagatatgagaaccacagctatagtcaggattaaaaaatcacaattcagcagtatacagattctaaactttcttttcaactttagagatcatattttctttggttaacttttaatgaaggaaatgaataccatcactaaagagtttcttaaacatatagatttctgctaatcaaagaaaatcataatggaacctaacttatcaaacagaatcactttatcttcagatttttcagaccactttggaacaaagaaaacaaaataaccaactgatgggattctgagaagatgggagtagcaaggggccccatggattttgtatcttcctttattcccacataaaaacagacaaagcaactaggtaacaaaagatccatggacagcctttaccaaaaaactacttaacaaagtttcctacaaaccccaaaataaacgtggatatagacaaaccgccaatagtcaaaagatctgggtgtcactggtgttcaactgggaggaaattgagggaagccagaggagtacaacaccaagaggacctcaaaagagccagtgggcattcactggcaaatgcgccaagccaattacagaacagtagttgatacaaggaggggtcttcccattccaataacaggtacctgccaggggcctacgagggctgaaagagctgaggcagtctggacctttattaattctcagaactgaagagttggggctctcttccaggatagggtcccacactgaggagaatctgctgagaggagaattaaaattaagtgactaaggaaagaggaggtccagataaagagcaggtgaaagtggcaaggaaagaaaggcaggaaatccgagaaatccagctgccatatagttgaacaatgtctgaaaatagcacaagaggaaaccttatcaagttagaaaagctgtataaaatctctttctaaaagttcagcaacactaaattcatattaaaaatgaactactgaggccaggcgtgctagctcatcctgtaatcctagcactttgggaggctgaggtgggaggatcacttgagcctaggagttcaagactagcctgagcaacatagcaagatcccatctctacaaaatttttttaaaaagtcagccaggcatggtggcacatgcatgtaggtccagctattcaggtggctgacgtgggaagactgcttgagcccaagaggtggaggctgcagtgagccataatcacacccctacactccagcctgggtgatagagtaagaccctgtcacaaaaaagaaaaaaagagcaactgaaaagtctcacaattcagatacattactagaagaaaaaaaaggaggaaaacgatcatgataacatcccgacagaaaatggaagcacgtcagagagccatgctcaaaaaaacagttcaaaactataaccacttaaatctactgaaggaactaaaaggcattaaaaatgacataagatgtgaaaaaataaacatcagaaatagaaaaacccagaaataaagtgaaaacaagaagtgactgaaaaatttaaaaaatcattttggaaatgaagatgaaactagaaggaacaagaaaatgagtaaatataacaaaccatgtcattaaaaaaaagcaaagttgaaatgaaggataattttaaaaatcaaaaagaaatgacctaaaaaactagatatgcaactaccttatgaccctcaattccactccccagcatttatcttagagaaaagaaaacttaagttcacaagagaacctgctgtatataaacattcatagcagctttatttctattaatagacggttaagcaaactgatatatacaggcaaatggttaaacaaactggtacatacatcccatcacatacttctcagaaataaaaagcaacgaactactgatggacccaacaacttagatggatctccagaaaattacattgaatgaaaaaaagccagtcccaaaaggttacatattatacaattccatacttctataacatttttgaaatgacaaaattttagaaatggaggaaagatgagtgattaccagtggttagagaggggttggggtgggaagtgactgtggtcataacaaggcaacacaagggatccttgtggtgttgcagctgttcaatatcttgactgtggcagtggatacaggaacctacacaggtgatataacactgcaaaacttaatgatacacatacatacatatacaaatgaatatacaagtaaaactggggaatatatctatctcaatatcctaattgtgatattatgtattagttttgcaaaatgttaccactggaagaaacaacaaagtgtataaaagagctctgattatttcctacaactgcatgtgactctacaattgtcttcatatttaaaaaacaaatgaaaaagaaatgaactaaatgcaacatgatatcctgaattgaatcctggaacagaaaatggacattaatggagaaactggtgaaatgtgaacaacgtctggagttcagttaatattaatgtaccaatgttggtttcttaattttgtacactgctaatgtcacatgttaatcttagggaatactaagcaaaggatacaccagacttctgcactatctttgcaaattttctgtagtaaactttctgtagtgatctgaaataattcctaataatttgtttatttttaaaaaatgtaagaaattaagagttacataggatttgcgagaaacagataaatattgaagataagtaatgtgaataacaggattccctgaagaagaaaagcaaagcaaagaaacagcacaaatatgaaaaaccataatccaagaatatttatttgaaaattttttttaaaaagatttgaaactacatcttgaaagagcccacaatgtacctcagaatgtcaactcagaatgaccaacaaaacactctagtaaaattactggacttaaaaaaatcctttaggctttaggctaaaagatcatatgaccagtaagataaagaaaaaaaagcactagatttttcaacagcaatgtttttgccagaaaaaaaaaatgagttacaaatttaagatattcaagaaaagaaaaagtgagccaaggattctatttctggcaaacacaaactttagatataaaaaacacagacaaaatgttatgaacgagcaagaaaattcatgaaatatgaatattcccttaagcctttcctaaagaatttactagaggcaaaacttgaggcaatccaaatgactaaagaaacatcattataagaactagtggtgagcattaaatatacggttactaacagaattaagactaagtaaagactggaggagagacagcatagtatgtaatgattatatgctctgacaatatataggacaaccatgaaaaaaaatcgggaagaatgtgaatagcatatgcaaaaaataaaaaatatttttaaacagttttcaataattaaaagtggttgttgtctacggccataccatcctgaacacacccgatctcgtctaaagtggttgtggtggtgatattcgtatcatcactcctagattactatatgtgaaatgtagaattaaagcaaatgataattatggatacactaattctgtattttcagttatgaaaagaagatacagatgtaatacagaagaaattaagaaccccgaaatacaaactaatctttgaatctgaataggaacactcagtgtgaaatgacaattcagtattttatatttgttcacatattttcctagctctgtccaccaaaaaggcttaaaagtaatgacaaactgagaagcaatgaatatctctagtgcctagattggggtcttgaaatactctttcccatttttaaaaaagtttttaaaagaaggttttcttagagaaatggctaattccatttctaaagtggaaatgtacaaaatgatcctgaaacatcttgtcatacaagataggaagctttcaaaggacacaggttcccattggctaaaaggataatttgaatatgtatgaataagaattacagcacactgggccatactgtccaaggtaatttatagattcaatgccatccccatcaagctaccaatgactttcttcacaaaattggaaaaaactactttaaagttcatatggaaccaaaaaagagcctgcatagccaagacaatcttaagcaaaaagaacaaagctggaggcatcacgctacctgacttcaaactatactacaaggcgacagtaagcaaaacagcatggtactggtaccaaaacacatacatagaccaatggaacagaacagagccctcagaaataacaccacacatctacaaccatctaatctttgacaaacctgacaaaaacaagaaatggggaaaggattccctatttaataaatggtgctgggaaaactggctagccatacgtagaaaggtgaaactggatcccttccttgcaccttatacaaaaattaattcaagatggattaaagacttaaatgttagacctaaaaccataaaaaaccctagaagaaaacctaggcaataccattcaggacataggcatgggcaaagacttcatgactaaaacaccaaaagcaatggcaaaaaaagccaaaatagacaaatgggatctaattaaactaaagagcttctgcacagcaaaagaaactaccatcagagtgaacaggcaacctacagaatgggataaaatttttgcaaactacccatctgacaaagggctaacatccagaacctacaaagaacttaaacaaatttacaagaaaaaaaataacaccatcaaaaagtgggcaaaggatatgaacagacacttctcaaaagaagacatttatgaagccaacagacacatggaaaaatgctcaccatcactggtcatcagagaaatgcaaatccaaactacaatgagataccatctcacaccagttagaatggcaatcattaaaaagtcaggaaacaacaggtgctggagaggttgtggaaaaataggaatgcttttacactattggtggtagtgtaaattagttcaaccattgtggaagacagtgtggcaattcctcaaggatcagaactagaaataccatttgacccagtgatcccattactgggtatatacccaaaggattataaatcatgctactataaagacatatacacatgtatgtttactgcagcactattcacaatagcaaagacttggaaccaatccaaatgtccatcaatgacagactggattaagaaaatgtggcacatatacaccatggaatactatgcagccataaaaaaggatgagttaatgtccttggcagggacatggatgaagctggaaaccatcattctcgccaaactatcacaaggacagaaatcaaacaccgcatgttctcactcataggtgggaattgaacaatgagaacacttggacacagggcagggaacataacacactgggacctgttggaggttgggggctggggaagggatagcattaggagaaatacctaatgtaaatgacgagttgatgggtgcaggaaaccaacatggcacatatatacctatgtaacaaacctgcacgttgtgcacatgtaccctagaacttaaagtataataaaaaaaatacagttaatcaaaattaatacctctaggaatacaaattataaatacacatatttccatggaaaaattataaaataagtcaccaatgctaaaacaccagaaatagttgctattagaaaactttaccaaattgtcaaaaatgagataatctaagtgctacagaagttgctgtttatattgctccaaaacatagaaaaagaaaatgaaaaattacaaaccatctccctatgaatactgatgacaacattctaataaattttaattagaatattaaataaaatattagcaaactaaatctgactagatactgaaaaatattatcaccaagtggatttattctagtaattcaaatatcattaattattatgaaatccattatggaaacccataccactaccacatgagtttctgattgaccctccctagaaaggagcgtgcccatcagcatcctactgaatatcattgaatatcatagcaaatgaggaacacatacacatgaacacaggataataatgataatattaatggcaacaattgagaaacatttaatttaaatgcaaagtgactgtaccactttatatactctttaatcttaacaaaatctgtaagataagtattatcatcatccccattttatagagggaaactgacactcagaaattaagacatttcaaggtccctcagttaaatatataatacaatagcagtcaggcagggtggctcacgcctgtaatcccagcaccttagaaggctgaggtgagaggatggcttgagctcaagagttcaagaccagcctgagcaacatagtgagactgtctctacaaaaaaaaaaaaaaaaaaaaaaatttaattagctgggcatactggcatatgcctgcagtcccagatattcgggaggctgaggcaggaggatcacttgagcccaggagtttgagagtgcagtcagctatgatcacaccactgcactccagcctgggcaacagaacaagaccttgtctcaaaaaaaaaaaaaaaaaaattaaaaagattgatagaataaaacaaaaagctatttaaaggaaaaatagattacttttctcacataaccatttaaaaatatgtacattttaagaaaggaaagactaatatttaaatgagataaaaatctgagagagtgctagagatgtactgttcaggcaggacaaaaggagtctctcatagattgattcaacagtctcagagatccacaggaaagcaggtgacatagtgggaagagcaccaaactggaagccaaggaactgagttttccgtcctggctcaataagaagctgcatcatagtgagtaagtcaccttaaagcgtcagtttcctcatcttaaaatgaagactaacaaggaccattctaatgccccctactctacagctgttgacattaaaggaataatctggaaatgtaaatggaagggcatctcacccacagttgtaggcttttggtagctcaaaggttgggaactacagggcaagaaagccagtaagtagccatgcttaagctaaatgaagaaagatgggtactcccctctattaggctcactgaggacagaaatgggcaaatgtatagataaaaattaataaaggggaaaatattcatagtcatagtcataaatctatgtatgtatatgtatatatacatatgtatacgtgtatgtatatatacatatgtacacgtgtatgtatatatacatatgtacacgtgtatgtatatatacatatgtacacgtgtatgtatatatacatatgtacacgtgtatgtatatatacatatgtacacgtgtatgtatatatacatatgtacacgtgtatgtatatatacatatgtacacgtgtatgtatatatacatatgtacacgtgtatgtatatatacatatgtatacgtgtatgtatatatatacatatgtatacgtgtatgtatatgtatacatatatgtaaagattaataaaggggaatagtcatattcatagtcataaattcatgtaaggaatatgtatgactgttggacaatgttcttgctgttattttataaggcaccaaaataatgaatagcaactaaggaaaagaataaaacacagagcttcatgccaaggccagggattccataaaacactaaggcaaataaaacaattcctcagtctatgctggtcacagctttcacaaaccctgccacaggaccttaacacttatgtgttgaagtggcactcagaattaagtaagttttattttctccaagtcttcactgttatcaatgattattcttataacaaccacctggtgttcagcattatgctaggaactataaaaatataaaaagaattataaagcatgtccctagccaccgaaaacagaacaatatgcacaggaaaataagcaaaataactgaagacagtgagtgcatgcctgtgtatatatgcatatatgccatctactttggaatttaaatcacattttcccacagaaacacagagaaggtggttaggtttcagttgaggtgactcctcaaacttatttcatgcttatttagttaagcctcagtagctgtccttaattccttaaatctcaaagtgattttcaaccaagttgaggggctaatgggtagtgctgtatagctggaaataacacattcgatattatgacataattttacaattagaaaatgaacaactatttttcatgatgcagaagccactattttaattaaatgaatttgtaagtggtagctataacatacatacacagcgtgacctgccaaacactgctccaatatctttacacataacttacttttcgttatttaactcactttatttatttatttatttatttatttatttaatgttatttattttgagacggagtttcactattgtcgcccaggatggagtgcagtggcgcgatctcactacaatctctgcctcctgggttcaagcgattctcctgcctgagcctccccagtagctgggattactggtacccgctgccacgactggctaatttttggtatttttagtagagacaggggtttcaccatgttggccaggctggtctcaaactcctgactccaagtgatccactcgccttggcctcccaaagtgctgggattacaggcatgagccactgcgcccggcctaactcactttattcttaaaacaaccgcaagagggagtaccgtcaatattcccagttttaaggtgagtaaactaaggcagagggatgttaagtaatttccccagtcacatagttcgacaaagcttcttggtgggtgaagatacacagaaaatattttattttctgaataatctcattatccaatattctttactcgggttgaaaacagaatgaagggataaaggcactatgttaatagttaggtaagtacttttttttaaagcagtaagtaaactaaaatgattcatattagtatggccccaaataattccatattgtttataccacagacaggttcacacaagggccctaagatatatatacatggatgttatatatatatatatatatatatatatatatatatatatatatggatgttacataacaaaacatgttatgtatggatgttacataacaaaacaaaaatccatgtgtgtatatatatatgtatatatgtatatatgtatatatatgtgtatatatgtatatatgtatatatgtgtatatacgtatatatgtatatatatgtgtatatacgtatatatacgtatatgtctatatacgtatatatatacatatatacgtatatatatgtatatatatacatatatacacatggatgttatataacaaaacactacagcagtgttttgatggctaatgactgaaaatctaaatgtccatcaatggggacaggctaaatactatttttatatttttacaaaggactgctgtgtagccatggaaaggatgaggtagttttatacccatggatattgaaagtgcctaatatacagtactaaatggcaaaagcatgtgtattaggattccacttgtgggaaagacagaagggggtatatattatcatgtgctttattatgatcagaaagtttcttaaatataaccaagaaattatttacagtgcttacttctgggaagtggggaatggagatgggtagatcagtagatagaaaagaaaaagactttttttacattgtatccttctgtattaaatttccttttatcaaaagcatatagctgattttaaaatagcttaattaaaaatacagcaatatagagcttagtctccttttacataatggtttctaaccacagactggtatgtaatgatcagtggtattcctaatagtaattaacctagagaaattaatgaatgatttattttataaacaaggataaagtcaacatccctttaattaatccattaatcaaagggagaaaaagaaagggggcctataaaactcaagcagaaggttgaaaaaaatcttctaaagatcatgtttaagaaaggctgcatcccagagtctggatgccagaaatgccaacgaccttcttgaaaaacaaggaagtatctttacgtgattgtcaaattgggttgggaggtcccaaggtgtggacaaggctttttaaaaacttcattcttttacgtttatacttttgcatatttcatattatacacaacatatttacagtggtagtcatacactataaataattaaacacacaacatttggggagatgcatgctcaaaaatgttttactgatagggagtgcaattaaaaggtttggaagctgctgaggtagtaaaaaatattgatgcagtgaaaagaaaaacattaaatggtcattctgtggtcaagggatgagaagtaaaagctatgaagcagttaatgtacaatgcctgcaacttttgagtactcttcaactttttcctgcatctattccaaaaccaaatcctgccatttttccaataggatatttcctgagtttgccccttcataaccattctgaccatctaaatcttatcaattcacgcttttggaaaggcctctggcccttatgtaaagagccctccacttgcttgcatcttgcacagaactgtaaaaaggtcctttaaatgctcagacagcttccaactatctccaaaagtgaaagtacttacccatgattgtaaatatccctgtcccactctcaaactgtccgctccccatagaccaactggagctctttaaataagtcagacaaatatattcctcattcctcaaaggactcaccctccctttcacattccggttgtgcagattaaacatactccacaccatcaaaccaagttatttttcctcgagaactctcttagaggttcctttttctctaacagcctgcccacctctgattcctgggattttcgtgttgacgggatcgttgggatctttcctctcttctcatctttccagtaacccattagcattagcaggattattggacaggcctccgtttgcattaatatctccaatgattctgtgatctccgccctaaagacctttgatttcttttggtcgcgcctccccttcgggacaccaagtttgtttagggcctgagcacaggggcccagcaggttctttccgacgtcagcggctgcgtacggaggccgacttaggcaggccgctccaggaacaaggccgtgcggacaggactgacctaggcgcttttccccgtcgctcccagaggagaaacgtaccggggaggggacagaccgtgagcaagtggtccaagtctgcgcagggtgaccccgaaggcccaccggagaggccgaggcttgtgggctactagaactaggcctggtaggtgaaggaggcgggtgaagggccggatccaggactgaatccgggagaggcggggcgaggaggggactccggtgtagctgcttgggcagctcccgcggcccctctggcgggggtgaccgttattggactcgcagagggaagagttgggtagcgtcccctactcacctagaagcgctgccgcctgaggctccagctgcccccctcccaattcaagccacgtcagctcgggaagcccgtacgcgacaccttccaccgccgcgccccgccagggactcagccactagcagttgggacggaagat

SEQ ID NO: 1733 - DNA, 86569 bp, Homo sapiens; identical to SEQ ID NO: 1732

SEQ ID NO: 1734 - DNA, 86569 bp, Homo sapiens; identical to SEQ ID NO: 1732

SEQ ID NO: 1735 - DNA, 86569 bp, Homo sapiens; identical to SEQ ID NO: 1732

SEQ ID NO: 1736 - DNA, 22645 bp, Homo sapiens
gcttcccatacggcagtggctgggggagagtgatggagagaaaggctaagctaaggtcaaagaaagtggaggaaggctggcttgtcccgctggacttgacggcggagctgctgcaatctcgcgggctgggcccttgccccgggtggacccgagtgcctgcggggaggcgggtgtggctcccccgggaggtgacagctggcggggcccgtaaggagctggtctgctccggctcccctctcgtagccggcgccctgggaccagcgcgtgagcacgtctcggaggagtccgatgcgctgggcagggccgggtggtcacccccgcccagcttccaggggtgactgtgcctctgacgtcagacggtttttgggtcattccctggcacggggactttattttcataacagcatgaagtgccgtggaactggaataggcgtgtcctctccctcgaccctccccctccttgtccctctgctcacccctcgctcgttccctccctccggcgagggccgcctttataacaactgctcagagtgcgagggcgggatagctgtccaaggtctcccccagcactgaggagctcgcctgctgccctcttgcgcgcgggaagcagcaccaagttcacggccaacgccttggcactagggtaagtgaggcgccaggagcccagagcgctggggcctccggatttaaatcgtctggggagagcggggcgttgggaggggtgggatagaagaggagagaaatcctggtaatggaatacagttggctatgagaaaaaaattccctaggaaacagttcctctagtttaacaactcagatttttttttttttttttcccctttgcgggtttcctaggctaagatagaggcagagagcaaagagataatcagggtaatagtttctgctcggacacattctacaaactttgagtagatggaatccggccaggcaggaggtgagcagctctgggatcactctgcaggaaaagaatagagggagaaagatctcagaggacccgaaggtactgggagtggagggggagtgggaaacaaggggcaggggcaggagggaggacacggtgacagctactattttacccagatgctgcaaaaagcccttctgagttttgggaattagatctagaagcccatcccttttctcttgatgtgtgggcggtcagttccactctggtgtgccttgagttgctcagaaacctgggacagatgaaagttgaatgtgcgctgagagtgcaccttccactaccgactttatggataggatttgggaatagcatagatgctgttccatctggtcccttaaacatccatggggaaggctggcaaatagctttattttattttttgagatggagtttcactcttgttgcccaggctggagtacaatgttgcgatctcagctcaccgcgacctccacctcccgggttcaagcgattctcctgcctcagactcccgagtagctgggattacaggcatgcaccaccactcctggttaattttgtatttttagtagagacggggtttccccatgttggtcaggttggtctcaaactcccgacctaaggtgatctgcccgcctcagcctcccaaagtgctgggattacaggtgtgagcccccgcgcccggccacagatagctttaaacatccatgggaaaggctagctaacagctgaaacctgctcagaatcaaggaatttgaaggactttccattcctgacttctttccattcctgattgtctcctcagaggcttgtgtaaacaccacacctgttgaagggttcggccgaatcagccactgctgtgggttcattcctgaaggggaacacttcagctacttcagacacaatgggctagggaccacgggaggggtgagggcggagggggcacacaccctccaggtttgcatgccggtgtctgctaggtgagggaaggaatgaggggaaggaagggccgggagaggcgctacgtgggaaacaagggacctctccaagggcgtggagaggtgagtgcctcaagggcagaatggaatgagcagaaccctttggtttcccgggaagagctctcaaccttgagtcaggaagactgatttctcctcccagctccgcaggaacatggaactgtgatcaggcaaggggctgggcctgagttcctcataggggtcttggggaggcccccagtttcccctcctgtgtttcgattctggcccctctccatctgcacacgtcgccttggaagttccctttagaactggcttttttgtattctagtcttgaatggtaatcgaagacaacagggtatgaagaacaattttgacggcgtgattttattcttctcattctgggtccactactatttaaagtcccaagattaagctgaggaattaatatggtggtatagtaaacaataaattgaggagtatttttgcttgaggaatctttgacttcctgagtagttcagggtgtttgcttcttttattctcatttttattgcactgtggtcagactatatggtctgcacatttcttattttctaattccagatttgtctttgtattctaaatatgctcatttttggcaaatgttccatttggaccatggaccatagttcctattaagcaatcataatagagtagagatggcaaactatggtccatggaccaaatatggcctatagcctctttctgtaaataaagtgatttttgttttgttttgttttgtttttgttttcgtttttttgagatggagtctcgctcttgcccaggctggagcgcagtgacgtgatctcggctcactgaaacctctgcctcccggtttcaaggtttcaagccattctcctgcctcaggctcccaagtagctgggattacaggcgcccgctaccacgcctgggtaatttttgtatttttagtagagacagggtttcaccatgttggccagactggtctcaaactcctgacctcaggtgatctgcctgcctcggcctcccaaagtgctgggatcataggcatgagccacaacctgtaatccactattttactaaaacacagcaatgctcatatgtttatgtatcatctatgctgctttcatgctacaaatgtgtggcttgcagagtcttaaattgcttataacctggccctttatagaaaatctatgctgatcactgatatagaggatctgaattatatgattagtaatggagatctaataagatatgaagatagagaatatttctatttaagtatccatagaacatttacacaattttaccatgttcttattcatattgtatattttatctgccaaggactggtaaagaagtatgaaagtctcatgcaactatagtattgcctttgggttctccttgtattttcagcagttatttatttattttgagacagggtcttgctctgttgccctggctggagtgcagtggcacaatcttggctgactgtaacctccacctcccaagctcaagtgatcctcttgcctcagactcttgagtagctgggtctacaggcacccaccactacacctggctaatttttaaattttttgtagagatggggttttgccatgtagcctaggcttgactcaaactcctgggctcaagcaatcttcctgccttcacttcccaaagtgctgggattataggtgtaagcctctgtacccagccttcagtactttttgttttacgtattttggtgctatattagttggtgcataaaagtctaggatggttttttttttttttttttttttttgagacagagtctcgctctgtcacccaggctggggtgcagtggtgcgatcacggctcactgcaagctctgcctcccgggttcacgccattctcctgcctcagcctcttgagtagctgggactacaggtgcccgccaccatgcccggctaattttttgtatttttagcagagacagggtttcaccgtgttagccaggatggtcttgatctcctgacctcgtgatctgcccgcctcagcctcccaaagtgctgggattacaggcgtgagccaccgtgcccggcccaggatggttttatcttcagtgtagagcatccctaattattataaaacaagccttttggtcaatataatatctttttgctttgattacaactttgtatgatattaaaaccttaacttctacttaattattttaccttgaacaacttacttaactttgtgtctgacacataatacttgttaaataaatattatgttagtatttctttttattttcatttctttctgttcttttgcttttaactcttgtgtatctttttgttttaggttaggttcttctaggtatgatatagtttagtctttttttttttcaaaatagttaccatttacatttcttgtaataatagttacttgttattgtcatctaattttaggctatatggtttggttgtctccatctccttctgcattagacagtatatatcatatcatatttttagatctactagcaactgagtagatggtagtgccattctcagggctttgaaagataggcttgtaaggagaggtgatcagtttagctttgaacttgttggatccagtgaatattacccttatgtatcagaataagatatttaaatgaagggatctttgagagccttaagatagtatactagtagagggccggcgcggtggctcacacctgtaatcccagcactttgggaggctgaggcgggcagatcacgaggtcaggagttcaagaccatcctgactaacacagtgaaactctgtctctactaaaaatacaaaaaaaaaaaaaaaaaaaaaattagccgggcgtggtggtgggtgcctgtagtcccagctactcgggaggctgaggcaggagaatggtgtgaacccaggaggtggagcttgcagtgagccgagatcacgccactgcactccagcctgggcaacatagtgagactctgtctcacaaaaaaaaaaaaaaaaaaaaaggatagtatactagtagaggacttcactttattttcctattttctggaaatttcatttctttgaattcgggcataagagatttagaagcttcactcaaatattaagctttatttaaaaagatgatttccagtatttcattttatattcacattaatcaagtctacatgtttcgtttagagtaacaggaagatggtaatacgcccagggaactatctggaagtgtagaaattgggatgaacaccgtggttatacttgttttgatctgcctgtggtgctatgatgacttattttctctcattattgcatagaaactcaattcagtgatgttattcagatgttattcataagttattgccatgattcatcacttttatgtcatcagagttgggatggctacccagaataggggatcctggagatttccctgtagacgctttgcatttataaataatcctttatcaagggcagagggatttctgtaggacttctcccttagaagaactcagcctgggtagaaatacgaggattaacatcagcacatattcatctccaaaaaattttcctccccattactcacacttgccaataaataacttgctttgggtaaatattcagcactcagtcttagtccaaagcatttgctcagcaatcactgtgtagagtacagagtaagggggataccaacaaatagaagtttgctctattttcttaagaagcttgttgtctggccaggcacggtgcctcacgccaccttcctatcttcctaggagatagatgccacaaagaagcttgttgtctgataggcagctcagcagtgatattaatttgtaatatataacaaagatatggaaaaacttgagtgccaagaaatatttaattgtaaaaaccatgaagagatcgacacatttagagtgcaataggatttcaagtccaggtgtgatggcttacgcctgtaatcctagcactgtgagaggctgaggtaggtggatcacttgagcccaggagttcgagaccagcttggccaacatagcaaaaccctgcgtctactaaaaatataataattagctggatgtggtggcgcatgcttgtaatccaagctacttaggaggctgaggcacaagaatcgctttaacctgagaggcagaggctgcagtgagctgagatcatgccactgtactcccaggctggagtacagagcaagaccctgtcttaaaaaaaaaaaaaaaaaaaaggccataggattaatagtaataatgataataatttaaaaaactcatgatagaggttaaatcttgggcaaagttttgcagaaatatggtaagtggatcataaataggagggagaggatctttctggttaggagaataattcatgtgttgaggcaaagagcatgagaagaccttaaatgaacccaaattcccttccagatggaaaatacagaactctaggaagatttgcttgccttgcacggaggtggagacgggagttagggaggaaggaggagataggtgggaggactaattggagaaaggccttgaagctcaaactggggctggatctgccgtgacagacaaaaaggagcgaatacgcttctttttttttttttttttgagaccatgtctcactctgttgcctaggctggagtgtagtggcgtgatctcagctcattgcagcctctgcctcctgggttcaagcggtttttgtgcctcagccttctgagtagctgggactacaggcgtgagccaccatgcctggttcatttttgtatttgtagtagagatggagtttcaccatgctggccaggctggtctcttaacgcctgacctcaggtgatctacccgcctcggcctcccaaagttctgggctcacaggtgtgagccactgcgcccggccgataatttctttttaacctcctttgcggactcctacctagatgagatggtgctccacatggttctgtccttggcttcccatgtgatcttgtctcctcttgaggcttcagataccactctaggtgatgactgccagtctgtgcttacagcccaaacctctcctgagcaccaacccatatgcccacggtgcagagacagcacaacccagtgtcaaggagcctggcttttaagagtcatgtaatcttgggcaagttatgtaatttctctgtgcctcagtttcctcagctgttaaaggaaggcataataatagggttgttgtgaggattaaataacaccatatatggccaggagcagtggcttgtgcctgtaatcccagtactttgggaggccgaggcgggcagatcacctgagcctcaggagttgaagagctgcctgggcaacatagcgagaccccacctctacaaaaaatacaaaaagtagctagatgtggtggtgcgcacctgtcccagctattcaggaggctgaggtaggaggatcacctgagcccaggaagtcgaagctgccgtgagctgtgattgtgccattgcatcactccagcctgggcgacagagagactttgtctcaaaagaaaaaaaaaaagaaaaaagaaaggaaaccatatatggctcagaggaaactctcaagaggacttgggtcttttgacttgttattcctggatagctccacgtgcaggtcgcatatttatcaaagagccaacaaagctacacttagcatctctcctttcaagcctgtatttctaggctctgacagtggtgccactcagttgcctaagccagaaatctgggagttaacctgggcttttccattcccaaagccctgtctcttctaccttcataaaaatctcctaccatttcctgttcatctttcatgtttcatctccctgctttcttccctaaagcattaaacattaaaaataattattttaaaaccccactaggtagaatgggtcactgttttccatgtgccctcagcattcctaatgtattccataacttcttagttgtatgtcagtgtgattattattcattccaagggcagtggccacaattttatatttatttatttagttttttgttttgagacagggtctcactctgttgcccaggctggagtgcaatggcatgatcatagttcactgcagcctcgagttcctgggctcaagcaatcctcttgcttcaccctccgagtagggggatcacaggtgtgatcctggctaaattagcacccggctaatttttaatttctttttgtacagcgggggtctcactatgctgcccaggttggtctcaaactcctgggctcgagtggtcctcccatctctcggcctctcaaagtactgggattacaggcgtaagctactgcccccggccagggttgcttgttttggagacttctcagcaagccaatgcttgaatatatggtggtttaaatggagagaggttggggtcagggagaaaagctctagagatgatgacagtgatttagaggtgaaaaggaggattgaattatgattatgactacttataaagagctattctttctgaccatgtgacactggacatgtaccttcctcactctgttaggtttctcacctataaaatgggctgtaggaatgttaaatgaggtaatggatgtaaaagcatgtaaatgagagaatatgtgtaaaaatacataactactcagcatagtgcctgactcataataggactcaggaggtgacagtagctgtcattattcttactcataattacatcatgactgttattactactgactgaatgtagcaattcgagaatagagaaaaaatgaaaatgctagaaagtcacacattttcagggctgggctggcgcgaagacacattttgacagaatgagagaaatctcataggaaggaagacaaagtcagtttgtctttgcaaggttctgggccccagatgattcattctcagatgctctgggaaggactgcgtagaataagcatgggcaaacttccaggcctagtcacaagcaactctacacactttccccatctctctggttgcgaagaggagtctcaggttagaaacccaaagcgggagactcatcacatgttcacgtttttccctgcacagtggtcagtgctgtgtgtcagtcaaggccatgtctagggtcagcgctgctccaggagcctctggctttgtccttcaggtgggcagtcccttgctgtgtctcttcttcagacccttcaaccttacctctagccctggcttttagtttgggtaggagtttgtggcacatactcttttaatgacaggagatggggcaagaatgaggatgagggggagaaagaaagacatctggaagttttgtacatgaagctccccaggtgggtgaacggtggagctgaacatgagttcagaccacgtagttcagcagcgtgtcctgcattttatagatgagaggaggctttgagaggtcaagtgacttacttgttcacacagcctggcagctgaaaccccttctccctaaaggggaggaggaacagagggcttggagttgacccaagaaatgacttcgccctcctcttcctttcctccctcttcctcttgttcttattcttcccttccctctccctcttccccactggtttttctaaacctttcttttggggccgggcacagtggctcacgcctgtaatcccagcactttgggaggccgaggcgggcctgaggtcgggaggtcgagaccagcctgaccaacatggagaaaccccatctctactaaaaatacaaaattagccgggtgtggtggcacatgcctgtaatcccagccactcgggaggctgaggcaggagaatcacttgaacctgggagatggtggttgcagtgagctgagatcatgccattgcactccagcctgggcaacaagagtaaaaactccgtctcaaaaaaaaaaaaaaaaaaaaaacaaaaaaaaaacaacccagaaaaacccaaaaaacaaacaaacaaaagaaccaaaaacccctttctttcatgcctagattcattccaaaaaggtttaagacagcaacaagtgattccaggatctcagctgtgggcatccttgtgttactggatggctgtgtgttaattgttagcagctggaataagtgaagagggtctcgtcctcatactcaaagtcctttgctcatgcccaaggccagaggctactcatgctgaaacattaccatctccctccaaagtgcagggtttagtcactgagtactgggtggagcacatgactggatcccagttaatccctcccagcttaccagtaaaacctcaggattcatgctttcctgggagccacctgcggccactaagataggagcggggttcagacatggccaggcgctcctaatctcagacccaaagtgcaatttttggcagcctgcatgagaaggagggtgggaggaaaggtggctagaaccaagggtagcagcctgggggcttgagaggaaaccaggcacagcccatcctaccctgtctcacgagcagcccgtcctcctcctgactccccttaccccacacaccgagcgccattctcttgctgcctcatctattctggttaggtacttactgagcatcaggtgctaggcaagtggctggggagagacaacgtttaatgactcagtctccgcctgcacagagcctttgagtctagagggagacacagacttactgacaggctgggttgtgtaataagtgctacgggaggaaaagctgagagtgtctgagaatttatgagatgtgtgtctcatcagacttgggcatcaaaaaaaaaaaaaaaaaaaaaccatcctggaggaaaggacctctacgtcaagtgaagggtggggtccatttggtttttataggagcaagttctttgttggctggactctagatctcccgtcctttgactttggttacaaataatatccaaaccaccgctagtctcattctcttttctctttcctgctctagccctttgctcctctcccaggctgtttctctagctccagacagttcatattcctaaatgctgatcacttctcttttccctctcaaatgctgctttctagaaatcattttcagtttttcagaaccctgtccatctcttccaatcccctggtgtctttcccttacctgggtcattctctgggcaacatggcaccctttcagtgcagacttgtttattaataactccagtgagttttattttcctcttactaaattcaaagtactcagaacattttagacttgttgagcaatccctatcagcttagggatggggtgggggaggctaacagaggtgaattaagaatgataattccaaactaattagtcatccagattaaaaaaaatagactaagatggttttttttttttaaagacatttgtgagagaattgggaaatatgaatcctaactagatagttgataataaaggattcttgttagttattaaagtgtggttaagaaggagtttttatcttttagagagacgttctagactggacatgggggctcacacctgtaatcccagcactttgggaggccgagagggggaggatcctttgaagccaggagttcaagaccagcctggggaacatagcaagactccatctctaaaaaaataaagattaaaaaaattagccaggtgtggtggcatgcgcttgtagtttcagcttcttgtgggtgctgaggtgggaagataccttgagcccaggaagtcaaggctccagtgagccacagtcacaccactgcactccaccctgggtgacagagtgagaatctatctcaaaaagaaaaaaaagggctgggcacggtggctcacgcctgtaatcccagcactttgggatgctgaggtgggtggatcagctgaggtcgggtatttgagaccagcctgatcaacatggagaaaccctgtctctactaaaaatacaaaattagccgggcatggtggcgcatgcctgtaatcccagctactcgggaggctgaggtaggagaaccgcttgaacctgggaggtggaggttgccgggcgccgatatcgcgccattgcactccagcctgggcaacgggagtgaaactccgtctcaaacaaaaaagaaaaaagaaaaaaaaatacacatactatttatagataaaattacatgatgtctgagacttgcttaaaaatagtctagggagtggggtggggaatgcagacgaagcaaaattggccatatagtaataattttttgaaatgaagtgctggatacatgggactccattataaaactttctataatgaaaacaagtttttttttaatttttaattttttaaaaatagacacggtcttattctatctcccaggcagaattgcggtgacgtgatcacagctcactgcagcttcgaaatcctgggctcaagcaattctcctatctaagtctctcgagtagctgggactacaagtgtgcccctccgcacctggctaatttttacatttttatttttctagagacagtggtctcaccatcttgcccagactgctcttgaattcctgggctcaaacgatcagcccgcttcggcctcccaaagtgctaggattaaaggcctgagccactgcggctggcctaaataatgtttaaaaggaacttcaagaactatttctccattccctgttgcatgattgggaggtgggaggtggaggtgacatttggggaaactggttttttcttctctttacacccactgccattacttttgttggatcctggtctgtgggttctataaggccctgagactcagcaccctcctgcgcagctgcgctggaagaggagcctataggttctagatgggggctctgccttccctcctgtctgtccagtaccagaactgttcttgaggcaaacaccacatcaatctctgtcaagatttagagtcatcaggttcaaagtccctcataacgatcctgtccctcataacaatcaggtaattatgaaaacaactacttgtccacaaacagtaatacctgatgggtggggaaggagcaattggcagagaggggcagggagagggagagatcaaagggaagagggaaatacctttcctgctagacaacaccctggtgattaatctgccggggtgtggagagacacagtgaagtgcacagggcctgagttccttccgctcgccgcccttgaaggaaatagggtcttcctcttccacattcacggtgtagcctgggagagccctcatacttcctctttcttatgtcaaagaggggaccaaagaggggacatttgtaggcaagacggatcagacttgggtgcttggattgcaggggctgtctatatctgaacctcatttgcctttttcttcctatttctcattctgcactgccctgtagaggtatagcccattctttgtgctctgcttgtggtagcgatggctgtggtgtagcttccaggagggtagagtgtttaggtgacagacccactgtgagggaaggcggtgggaggcccatggccatagtgacaggtgccatccgtctctctcttctactgtggtagaagtggaaacgtgtctgtttctggctttaccatggagtgcttagagcagtgatcagcacatagtggtgctcggtaaatatttgttgaatgaatgactacataaaataaagttgagattggagagccaaattttattaaaattcgggaagatcgatttaagctatatctggtgtcactttaacacactatacataatatcgtgataatatatattcacatgatattcacatatgtatcatacatatgtatgtatatgtatatattgcatatatacatatgtacaatcttcctacttgctatatgaattaaataattttggtaagatgactatctcttctagtggaaaagaaaattttgtggtttttttttttttttttttgagatggaatctctctctgtcacccagcctggagtgcagtggcatgatccccgctcactgcacctctgcctcccgggttcaagcaattcttctgcctcagcctcccgagtagctgggattacaggtgcgtgccactatgcctggctaatttttgtatttttagtagagacagggtttcgccatgttggccaggctggtctcaaactcctgacctcaggtgatctgcccgccttggcctcccaaagtgctggaatggcataagccactgtgcccggccaagaaggttgttttttccgagctgttttttctgctctaaggaaagaggcaggattcaggggatgctttgtatcttttcctgcttcccaacccgagtccttcctcttgttttggatttcttgctgcatcatctctgtccttctttagggctggaggtgacctctgcgagccttcccttcctctaactctggcctctttcctgctgcaacatagttctcttctagtccgttcaaaactttttattgccacgtgaacaatctcattgggaaacaaaaaactcaagaaaaaaaatcccatgcccaaaaagcatggaacacaacaaaaagaatagtgtagaagacacttaaataagcaataaaataatttgaatgaaattgttgacaaactggactatagttatgtctagccttgttgaatctcaacatcttattcgacattgactttggaatttgtgagccacctgttttgaggaaatggggacactcctttctctttttcgatttcccaatttatcttcccacttgtgccctgaatcctgaggacttagatttcctaggggtatggtcaaggagctgggtctaaaattcacacgaagattgtaggggcagagaaagaagcctttctcctgacaaaggacagatatatgggaagtaaactgtaatacagctagtggcttcctgattatccgaatgagtaagtagatttctcactttgtggatggtccgttacctgggatctcctatcctcctggggctgaactaggagagtggaaccagagtcataatgaggcatctgatgaggggaggggtagggagagagagaaagagacgtagagaggaggagagagagaaggatatctcagatctcattttaaggctaatttgagaggagacacgtagagtacttgagaacctgggtcctggcaccagacaacctggattcagatcctggctgtgccatttcctggttgtatgatgttgggcatgtaacttgacttctctgcctcagtttcctcatctgtaaaataggataatagttttacctcatagggttgctatgaaatgaagtaagtaatgtatatatagagtgattagaagtaaaaattcgaggctgggcggggtgactcaacacctataatcccagcactttgggagggcaaggcaagaggattaattgagcccaggaatttgcgaccagcctgggcaacatggtgaaaccccatctctacaaaaatacaaaaattagcggggtgtggtggcacacgcctgtaatcccagctactcaggaggctgaggtcgggggaggatggcttgagcccaggaggtggaggttgcagtgggtcgagatccagcctgggtgacagagcgaggctctgttccccccatccccccaaaaaggagtaaaaattggagcaatactaaaaatgaacatgttagctatgaagattattttttgttggattacccgctatttatgtgccatccaggacgttcctctttacaggtagccaatttagagctggttatgacagacaagacccctttcataacttttcggaattagtggagccatctttacacatcttaaggaggaggccgggcacggtggctcacacctgtaatcccagcactttgggaggctgaaggagtttgagatcaacctgaggtcgggagtttgagaccagcttgaccaacatgcagaaaccccatctctactaaaaatacaaaattagctgggcatgttggcgcgtgcctgtaatctcagctactcaggaggctgaggcagaattgcttgaacccaggaggcggaggttgcggtgagccaagattgtgccattgcactccagcctgggcaaaaagagcgaaactccgtctaaaaaaaaaaaaacaaaaactcaaaaacaaatcttaaggaggaggggcagaataattctgaaccacagagcctaagaagaggacccagccgctggctcagaagggaatgctcggccttctgtagaaaaatctgctattcagagaccatcatgggtaacacggtgaaaccccgtctctactaaaaatacaaaaaaaaaattagccgggcatggtggcacatgcctgtagtaccagctactctggaggctgaggcaggagaatcacttgagcccgggaggcggagcttgcagtgagccgagatcgtgccactgcactccagcctgggcgacagagcgagactctgtctcaaaaaaaaaaaaaaagagagagaaagaaaaatctaccattcagataactcctcttatccatgagagaataggatgcttacaaatgataactgtatcagggccaaaggtagaggctgcaacgttatgattaaagtgttaacttcaagtttagatagttccatgttcactaattcctaagaaaacactagtaaaaaaatatcaggaaccctggcaggttatttgtaatatatacacgtatatatatttcaagagacagggtcttgctctgttgcccaggctggggtgcagtgacgtgatcatagctcactgcatccttgaactcctggactccagcgatattcccacctcagccttttgagtagctgggactacaggtgcgtgccaccatgcccagctaattttttaatataaagatggagtcttgctatgttgccctgtctggtctcaaacttcagagagcaaatgatcctcctgcttcagactcctgaagtgctgggattataggcatgagccaacacgtccagccctgtgaagttttttgagattaggcttcaaaatacctcttcagagtgttaggttctctggctttaaggtaaatattaatatagttaaactgggggaagggacatatgggatttcttcctggttcttcaacaggttttagaatttactacaggaggtagaggaaagttagtagctttacttaatgtagtaagctcaaagtcaaaaccctggctaaacatgcaaaattggtttcctaatccttttttagtcttctgtgtctgaggactgtgttaggagattcaataccttctccccactccaacattccttttctgcaggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggtacagatgcagcctggctaggcagagaatcccttgtagaaaggtgggggagaatcataggatattataactgtaaggaacatgcaagattttccagattatacccttgatagaatagataagttccttaaggctcagatcttgcttaaagtcgtccagcctgttagagacaagtagaacacgaagctggcctctggagtctttattgagtactttgtacaattggtgtagactgggagagccctcctcacttcccctttcttgtgctgtaatttcctgtggggcagaacacctcagaggtttctgtgcatcaaaataagatgcagcaaagacatggaaaaaggataacgagacaaattcccagcaataagtagatgaggttgtgttttttataaaagataacgaggcattccttccagaaatgtggagcctttgtagatttcagtgcataaaaccaagccatgatttcctgcagtgatcacagagcagagaagggagaaagcccttttatcacaaaccagcaggaagtctctgtaaaattggtaaggattctggtttagtgtgaagaaccacattttttgtgtatgtttctgggcccatgggaaggaacagatcatatttgacatacaagaatcaaatgattcaggccaggcatggtggctcactcctgtaatcctagccctctgggaggctgaggtgggaggattgcttgagcccagaagtttgagaccagcttgggcaaaatagcaagacttcatctctatttaaaaaaaaaaaaaaaaaaaaaaaaagaatcaagtgattttgctcttatctggagttgagacaagccagatgttctcgtgttgttttcataagcaaaagaggctaaactgatggccagaaagtactcctgctcatagggacctattcattggtctccagggtttacactgacctttaagtctaatcacagggggtgggtggttttgggataggaatgaggaacctccaaggccatgttcttagctccagctaaaaataggtctttcctttgctcttaagcctgaggtgtggaacttcctggtgctactcactgcagctatggtccctgtctagggcacttggaagtctgaagggaggcggaggagggcaggaggggttatttaaccacccagcccctcctgtccgttccgtggcttcactccatcacctcactcctgtacttcctgttctcattcactgatgagtcttccttccttcattcatttcaagggccactgtcagctttctcccttaaaatgcttctctggcctccatgctttgctgctcactttcctccctgggtcccctgagccaccccatcccatcaaatccttcctgagcccttccacagttggaaccaacaacctctgaagctttgctcgcagtccagatgaaccaagtcgctgtgctttcctgcctgtgcctgtgctccaggtgtgtctgtcctctgcctggtgtgaccatctccctcttctgcccttctccaggatcaggcattccccagtttcccctggtaatcactccaccctgtgcatctgtaggactttgaaatgctcttatcagggtctgtctcattgcactgttatttatgtacctgtcatatgttccttactctccagtgtcagctgcaaggagggatcattctggttaatctttatgtgcttcaccatctctctcttttttttttttttttgagacagagtctcgctctgtcacccaggctggagtgcagggacataatcttggctcgccacaagctctgcctcccaggttcaagcaattctcctgcctcagcctcccgagtagctgggattacagacgtgcaccattatgcccaactaatttttttgtgtttttagtagagacggggtttcaccatcttggccaggctggtctcgaactcctgacctcatgatccgcccgcctaggccttccaaagtgctgggattacaggcatgagccaccgtgcccagccacgatctcttaaataaaggcgtttaagtgtttgttcagcaaattgggcccataaatttggtgggaaataaatgaattgctttgaactgcattcatgatgattgcatgtgtttatccttgtttcccaagcctttggttttccccaaatacacagaaaacagttgctcatcaatcctgcctcttcccaatgaaaatgatacaaatatatacatattttccttgtcaggcagttgaaataggtaaatccccagtgagattcactctaggtacacccctggccagatctatatctgaaatgactggtttttatgactttttcttttttttttttttgtttgagacagagtcttgttctgtcgcccaggctggagtgcagtggtgcgatctcggctcactgcaagctccacctcctgggttcacaccattctcctgcctcagcctcccgagtagctgggactacaggtgcccgccaccacgcctggctaattttttgtatttttaatagagatggggtttcaccttgttagccaggatggtctcgatctcctgaccttgtgatctgcccacctcggccgcccaaagttctgggattacaggcgtgagccaccatgcccagcccatgacttttcaaatgtgcttttgaagtggtcctaggatgaggtggggctctggtgaagttctgaaaaggggcgtccctagtcatcatagttattcattcattcaaccaatattgtgtttgctttgtgcctggtcctaggcttgaggacctagtctctgtccctccaagaaacttaaggtctgctggagagacaggcaattaaatgggcaagatgtcacactgtgataagtgatacaatggggtgaacataggtgggggccccagtggtttaatttctcctgttcctccatttcaggttttgaagagacaggggacacgctctatgccccctattccacacattttcagctgcaggtaagtgatttttttctccctcttcatcaaaggcattagcacctcaggaacactgatcctttggaaacagacgatgttacctttctcatggcccctagatggccacttgaaggaatgatgggtcttctttcctctaagcggcctcacggggttagtgggtaagaatgagtgcttggcatagagaggacttgggggtgggaggcctgggagaaagggaaggaaatgagacttctgcccagactggagacctgttgaaatggcaggaactggagtgggtttcacgatatgactgtttccttttcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatcctttggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggtggtggcagcagttaccagtaa

SEQ ID NO: 1737 - DNA, 70299 bp, Homo sapiens
acagactgcagggctgactagggttagtttggaggagggagtaagaggtggggaggaggaggcacagttaatggatctgtaaacttgcaccctctttcagagtggtacatggaagacagcacaaagtggatccatactctgaaatgcagtaactctgatgcttgaatttgtctcccttcttgccagaaaggattctaataactcggtgtcaaagccaagacataaactcaaccccttctcttccaaaaggtatgtcattatacaacatctgtacatatactctagaaactttgaacagttttataatttgcagaatgttctgtatgagttaattaaaatgaatctcactagttctctaaatattgcttttaagtcccatcagctaaggtctctaaaccttttgctgtgacaatgtttgtggtgatgggatttgacttctatcaaatgaactgggagaacacttgttccttacccagtccataacacaaaaatctccacaaactggcttcagaagcatctcagggaaagattttcgaccttgggatcatggaggtaaaattccacttcaccatggtcagaatttaatccaaattggaagggattggagggggtggtagagggctgagcagtgatgaatgaacactagcactctgaggtcaggatttctctctttgcttgaatttctagttctgttcgcatttttgttacctgtacaaaggacaccagttttcattcctttacgaaaagaaaactttatgttgaagtgtattttggaagggtattgtctctcttcgtactagccgttaggctccatccctatgactgtctctggtttaggcgtccagtctgaagatagctgctttgtgttctttgtcccaactcttcctgaacgtgaggattgaacataccaaccaaaggtttcactaatttaaaatgtactgtattgccctgacaggtatactgtcaaaaaaaatttaccgtatttatctacctggaattaggccttcttaataaagtgtatgcagcataatttgcacactattgaacatacacatccctagataaactaggagtgggaagtgttttagatctaaacatccaatgggaaaaatttcgtgtgttctcgttatgttatctgaggatgggaaacttcaggtcgcagaatcttttgttctatgcagcaatgtttgtcataaacggtttagttctttagtggctcctttttgtttcttatttttggtttcggaaagagtatttagcagaagttactctcctttaacaatccagtattttatgtaaaactttatagaataattttatagtgattctctttacaaaaccatctgctattaaataaggaacactgtgtaaatagaggaccacctaagtatatttaattttcaaatacgaaaaaaatctgactcatacccttttttgtttttttgtaaaagagaggtggccctatattattgaataaaactgcttttttagattgaacttggagtgtctcccatgtggtaaactgaaatcttattctccccaaattgtaatagattttatctttttaaaaatgactttactgaagcagaggagaaggagatgatcaatctattcaatatgaagaaatatctctgttgctaatacaatatccttttgaatatctcccacatcttaggccctggtgaaaatccctttcaattgttctgtctacctcgtagggatgttgtaagaataaatgagttaacatagatatgaagtgccttaggaaaaaggctctataaaaatgcaaggcgatatcatgattagttgtttctttgactcttgatcattttcttcccacttcttatacaaaatgtctctcacttatttcctgaagccatctcttttagaactattgcttcctagaagagctgaaaatgatcctagttccaacatatttattgattcccagataataacacccactggtgttgatgactgacagggttcatgcctaagcttgagtagaacttgcccttttttcctgggtcaagaaaagtctgcaattgttcgaaaatgtgtcagtaagtgtgattccatcacgatttcttaaataagtaacagttgctgctggataatcctgggggcagatgattcatttttgtgcccctatcaaacaaactcaaaacttgttaaagaatctttataagttgtttgaatcaaacaatagggtcgctaggtccccattttgtccatttgaggtatttgcccagcataccttggtctgtaaagaaatagcacagccttggctgggcgcggtggctcatgcttataatcctagcactttgggaggccgaggtgggcagatctccaaaaataaataataataatgataataacacagcctcatgagtcttttttttttttttttttttgagacagggtctcactctgtcactcaggctggagtacagtggcacaatcacagctcactgcagcctcaactaccctgggtttagtgatcctcccacctcagcctctcaagtagctgagactacaggtacacaccaccacacctggctaatattgtatttttagtagagacagggttttgccatgtttcccaggctggtcttgaactcctgaactcaagcgattcgcctgcctcagcctcccaaagtgttgggattacaggtgtgaaccactacacctggcctgccctttcttttctcttaaaaattcttaagaaagcatggtcctgtttaacaaataagcattttacaaacatttatcgatcaattactatatgccaggcctggcactaggcaccaagtcctcttcaacagtgttaacattaagtttcaataaacttgagtcagtaggaattcagtaaataatttttaaagattgttttctttttaaatatgtatttataaacaaaaattttagagaattaaaagaaactatcacgaagtgcatgatgataaaagtcttatatactctccaaagaaaatgttaagacataccttaaggagatagtgaagaacagccgggcacagtggctcacacctgtaatcccagcacttgggcggccaaagcaggcagatcatctgaggtcaggagttggagacaagcctggccaacatgttgaaaccctgtctctaccaaaatacaaaaattagccgggcatgatggcaggcgcctgtaatcccagctacttgggagactgaggcacgagaattgcttgaacccgggaggcagatgtttcagcgagctgagatcgtgccactgcactccagcctggtcgacagagcaagatcctgtctcaaaaagaggaaaaaagaaaagaaaagaaaagatagtgagaaaataactgaacataaaacataaagaaaagttgaaatattagtactcactacctaggttcaacaattgctaactctttgccgtatttgctccatctatacctatttctttctgaattacttgtaagttgcagataaaataatacttcactcctaaataattcagtactcatctaagaataaaggcattcctctatctaaccacaattccatcattaggcctaagaggataaacagtaagtccttaatatcatctgatagctagtgcagatttaaccttccccatttgtcccccaaatgtcttctataccattttttaaaaaaagaatctaatttttaaaaataagaacatattttgcagttgggtctcatgcttctttcttcaacattggatgtttttaaagattacgccagttctcttgtaccaggtcccactttctgaattcgttgttgcctcatggttaatttgttcctctacccactttatttctcataagctccaagttaggactaaaagcatgatttgattttgattgaacgttttttgcaaggtgccactgggtgctccatattgcatcttatcaggaggtacagaatgccaggttgttccactgtgcatgatgccaagtttgatcagggcttgaggtagtgatcttgctcagaggatctcttgttgtacaggcactttttcaccctttgcaattagcgagtactctcagggggtatctcaaagtgtatctcataaacactttggcatggtggcaatatcctatttcccaacaaactctcacccggtgactttaggtaataatctttgcctaaattgattatttcattggagttcatatatatttttaatacgctttgaagatggactcgacatgcaaattcatcattatcagcagcaatagtggctggaaatatttattgagtgcataagttcaggtaataataataatagtaggtaatgtttattgagtgcttgctgtggagccaagacagcctcggtgtgagcccagtctttcacttactaagcgaatgaactgggacgagttattctttttgtgcttcagtttcttaagctataaaatgggattactaatggtgcctatctcgtgggattgttctgaagagtaaacgatttatacatttaaggttcctaaaacagtgcctgttattattgttatttgccaagcattgttctaatactttgtaggtactaactcgtctacttcttctaatggtgcaatgaagaaagtgctaataatacccttttttcacaatgaggaaactgaggtacggagaggtctagtacgttgcacaaggtcacttaactagtacctggtggagccaggatttgaacccaggctgtctggttcctgagcactctctctgatgatgggcacatgcagtgaggagtgatacaagtggagctgagtggaagtagccctcacacacactcagacttgaagttattgaaaatccgggaggttgccacccaaacacatttaaggtttaattcatctgaataagaacagcattccactaagcccagataagtactcttattacatttacatagcttaaggctctgtacaagaaaccttgaacataaaatacttggaacagaaaagagtaggagaactatgaagtaatggggggaaaaaatccctgaaaggaacaatacaagcggggagttatgagacctgggacctcagagcctcggggtggaagatgatattttgatataatcaggagggagaaatttcctctcatttttcacatttctgtactatataagattttaccataaaacgcaagagtataagccattgtcagatttataaaaggccatggtggatttccttaagagacgatggatgactgttgttagtaggtaaattccctggttggttatctcatacactcagatattccataagtcagcctgtggcttctgaaactgtattgagaaaaagctgtataaactaggtgttggtccatgctccttcattagcattacaaaagggttcgactgctgagttgaatcttatccactccttcagtggccattacagaaagctctcaagtgtaattttctaaagagaactaaaaataaataagaaaaaaaaaatccagcattaataatggttctttttgcatttccaacacagtcattgccaaattggttctgcctttttatgttttttaatgaaaagcagcctaattgatcaattggtcatgaataatacttcttcgtttgtttttctccacaccccccagccttctagaaccacgggcttaatgtgtcggcctacaaatggttcatgatttgtgttttttgtctagtgctttatgggaaaatattagaaacaaactgctgagaactcagtaggaactcagtaaataataagtagatagttctcttgttaaatatgattttaaagaaactctttctaaataactaggaaatattacaagggaagtacaaagtggggtggaaagcctggctgacttgtaatttgaaatttctcttcatcattttataggtcacacagtttaaccctttataaaacaaaatgtaaagtctgatagctgaaaaggctctcctccgctaaatagatttgtttgaaaatatagatcattaaatcggtaagaataacaggagaatctcaaccaaacattgagacaactaagaaaattgtctaaatctaataccttatatcagtactttaagttgaccataaatacgctgatatccatagcacataggttcttactggcagtggtggggtgggtgggggaaggggagtgtcacagacacattcaagatgtcaacgaaaactatgaaaactctccccaatggggaaaaaaaaccaacgatgcctagcacttatcctacgcaactttgtacagaatttccgtgggaaattctggtgtccatccatcataaatcacctggtgtccacccatatatcctgaataggaaaaattgtctttctctagagttattgtacactgatcctgatggagctttaaaaagagttgtcgtacaggctcattgactttgggaggacaaggtgggaggattgcttgagcgcaggagattgagaccagcctgggcaacatggtgaggccccatctctacaagatattcttttaaaaaattagccaggcccagtggcccgcacctgtagtccaagttactccagaggctgaggcaggaggatcccttgagcccaagagatcaaggctgcagtaagccgtgttcacaccgctacactccagcctgggcaacagagtgagatcctgtctcaaaaaataaataagtaaataaaaagagttgccattatcttgtttgatctggctatgatctttgaggtagacagaccacagattttacctctcattctgcagagtgggaaaagcaaggcttggagagtttccgggacttgctcaaggtaatttgctaatgtctgccgggacgtagcaccaagcctgtcacgctgtaggctgggccccttccacaacactggtccaaacacaggattctggagatgcaggagccctcgatgggcttctggaaagctgaattctggctctaccagagctacccacgtgatcttaaacaagtcacctaacttccctgagcttcagtttcttccttagtcaagtgagaggttagactgtgtgttctctgaagccctttgattttctgcagaaaaccacctaatcccactgggtctgggaacagagggaaatgaccttttctgccatagatggcaagacccttcacccttccctgtagggcataagagctggcatccaattcttaacggattcccttgcaatgtccaaatcccattagaaactacaaacatctcaatagtgcctttgtgggctgcttgggtgtcatgccgctggctgcctcacttgctgcagggctgactgtccacatcaattatactccaaccctgtgctctgcaatgggcagacatcccatgagattttattacccctcttgggtagttcagggagtcatatggaagtaaataatgctgatgggcttattttgggctgatagatccttatccttctaaagaggttatgcctttcaaagggtacaaaaccttctccttgattttttattacgaacagttatatcctttaatgtcccagaattgttcttggaagttggagactcacaagagggcctgcagctgtgaatgcagaagtcctgagactaggggaggacatcaccactctcccttggcctttggagtcatccaagctaagtgctaatatttgtgattaacaggtgttgataggaaattgggcccctgtgtctcagtctttttgtgcttcaaattttctaagtgaacttcaggctggcaagtggagttagatcaacttgttgcagacagtatcatctgctcggtaccgtgtcaggtcactggactgtgggaggttatactgaccagtgatgagagtgacagagcatgagcttggctcccgtatcctgtgttctgtgctcagcctcacagatgactcactgtgcctcatcgactcctctgtcctcgagtgaaattatgccattctttaacccactatacaagagacttttgaagattcatgtgtggctacccccaacaatatctcatttgtacaatgcagaacatggtgctttcttgtgtaaacaaactcattttgtggaatttttattttctagatcaatatttttaaatagactactaattcattttataaaccgggtactataagattttatgagttgacacttggtaccctgtaagtatccaaataatcaaagaaggagaaagtgtgaagtcaaggaatcccctagctgaaaagaaattcccaatacctggaacaaaaaagatggagcttttagagagcagactttttctccagcaaagatccacaacttccatttttaaatgtaagacgtaagggagatttatgatacagcctactttgtcagatcatattatttcataaagtgaagggtcaattaggtgttattattatcaagaaagcatgctgtaatgcttcgtcttgtagatgctgtaaaaattacctgtctgattactttaattcatcttttggctactgtctgcagaaattcactcagtccctagctcacaggtatgcagacgtactgagaacactttgggaaataaaagcaaaaaaaacattgggtcctttcccctaaggaatgaacagtgtatttgggaaactaggaaaaacaaacaaacaaaaaaatggtaccacaatgcaaaactgatgaggagattaaaaaacagctcaagatggagatttttagaaagaacttcttgaaggaggtgcatctgtaggctgagagagatggtttagcaagcaggcatcaatgcatccacaaagctttacacttcaaggaaatcataggagaaacagggtcttctttgctgaagatctgtttattttgcaaacaacaaagagtcagaagagccatgtgaagtttccatggggaatccagaaactaaacttctgccactggaaattacctcaagatcttttcccagatagcctgctcttcccctgcttccaatcatgtccctcaaagtcttctttttcaagcataaatatccttagttcttgtaaccactcctcctatgaggcagttttgcgtgctgccattattttaagcacccgcctctgattggactctagcttagggcctcccctaagtcacgggactcagaacggagcaacgctctccaggagtgatctgaggatgcagaacaccatggggtagttgcctcccttgatctgtagcctatacttctattaatatggcccatgattgcatgagcccttttggcacccatgtcacactgctgactcatatcgaaattgtggtcaactaaaacccatgagttcccatgcactactactaagccagatctttctttctttttcttttctttttttctttttttttgagaccaagtctcgctctgtcgcccaggctggagtgcagtggcgcaatctcggctcactgcaacctctgcctcgtgagttcaagtgattctcctgcctcagcctcccgagtagctgggattacaggcgcccgccaccacgcccggctaatttttgtatttttagtagagacggggtttcaccatgttggtcaggctggtcttgaactcctgacattgtgatccgcctgcctcggcctcgcaaagtgctgggattacaggcatgagccaccatgcccagccagatctttcttattctgtacttacactgttgatttaaaaaaaaaaaaaaaccctaggacagaggtttaaatgtaaagacatttatttctatttcactcgatcattttgataacaacttgtccaaatctttcagagctagggtattagcttcccctccctgcaggtgagtacttacctgctggtgcagctaatctcatgatggatctctggcctctaaagggccagaacttcattgtctctttcctatccataaattctctgcaaccgtggatgaatctgcatccttagacaaactagtgggcctcaatcttcctaagtaagataggaataagtgtgaatggccatttcctccttgcggtgaggatatgcgacaatgagttcgatgtctgcaaaaccctaaggaaatgtcactcagaggcagcattagatgaggagagaaaaagtttatttcaggctctcagcagctttcagaagacttgattatcctgatcactacgtgtgaaagttaatgacttcatttttgcagttattttaaaaatataactggtttatctgatttttggttgtagtaacatcacgtgatggtcagtatcattttacacattatttgtaatgtgagcaagtgccataaagcatatctgcaagactcatttaaaatgactctcttccctccatcacctcccccagccccatcctcaactctaccctcttctgtttgtaatacgggactacaaagatcttatagtttaggtttccgtcagacttttggaaacctttaaaagacttaccaagctagcttagaagttcatagattttcatccctggccagcgcagagagctcacaggtaacttgtataatatttatcatttcaagctcatagaaatgtcatatttcaaaacacatccctgagagcagtttttttgttccttatagacaggtgcagggaacatccaaatttttctagtctgccattctaatgcacattgtgatgttgctcttgtgaccctataattattaattttccagtagcccctccccaacctttcacgtgatttttaatccagggcctgggcactcgtagcagagtgtgatcctaggaccagcagcaacggcaccgccggggagcctgttagaagtgaggatctcagaccctgcctcaaacctattgaatcagaatctaaactgtgaaaaaattcccctggtgattcttatgcacagtaaaatctgagaagaacagatctagagtgaagggattttcactcccattttacccgctgtagaccttatgttgtaatacaaaacttacaaacttccatttggtgtttattaaaaggttagagtccttagttaaaatgttaccagattcaaatgttctgtttatatattcagctatttctcagtgtatgtaactggctttaaaatactcttgttgaccaggcatggtggctcacgcctgtaatcccaaccctttgggaggccagggtgggaggattgcttgagctcaggagtttgaggccagcctgggcaacatagcgagatcacatctctacaaaaaattaaaaattagccagggatggtgatgcatgcctgtagtcctagctacaggaggctgaggcaggaggatcacttgagcccaggagtttgaagttgtaatgagatatgactgagatactgtactccatccagcctgggtgacatagtgagaccttgtctctggaaaaaaagtactcttgcctttctgggttcttgtggagcaggggttctcccccactcccaccagggacatttggcaatgccaggaaacattttttgtcacagtttgcagggagaggtcctactggtgggtagaagctagggatgctgctgagaatcctacaatgcacaggatgggcccccacaacaaggacttaactggccccaaatgtcaatagtgacaaggttggaaaacaccagtatatgatttataaagactcagatgtgcgaccataaaccatagaatgccacaggaaaatagagtcacgtggcatgtcactatatgaccaggcaaagaacaaatagaccagcagtggccggagtgatggtggtggggttgtgagtggcagggaatggaaaatccagccacagatgaaaggagacatctaggaccaatgctaactggtactccgtgcacaaaggcagtgagctctagaggacagggctaaaaggccggtcacggtggctcacacctgtaatcccagcactttgggtgtccgaggcgggtggatcatctgaggtcaggagttcgagaccagcctggccaacatggtgaaaccccgtctctactaaaaatacaaaaattagctaggcatggtggcgggcgcctgtaatcccagctactcgggtggctgaggtgggagaatcgcttatacctaggagctggaggttgcagtgagcagagattgcaccactgcactacagcctgggtgacagagcaagactccatctcaaaaaaaaaaaaaaaaaaagaggacagggctgatgttcagggactggacaccaggtatgagccccaggaggggtggaaggaggtgtgggagaaatagagagagagaaggcttcagttctagagtggataccaggtatgatctcaaaatcgtgttagacatggaaaacaagaaaggatttcaagtattagcataggagtacacaggcagatttcaggtaaatccagtaagatgaagactcaggaacaaggcagaatcctgcttgctagaactggggcgcctcagagccaggccagcagcaggcatgaccgatgctgagtcagccaagtgttcaactagagtgagcttcttaaatccctcccaactgagaaggggcttagtgctgagtctacagcatggttgacttgcaagaaggggtcaagggctcccagctatggagaaaggtagaccagaagtaagccagaagtaggccagtgacagtggccactgaaaaatcacgggataagaaatggaacagaactcgagaggtcctctgggtcattcccctactgcagcgtgcacctaaatcatttcagaaagattatctacgcttcaactttaacattttcagagaaagatttcttaaagaccagtgggtgccttataatccatcgaagtcacagcttcttccccatttctaaccctaaacacctcttcctgggatgtaaagcgagtgtctttcatcccaccctgcacacagtgtgatttctatcattcagtaatgataaagaacacaaactgccgtctgcaactgccaagcacagccaccccttttccaggctaaagcatctcaattccattagtctgttgccctgagagtctctccctgaccttttaatcccctcattatcctctggacctgctccaagccttgcctgcttgaaatagttaccaccaagtatgtatttgttaaataaaagctgtgtgcagactgcccttttgccatggaacacaaaggaggaggaatataaaagaatatacacagttttgttggtttttattagtctctctcctctctctccaaggagttgtcaatcttctctgcacttatagtctagttggagcactagtccttaggctaaattccaccaaaacattttggttgttcagcaaacgctttcactgtgaccctcacctaagaacaatagagtacaccatcaaatgggatagctctaatgtgaatttagctctaaataaaactaggataaatgcatttgttcagttctagagaaggcatcatactgtcctgtggatttttcatttcgaatgagctgcaaaacaaagttcttttccatggaaaggatttactcaactgaattcactcactttgctgtagctggattaatctcatttcacatcatgtctctaagtagaaaagtaaactgatttacagcaggctaagtggatatgttgatgcatccaacatcagtgagatttattccaactagattgcaaccagaaaatggtgtcctggttgtttttgcttctataaagtagtcgcaaaagtgcaccactttcgtactcgatctgaaaaacagtttatcaaagttacaacagatgaggtattgtgggatgcgacagaacgtacgtacgtcaaatgaaatgagcatttctgccttcccagatcttgaaatggtcttttgccccacaaccttataaaaaaaaatattcattttaggccaggcacggtggctcacacctgtaatcccagcactctgggaggctgaggcaggtggatcactcgaagtctggagttgaagaccagcctggccaacatggtgaaaccccatctctactaaaaatacaaaaattagctggatgtggtggtgggtgcctgtaatcccagctactcaggaggccgaggtgggagaatcacttgaacccgggaggcagaggctgcagtgagccaagatcacaccactacactccagcctgggcgacagagtcagactccatctcaaaaaaaaaaaaaaaaagaaaagaaaaaaaagaaataaataaataaaatcattttattctatccccatgttctgaaagccacccttttttatttttgagttgtgtttcacggggcactgctcaaggtaaacacccagccccacttgtggttgagcaggcattgaccccacactggctccctgccctggagccagccaccaccctgttccttgctccaccttctgctttctgcagcacactctttcttctttttcttctgcatcactctgcatttccaaagccacaatcgtgtcatcctctcgggactctcagtctctgtctatgctggtgccctctcctttgtctctcccagattgctgactttattccagcttctgcttctaacacaataagactgctattggaaatgtttttctgacttctatagctggcagtttctataagcagaagttactttcaaaggaaagaacttgtggagatgagcctggggtgtcacagggctgttacatgggtcaaatgtaataacgtgtatcaaaaagcaatttgtaaactgtaacatgctcttcaaaagtaaattattactgtattatatgactttagggtttaaaaagcagctggatgatatgtaaaaattcaaggctcagtagcatcattggaaaagaaaattagaaaatggggaggggcacggacgcttccatcaacaagctaggggcctctcaacattttttccagccaaagcacacccatttagctgagagcatacactctcttctgaggactgcctgctcaccattctggacctaaggccttccctcttgcttaagctcccccatccctctcatcgccaccttcccaaatcctagctgaccccaagggctaacccccaatccaccctcccttcccagctctgccccagattaagtgaatctctttctctccagcactcagtcttatgttagaattatttatgtgggcattgatcttcctggattgactgtgacctgctgaaggcagcggtggtcctggcatctgccacagccccctcccccaacagcacttcatcacctccgtgaacggaagtgaatggaaggaacagctcaattaggatggcagaggatcaaggagagaattccacggacccaaaacatcctgcaaaaaggctttgtccccagaggttggtcttcaatttggaaaaattcctacctgagcaactgtaggacccctctgaaatggaacagggtctattagactcataaaaagcctcagtgatgagttggttattattattctctttacttttctgtacatttaaagtgttttatattttaaattgaatgtaaaaagatcccatcctatttaaaagttagtgagttgaataagtttcattataacttgattttcttcctaaaggttttcctatagttcaaattataaaagtcattcttagattcccagcttagttcccccatgaaatcacgagttcttagactgtgtttcacacaatgccaggtcacattgcacccttactgaaaggaacttcttgtgcagagtgcggggctcttggagaaagaaaagtaccacttttttagcacattaaaaacaaatccttgagctgttttattattttaatactttacctttagtggagcagaaatgatttatttgatggttttggcaggtgattttttttttcggaatcttctttaacactattagccatgtaactattgccaagtacataataagtactcaataattattattatcttttaattaaaatgtgatgcacttctaaactaaaggtaacttcagtcatgtagaatagaaagcaatgggtggagcttccaattgcttctctttggtattcattagaaatcatttttgaaactgagaagttgggggaaagatcagacatttttatggaaactgcattgatgacagcagagtgtaattttgttggtagtgatttgatacacaattatttgagggatttactgtgctcatggattagcgctgtgttgttactgtaacagaggattggcgcagagccctggcccagtgcaaagctctctaacatcgtttctcttccttcatcagcagcccaaagcccccctctctacaactccatgcagcacagtcctggcacaaacccctaacctgaaattccagccaatttcactaacaacacgcctctccccttcacctgccagatgcttctcgttctcagacactgcaccctgaaattgggagctttcactgagttaaaaaggcaaatatagaattacctagctgtatcagtattttaagtgcacttgtagacttaaatgagagctcttgtacaaaaccacttgtattctttcttaagatatgctaatttttttctctctttgattgaactgttgaccttctggatatatgactagttattacttcaagtatgtttggaactattcttgccctaactgttctaaaatgtaattagcattgagacattattgtagaagcacagcacctggggctgggatctcattagatggcaaaaattgagcagaattgtgcatgctccatgctcaaaatatctctaagaaaaattaatggcattagggggaaagttaaaattggtgatttcgtaggccctttcttgctcacatatttgattcgtataaggatccaaacagaaaggagattgtggttcttctgtttaaaaaatgaagacaactctgctttcttagaactcttcttatgtaatgtggctgctgtcacatctctgggtcaaccaaaaccaaaataatacattttctggctctagctttttcccccctcaagaaatgcatagcatttttaggcattatctgatttttccttgcaacaacagatgttacagagaatgaatattctgtaagaggtagttaacaaagtgtggaaaaactgaggcccaaagaggtactataactcacgggtttttcacgctcctccctgaacattcccgcatctcttctactggggagggagctctttattttctgaattgaaaaccatttcatgcctcctgctcagctatttcagtactggctcctaagtttggcaccaatcccaactgttatgaaatcgcagacgaataataacgaagttcttcattgctgggatcccaaaaggttatcatttcgagttcattgcagggcactttagacgtccatattgggccctaaatgattggaaccatcaggagagggcttgcctgactctgccattcacctcatttgtaagtctctgccgtgtttcgacactgagttgtgtcttgttgtttaaaaataacttctcattataataacattttcccttaattgaaaaaatatttctgacctgaatttattattgtcatagctgtgtgagcaagcagagtcttgtttgcctctacaatatattaataatgtattaattagcttcccagtgctgcccaaacaaggaacaaaaaggatttatctaaatcatgaaaactgaagtgaagcgaacactttggtaattatattttaagggcagtctcagcatttgatagtgtggcaaatttttgtcctgccttttgagagaagataaccaaaaacaccactcaattaacaaaacgttgtttagtacctactatgcacaaagtctgagaggtaaaagaggttaagacaaataaaattgtccaatttatttttatggccatagttaaaaggcaataaaggcaagacactgtgagtattttgatttagctacaattagctgaaatatactacatcaaatcatatgaaattgacaatatctgggggctggctgccgtgactcatgcctgtaatcccagcacttttggggcccaggataatcacttgaggccaggagttcaaggctacagtgagccagggttgtaccacggcactccagcctgggccacagtgtgaccctgtctctaaagaaataaaaataaaaataaatagaagatattgacaatagctgaccctattttttaccccaaaagtggtgattttatataatttaatctaatattaaggtattcttgtcatactgtaccagctcctaaacattatacttttcattttacttctatttctaagctatcattattacaacaaccaagagaaggtaaatacaggtcagagatttgactcctgttttttgtatgtatttatttttgtagattcacaaataacttatattttgcagttttaaggtttctaattatattagaccctgttttttattttatttagagtcattgtccttgctgcctgtccttcacatgtgacaagtcaattcttcatgccatttccttcacaatcttcatgcaaactcatcatctccatttccatctattcttcagagatgtatgattgcagaaaactccccttttttgaaatattgctcaatagagattaaatctaacacccagttttacctgtctatccttgaattacaggttactgagaagtcagaacagatagccatagaagtaccccactaaatccattcttctatctccttcaatatttgacaaatatttactaagcatctatcttgagcaagcattggagtaagtcctcccataaatatgaagttgtgtaaataaggatgcatgcattcatgtaaatacaagtttaatgctggatatatattgttttaagtgcctgatatgtattagtctatttattcctatctaaggggataagtgccattgttgtttccatcttaaagatgaggaaactgaggccagagagattatacgaactcctaaaaccctaactcttaaccacagcattcagaatctatctggttgtagtggaggacccaatgtcaaaaaagcaagtgcttttcccagaccatgaacacaatgtgtgacaaattagcagttcttccccttgccctaagatagtaaatatccacccaggccaacttgtgtctgtcagagaacaaagagtgggcttgtcacactgttttctcccaagagggtccatctgcctccgctcctttggtacacgctaggggacacacactgtccagcatattcttgcagagtcatatcttaccccacatcttatcacaaccctgctgaatgtcaggcactatcaagaaaatgttcactcatcttcttcccgttatgcccaatgtgtgaactgataacacatctaaattcaaagaaaatcaacagacatcacctcaatcaacctgaaaagtctggtgactcattcccacccttctcacggggctcctgctgggctgcctggttctccggaaccagcctccaggcctcctgcagccggggtgcagctcagtgttcgagccccctctctgctgcccatcagatgagtgttgactttctttggcacaggcatttgagttgcatttgaattgcagaacatgctgcccccattctgtgctgactgtgaccccacttcatgtgccccagaggcaggctaaacaagcttgccttggaaaaaataacagggaagaagatgctgactctccaacccccagagtaagttccgtcactctggaggtaaagtcataatatctaaatatggctcgattcatgtcaggtcttataaatacacacacacacgtggatgctgaaaccgtgcatgccctgacagccaaaaaaaaagtcaaaacgacttactgtctcattagcaggacaagacctgataggccagctcaccagaataaagaatacaaaaaatgggtatttaacttctctacacagacacacacacacacacacacacacacacacacacacacacacacacaatctgatgtaacgacctcaagagagctggttgccctggcaatgaagaatcgtttgtatattcaaggattttcttgtttaaatttaagctagccacttgaacttctcgagctttcttgagcttagcttcaggcctccatccccagacagaggtctgacatctatgtcagcctctagcaaggcaggaagcttagaagtcggaccaaaacctcacaagccagccagcctggatttgaatttcagctctatggtttctcagctgtgtgacctgggttagctgcttaaccaccttgaacctctatttcctcacctgtacaatgggaataataaaattaaaacaaacttgcatgggttcattatgaaaattagattgattgatgacataatacatagcaagcatttagagctgtgcctgattccgaatgtgagttatctgtaatagtgacttgaaatgggtttacactgcctggcaggaaaccattcaattcctttttgtttttgactttaatctttgaagcgctttcatctcatttcttcttattttgtgtttgtggagaaggaggatgtttagccatccttggagtacaatcttttattaaaaaccattattaagtctcttcaagtttctcttttgtagtaaatgatctagattacttaatggttctgttttacatgttttaatcatttatttgaaccatctccagatgtagtacacacagaaatattgtctaggaaaatgtgttactgaaattccttatcatctgtggtccattagctcaaatgtttaaaacccattgtttttatttttattatttatttatttagttatttttgcaagacagggtctcactcttttgcccaggctagagtgcagtggcacaattatagttcattgcaggctcgaactcctgggctcaagcaatcctccagcctaagcctccccaaaacttcttattcttaagagcaaagttgagttccatcatattgtcagttggtttcactccatcatattgccaaaaccacctaattctcagatgcatagtttagcacaagccaaaccagaagagaccataggtcattcattcattattcattcaacatttactaagtgactgctgtatgccagaggctgggctatgctgtaaagtcacaaagaagatacttctcagttgggagagcttacagcttgagagagaagacacacaagcaaacaaatcattacaaatgcctttccattgggtgccatacttgaaatgagaagatgaggccagggtacccttggggcagaagggagggaggattaagctcagggaacagctttacagagaaggtaacatttgcaccatattaaaggatggcaagaattgaggagtacaaaaaggagaatagtccaagaagaaacactcagggatgatttgcacattgtaaatttaggtaaccttacatgccttacatggggctgctgtgactgaggcacagggtcaaggaagggagcagagtcataaagctacccaggtcagccaaggccaggctaggaggcctgagctttatcctgcaggtgtgcagagccagaggagagtgcaagaagagacatggcacagtctgatctgttttgcacaaatcactctggaagcaatgaggaggggagaatggaggtatttgagcctagagtcaggaaggagaagtaggatgccagggttgtggggaaagacgataaagcccacacaaaggagggctgatggaaagatggaaatcaatttcaggtatatttaggccaggtgcggtggctcgcgcctgtaatccccacactttgggacgccgaggcaggtggattgcctgagctcaggagctcacaaccagcctgggcaacatggtgaaaccccgttctactaaaatacaaaaaattagctgggcatggcggcatgcgcctgtagtcccagctattcgggaggctgaggcaggagaattgcttgaacctaggaggcggaggttgcagtgagccgagattgctccactgtactccagcctgggcgacagagtgagattcagttaaaaaaaaaaaaaaaaattcaggtatatttaaaatatagtgtttagagacccattagtggaagataccagatttgagaaaggggaggaaaagacacggaggagtccagaagaaatttccagatttctggcctggataactgtgagggcagtggtgccagatagtgccagaatgaaatatatagattggcacaaatccatctctcagaaatgcacctctgagacatctgttctgctgaaggtcagtagggaaggccaacttcatgtgcaaagagcaatatgtgtgtatttcttactagctattctttttaaaatacttcttaatatatgggacatacatgagctaagatagtattcatgcaggaggtttcatttttcattttctggcaattgtgttttcaaatatgagatgctagcattatttcagttatctatgcctagcatagtatatatctacggttcaagattattaattgtctcccctgcctccccactagaaggtaagctttctgaagccagggattttgtctcttttgtcctcatctccattcctagcccttaaaactaagtttgactcccaattatcgagtaaatgattgaatttccatctgagtaaaaagaaacagtcatttcctttactaatgaggaaagaaaaggaaaacaacaaacaaatctggacttaaaacagtttttacaaaaagatccaatttgcaaaaatggaactgaagtttaaaagctacttttctccctgcagctctacttctgggaaagtcacagctgccagcttagatggtggttttcactgcccggttacaaattctgcacagttgtacatattggcagggctcagcttccttaaatgccattggatcagtagggaaatggtgattttccttattgatttaatgccagttcctcttttatgaaaaatcccacgtgctgctcactggcgtatgtaccataaaaactgaacgtagggggccagaaattaagtaagtcactcatgttcttctccagccatgtgacgttaaaccatctctactttcaggctggagtgttcaatcattctccctttaaatttagcagagtgattattcctcctggtggattgcacatatgctcctttgatctatgaaatactcattctggatgaactttaagctcccaggaaatgcatgtaaaatactgtttataaatcgcgggagaaatgtttcacattcttattactcccaagtaatcataccaagcctctctctccaagattcgctttttttcctagaagagggaaaaagaacttcgggcagtagcactgtgacaatcatcaccacggtcgtactttccatgagttttacgcagtaggctcacggaagtgacaatgcatggtcgggcgcggtggctcatgcctgtaatcccaacacttcgggaggccgaagtgggtggatcaactgaggtcaggagttcaagaccaccctggccaacatagtgaaaccctatctctactaaaaatacaaaagattagccggacgtggtggtgggcgcctgcaatcctagctactcgggaggctgaggcaggataatcacttcaacccgggcggcggaggttgcagtgagccaagattataccactacactctagcctgggtgacaaaacgagactccgtctcaaaaaaaaaaagaagtgacaatgtaggatacccattcatcagcaaatatttaatgtgagcaggacaatgtgctaagtccatagactgcaaagaggagtgaggctgggttcccatcctctggggcttacaaggtagctggagaagtaaaactcaaaccacaaagtgaagttaatagtcaccaatgaacaacatagtaagctctgcactggttcagaagaggacaggagtaacaagacagtaatcctaaaggagatggacttgaatttgagctggacctgaagagtcaggagctagagtgagtaaaggcagagtggtgggaacatttgtgaatcaaagctcaggtgggggttacggcaggcagggtggggatagactgaggatgactttgaatgccatgccactctaaggactttggacttgactctacaagcaaggtggaattattaagagattttgagtagaaatgatgtgagctgaacagtgcttttgagaaactaaatctagcagggatcagtgctccaaattaattggacatgtttcagacttgagatcatgagaccctgacccaggctggggacaatgggatgtctccatcatacattacattcctgtgaatacttcttacagattcatatgaaattctgcctcaatgtgcctactgtctctgcactgtaagacagtgatattgtgatcctgtgtgctgcttggaaccagcctcattcctttagcaccccagtttggacttggagtgggcccaagtgcagcctgtacacaaacctcaaagaatccaggcagcatagatgtaaaagcttggagccctccaagtccacctcctcaacttaccaagaaataagctaactcttgctcatctccctaatgacggattcagcatgtggcctcagatcttcctgtgctccagcagtgcttctgaggccagtccaaattctgctttgaggtgtgcgtgtgccaattgtggtgcaatccagaagcattttggacgaatgaaggagctgtttgtgttttcttgccctaattgagatagttgaagctcctctcccttactctacaccaagccccccagatccggtacctccctgagtccccgacttcatctctgccttgcttcttttccacaacaccctatcagttcttgcatcctgccattggttgtgctgtcctcattatctgaagcctttacctcccctcttaggcctcatcacctccaggagactctccatggcctcagcccctcccttaggtggaccaagcttcctccttggagctccatgctaccctgcatagggctcagtcactttgcctccatgatgtcttgcaattgtctatttatatgtctgcctcctgtccttcaactgtgagctccctgaggaaaggaactgtgggtatgcatcattgaatactcagcatctagcacggtgcctggtacacactaggtattgaaatgtctgataaatgaatgacagttgcatatttgtctttttggtatattcattcatttggtaaatatttattgagtaattacttataattgaattggcgctgtgtagttacacttaaacatcaaaatgagcctatcctctcaagctccaaattatgcatgcataaattatacatgtgaagtgttaacatgcacacgcagcagagagtgtgcgtatctacaaataccagagctagcaaatgaaataaactgtgtgccagatgtccctgaaatttacaaagaaccaagaaccaaaaatgacagttagctccgtaagcccaacaaaagaaaaaaaaaaaaaaaaggaaaagagcaaaaaagcaaaagaacaaaagaaccttgagcataaggaagtggctatggttttttctacatgctctagctgggggtggggaaaagtcataaaagcattctatgctggaccggttcgtgttaagtctgagttcctcaatcgctggctctcaggagctgtttggaaaattcgttgccatgcatgagtcgggggattggttttttttccactggaaattgttaatggggactgcattagcggccccttatcgctttgcctgatagagagacagcaggttcgcccaaacaattctggaaccctgatcactgccaattaggggagtattgtctggctgacataatcaagtaagtataaatatatttatcgtgattggaatggggaagggagactgcagaaagattgaggcagaagctgccacccactgcctggctccagcctggatccagcccagtttgtcaccctgtgctcagcagaggcggtcactggctttctgaggtggaatgcacagttgagaattcaggactagaattgcttctcccagagagaaacttgtctcttctcatttttcctcccctcttcttctctttttttcatgctcacttctgtgagagctgaaaagagaagaaaaagcagatgccacgttgatcacgttttaattctgcccccccggccatgctatccccacttaccttctctgtagtggaaagtgatggtgaggcacagtgccctgactggacctcccatcctctcggcccgccggcatgtgcaagttggtctggcattgggtttatttcattgttgatttgtggagctttttgggaatacctgtgatgtgaatcagccctgggattgaaagaccctgaaaaaacagtcccttgcagtgggctagtgacgggaggaattgctcacatttaaacagctgaaaagcagacatgtttaagtcacatctggtggcattcctgttgtctgaatggagagcaaggtctttttaagcatctgcccagatttcaaaatgcaggctgcatcttttcttcctcaaacaaatggtcaggatcggatatgaatggcctaatcgcatcgggagaggtaaacaaaactgatctcatggctggatttcaaccttggtccatccaggcccaatcgatctaaggcatgacttttttttttcctctcacccatgactacttgataatggccatttccggggccaagttcatttcggctcttttccaccatcccccgtgtgctgccctgtctcaccacttgagggctgaggccccttcccaatggctacaacagggtaaggggaccctgtccttctgtctccttcatcctatagtttgtcttcacagctgcaaattgctctcaggcctgccttcctggatttgacaaaaactattttcttactggtactatggataccacaagtggagatgtaagtaggaaggtgcaggtccacaaataaatagggagcccagatgggagaaatgtcattagagagatcactgtccctaaaggcatctgaccacccatgttcctgcctctttctgcgaccattttcctccttcggctgctcagaaattgtcgaggccaaactcctttcacccagattccagaaatacacttatttcctttgctttccaaatcttaatggatgaaacacctctttttttttgtcttctatctcttgccagaaatattgttttttgagaaccagagctcatttatctccaagggagaaagaaattcattccatgtttacccattaacaaattaccacttacatgaaaatactgggacttctctcattctttgctaataaatgggttattcaccttggttgaaccatggcagaggcagatggatagccactattcccttcaagttggcttaatattctctcgttggcttttgtctccttgaagcacagagatttctcagagctttctttgcttgattctgcttttaaggaacgtgcccaacttatttgagtctgtttgtttagtaagctgaattgattaaatccctggcatttatggaggagcctactgtgttgggtgctatgggttcctccccacttgaaagttgaattggagtcacccatctgaatactaactccctcctaatccattggttttcctgctgtgtagacaggggtatgaagtagccatttaccaagagatagtgcgatgtcataaaccgaacatgagttctaaagttagcaagacctggtttgtacagtagtgcaggcttgggcacgttgctgctctcttttgagtcacacattcctcattatagatgctgatgggaacaacagagctgtctgttcatctttgctcttctccataatgagataaagccaaacagacagtgaagagcctggtctaaccacataacgttggtgcaaattatatatggtcataagaaggtaatttttacctgagcatttaggtggcatttggtgtggtatttgatgcatgtcatttagttacagagataaaacctcctgaacacacataaagctcttggcctggttgaacattacatctcacagatttttatgttttttactaaggatacttcctgctaggaagttgtaaaagagaagatggaagtctttttaatggtattgtagcaatatcagtttcctagctttgatactgtactatggtgatgtaagatgtccccattaggggaagtggggtgaagagtacaggggacctctgtactatttttgcaatttcctgagagacagagggaaagagagaaagagagagagagaggagggaatgagtggagtgacatgaaaaaggagtgttcatcttggcttatgtccctggctggacaaatatttacattttgtttgcctctttgtatagattttgtgaatagtcatggttaaaagctagcattcccttttctgtggaagagaagaaagataatagaatgagctgagaatccctgccaacattatattagaaagccacctacttcctgcctctcctcaccctccttacctatacaaacttaccttctgcatctttgtcctccttctttcccattcaaaggggagatgcgtctcctgctgaacaaatgaactcctccgcatgaccaaggtgtcccatccctccctgctgtctccaaaggttcagtcctgctacataatctctctaggtgaattccttcttactcagggttttcacaatcatctatattggaatagcacccaaattaatagctctacccagacttttttattgagttctatacctgcatagccaatccttgactgggagtctctacatagatcattcacaagcatttcaaacacccctttaattatctcctctttctgtattcccttatctcagaaaatgctaccaacatctaccctaatgcccccagcaggaactcaagagtcgttctagacctatgctgtcccaagtacttcaatgtggcttgtccaaattgaaatgtgctgtaagtgtaaaatacacaccagatttcaaagacttagtttggaaaaaataatgcaaagtatctcaataatattttatattgatttcaaattgaaatgataatattttggacatattgggttaaataagttattaaaaataattttcttttactttttaaagtgccaccaaaatatttaaaatggcataatggctggcatttgtgacttgcattctatttctattggataacaccattctagactcttttctgtcttttagcccccttccaactggtcataattcacagtgattcccttgagttaagacaagggagaatactgtttaagtgcacaggctgagtttgaatcctggctccaccattttttgatacatatgaacttgggtgattatttaacccctttgagcttcactttcctcatctgtcagctggatacaatagcagttcttattttgagattcttgcatgctttaaatgagataatgtgtaaagtacttactatggagataaaaacatgtggaaagacccagtgtcaaaagaaagagcatgatctgtcactgttgtagttcaggccctcatcattactagccaagactactgcgatgctttctccatcttcggttcaccctgccctccattccttcatactgccatctgattaaacattcctgaatgcaaatgttttcaaatgtccaatgacttcccatcatccttggtatgaagtcctaagtccctggcatgctttcaatgtcctccatgatctgcccccagtccaatcactgatcccatctcctgccagtccatgattgaaccagttgggtccccaactcctatttgcacacaccattctctctgtgtgtcatatatgagctctctactctgcctagctacttgtctgcaagactcagttcaattgtcacctcatttgggaagcttccactaatccctcctgcacctgtctccgtcctaggctagattaggagcctgccctttgggttcctgaaccacttgaggtgtggttcctttatcatgctgatctcactggtttggctgacttgtttttcctacaagactgaactgtctgaggtcttaagatgggctgtctagtccacactggatcttcatgctctacacagggcttgacacagagtggggcacaggaaatgtttgttgaacgaatacacaaagcatatggatactcctgagagagagaaggtgggcaagacagccttgtgaagttaagcagcagaaaatctgaaaacgaacctggatagaaatcaccaattcctggaagtacagagagaggaaggagagagaagaatctgtgcaaggagtcagtaatggaggacttgaaatgaaaggctattaaagagagaagatcattcaaacaacagaaccacatttggtactgttggtggttttgtaacttcctctgaaatggttccaggaagagacaaggttctaggatggtgcaaatcatataaagaaaggatggggtattataagccaattcaaggattatttgtcatcaggactagatacatgggtggtacaagtaaatgtcaacctgatgactacacgatgggactagtaataatttactggggctggtgcccaggaaattttttgctgtggtgcagatgccaagcatggaaaaatttgacgagttataggcatgagaaagtagatggcgaatttgagagtaacaatgtaaaatgccagagtaatcacaagagaaatgtctgaatatgtaagagagtttagaagatttctgctttaccacaaatacggacttcaagaaaaattcccttataagaacagaaattccaatatataaaacttatttatcaaaacacacagtattccataatatataatggtaaaagcatgccttttgacccacacaatattaaaagcagcaaataacacaagaaaggtagagaaaacagaaggtacaacattttgtggctcacaggatatatgagtgagattatatacttctattccaaaccacaaccttcactagaacatctaaaggcttcattctagaaccttcatactgcttatcccaaaggctagcccactccccggttttcatgtaagaaatcttgtgggacaggcgttgcatgaggtgaggggcagcagggaaattcgagatgaaagggtgaaaagatcaaacgagtccttgctattcttcttaacaatgcttcagtccaccactttgagatttctgtggagaaagtaaagatttgggatatacatatactaaaacaactattggttgcttatctgaaaattaactttagctgggcattctgtattttatctgacaaccctacttggtgaggtgtacattttcttattcatacttcctgcgagccacaacatgtcttaatagttgttagctattaaggactatgcataaaagtgacaatagctggctgggcacagtggctcatgcctttaatcccagcactttgggaggctgaggcaggaggatcacttgaggccaggagttcaagatcagcctgagcaacatagggagacccctgtctctacaaaaaaaaaaaaaaaaaaaaaaagctggatgtggtggcatgcacctgtagtcccagctatttgggaggctgagacaggagaatcacttgaacctgggagttggaggctgcagtgagccctgattgcctcactgcactccagcctgggccacagaatgatacctgtctcaaaaaaaaaaaaaaaaagtagcaatagctaacaactattgaattattgagtgcctactatgtgccagacaccatactaagtggattagatggatattccacatattcttcccaagaacattatgaggcaggcactattatcatccctgtttttaaaatgaggaaactgaggctcagagatgttaaataacttgctaagggtcactcagaaaactagtagtagagaagggtttgaatgctggcagcctgactccaaggctcatgtgcttgcctaccttacccagatggcggcagcactgagcaaggggtagataacttcaagtcccctggaagaataagagaaagtgagaccatggggtatgaggggggcaggccctgagtaaagctttaaaggagcagttgaaattagacccggtgcctttgtttaagtaagaagaatgtgctagttctaaacagatgcagccccatactgggactcacagcttgatgagaagcgcactggatgcatttcagcccttactgcaacctcagcctgaggcctttatgcagtgagcaacctgcacaaccatacatagcaatgtgagtttgatgggagaaggaagaccagtgcagagacaaggatgtcgatggagtgcttagagaacaaagggaagctatttactaaagcatgtttgcatggtgcaggtgattttctaaagttaattttgacagacaggatggggaaagattgttgaaggcctgaaatgacaagagagacttgagtggatctgggaggtcatgtgacaaacatgacattaacaaattctaaatggaaaaaatgaccctcagaaagttgtgtgtcaaggccgggtatggtggctcacgtctgtaattccagcactttcggaggccaaggcaggtggatcattagaggtcaggaattcaagatgagcctggccaacatggtgaaactccatctctagtaaaaatacaaaaattagccaggcgtggtggcgggcacctgtaatcccagctcctcaggaggctgaggcaggagaatctcttgagcctgggaggcgaatgtttcagtgagccaagattgcgccactgcactccaacctgagcaacagagcgagaccctgtctcgaaaaaaaaaaaaagaaaagaaagaaagttgtgtgtcaaaagcttcaacacacaggggcctttgctctgtcaagcaaggagaatagggtggaggaggaacaggaacacagtagctaaggtgacagctgcctcacaaaaggaaagtctatggcttgcaaaagaggtcgaggaaagcggaaaagcaattgccgaagagggacagtaagtgaaaagatgagtttcttccacttggcatctccccaaatatggccctgaaggaagagttgaccctgttacggtttctttctttttcctgtggggttattagagtgacatataagaaaagggccacaggcacggcacagcttgatttcagccaggctttgcatgacaccctacagagcagaatgaggacagataggctgaaggataactacttaactgggtaggtttcaagttgatactcagagtgttgattaaagggtggtcaatgacaacctggaggaggtctttaggtaaagaaactgagttcaaagataaccaacttgcatgaatgaaggagccaggatttgaacccagccctacctgattcaaaagtccattttccatttattataaaacaaaaaccaaaaaggcatgaagttcacttatgaaagaagagttgaaagatataaccagagggttaggagtacaaatccatgcccgaatgaattgtgataggctgagaaattggccaaagggggagaacaaaaacacagtgaaagtcagaaaggttaaatgtgaagccctgcattttggtttcaagaaacccgttgcagaggtggagaggtccagcttgaccatcttcatgttgggaagcacccgggcttttgttgtagttattgttgcttaattcccaaacagcagcggggtgtgggggcacacgattgtagccccagctactcgggaagctgaggcaggaggatgcctaaagccccggaggtcaaggctacagtgacccatgatcacgccactgcactccagcctgggcaacagaacaagaccctatctaaaaaaaaacaaaagaaaacaaaaaaccagccaacagtgtaacacaattacaaaatcttcatgtacaaatgaagtgattaaatcatcctattctactcagcccagctcagaccatatcttgaatactgggttcaagtctagataatgtattttgtattttgagaaaaatattgaataactgacaggagacctgaggaaaatgaccaggagatcaagagttggaaccttgtcacatgaagggtggtcaaggactctggggttatttcagcttagaaatgggaatttgggatttgtgattctcattttctgtttcttttgttcgttcattctttctttcattctttctttttctttcttgttgtggttcttagcacagaattcagatgaaagagcttttgattcaacgtaaacaattcaccaagctgtcagctcactccaatcccagccgtccccgatgcccattgtctatcatctcaatgaattagggaaaaagactgactttctgggccacttccaactttgagaatctaggataggggcactatttaatcaaaactggcaagtaaaaagaaagagaactattttaaacaagacaaatacaagaggtgttgaaccaaactcaaattagaaagaacaaaatttcccaaaaataagaatattataattcatttgatgaaaggaatttgccatattatcccttttactggcatttttttagtacctttacttgtaaaaatgtcaggccctcccacttttctgggatagacttatcgaatgaagcaaggggagcttctctatggatagatgatcacttttgcaagctttgagatcagtgagctgaaaaaatgaccagcattccaacaacaaatgagggcttgggagcgtaagtaaaagtgacagcaagattaaagtaattgtggtcatgccgtcctctgctgacacttttgtgttttgcccagatgagaattaaggtagcccagggcacaggcagtgaggaaaaggagaggggcgctgagcgtatttgcagcatttgtgaaccatgtcacagccctggcgaaaacagagcaagaagatggaggctttcaaatccatgataaataagccatgctttcagagcccaaatcagtaaaaacaaacattaagtgaacagaagggaagagggaaaaaaagagaacatgaggccaccataaaatcctggtgatatattccaggggaaatcatgatgtgaatagaaaatgagaagtaaaagaaaatgaagcctggagatttgtaaaatgtctgtctgtctgtctgtctctctcgactgtcattcccatctacccctgccacccccaccccgccctccacccttctgatggggttcattagatgatttctgattcaggggtggggggcggtatttttaatgcttcacttatgtttgggttttgccagcaggatccgaggtgtttctgtagacaattgttattgctttaggaaacaataagaataaaatgaggaaacatcaagtgatacatcagtctagcagcagagtgaggctcgaagtagcatttccagcgaggttggtggtctctttttgccttatttttgttgttttggattgatgttttcatggtgtcattttaataagaaaagtgtcagagaattaaaagtggaagtatgcgagatacactttctctaactggattcatggtaagttattaatgtttcaaggagaaagaaaagaacttggaaaaagcagaatatattgtggggaaagttgatgaagggaaaggtaagagaactgtgacaaatgagacacagacagaaggagagagagagaaagaggaagagagagagacagggtggtgggggggaccggcagaagaaaaggaaaagagcgacagtttgtaagtctattagctgagattgtttccatttctgcaattgccttaaagcgcatgattgcttggtctgaggtctgccaggtcgattgcagtctttacctctttgaccaagaagtaatgggcttgaatttcctgggtatgtgaaaattgctcttgaatgttttggctaaaggacagccacccaggaaggttgagagggcctaagctagtgagcagtcatcctgaccaagtaggagggatttggttatgttgctcgtagcaggagaggcagagcagcaaagtgaagagaacacacagccttaggtgccaacagacatgtactgaaatctcttgcctccatttcccacctctaaaatgcaaaggatgatagtaacaataataaatgttgcaacgggtgaccgattataaagttcttgtcacctgatagaccatatcaatccatggtaacttattcttagctggttcacgtttctaggcattggcacagtctgggtggtgtgtgtcccctcaaaggtagcatcacagtgactgagctctgcatagatggcaaagtgtagaagcctggtcagttttctgtttctccatccaccatttctccccacttccccttggttagtgctgtcttctctctttcctcactgaattgtcttgattagtgtcatactttctgataacactgcagctaggactccacaggcaatagggagaagctagcgcctgcccagggaaagtgaggaaaaataggtgcttgagaggctgaaaagtagtatacgcttggtggccttacactttgtagaaacagttttggatttgtctctacaagaaaggattgtagataaccagaatgcaaaaatgctttgaagaaagagacattgagcattggaaccaagtattctacgtcctcttccctgcaacactggggactaaggattattatctgcatttctggtgaagaaactgaggcacagagaagataaactatggttctccggctacaaagtaagcagcagagcctagagtttgaagccaggtctgacacctaagtcccgtagtaaacctcccactgaggtaggcaagcctcgccttgcagagagtggcaaattagggaaaaaagaatcaaatgtgcttgagtttaacagaacatatacattatacttaaagagaaagatacttttcttacaaaaagtttgaggacaaatgagacttcatgtgatgcgtcttgcactaaaaaaaaaaagttagattatataagccagactggcgttgattaaagaagagcaaggtaataaatacgcataagaagaaggaagtggctggctctaccttgggcatcacccaagttacaggcaggggaggggataggccctgcatggggacagtctcctgacttgtcttcttccttctctacttccctcccttcactacccctccctccaaaacccaaaaaaccttaagcaggaaaaaagggagctaattaaaaaagagaaaaacatccttgagaccaatgaagtctccataatccacagtgacagacagggacctgcagaacagcaatttgattaaataaggatataagggatttaaaaggactctccagttgtgtaaagtgtgtccatacgtctgaaaaataccgtatttatttggctcccaaacctgaaaaccttctgacgggggagattgttcccatttggaaactaggaagaaatcacaaggcaaggccatggggttctggcagggctggggatcccatgttgggtggaaaccccaagaagccagccaagggtctgcaggaggggccctggcagagagaagcattagaatgcaagggcaggtaaagccaccctcacagaaggtgactgtgggctgagcctgaggcccttcccagatggggaagagagaacagcacacctctcctgcccacgcctcggtatctcactcaagaatcagctgcccgttagtcacctgtcatcggagacagctctgttggcggctttcagaaaaagcgaagcagccagaggatgaatcgttattcggggaacacacctgcacacaggacaggaatggatgggagtggggagcgccctggggctactgttcaaacgccatcctcatggtctccaagacttgcatcagcagctcagccgctgatgaattataattctcggacaagctgcagaggcccccctcgttccatgtgttcacccctgccgctcatactgggggatttatgcttcctggggctaggaggagaaaataatgagtcactggggacaagagaaaaacaaaaatgccctgtatgtgcaaaaccacctaaaatggaggcttttagaggacactcaaatcccagccaactagccagaaagggttttgctgggggtatattttatgtgtctttgctatctttggatgcagtaaagccagaaatgtttatatctcttggagggatcacctgtgcaaacaggacaggtcctcttgagaaggctgtttgttctcctgggatctcgaacctgagaagaaatggtcctggcctggcgcggtggctcgcgcctgtaatcccagcactttgggaggccgaggcaggcagatcacaaggtcaggagatcgagaccatcctggccaacacggtgaaaccccatctctactaaaaatacaaaaaattagccgggcgtggtggcaggcgcctgtagtcccagctactcaggaggctgaggcaggagaatagcatgaacccgggagctggagcttgcagtgagtggagatcttgccactgcactccagcctgggggacagagtgagactccgtctcaaaaaaaaaaaaaaaaaaaaagaaatggtcctgcatctctgacttgggaggtccaattaagcagaggaactgttggctgtaaaccttctaaagcagaggatcctttgggaggctgaggcaggtgatcatctgaggtcaggagttcaagaccagcctggccagcatggcgaaaccccatctctactaaaaatataaaaattagcggaccgtggtgggctgtacctgtaatctcagctactcgggaagctgaggcatgagaattgcttgagcctgggaggtggaggttgcagtgagctgagattgtgccactgccctccagcctgggtgacagggcaactccatctcaaagtaaataagtaaagcagaggaccctgatggccacccccaagttcatagctacctgcacactttatgtggtgaagcactggtggggggcccaggaagccctgcatgagttggttgtagctgccatgattccaactcccacgccaccctctgcacctagccacagagccgcatctccagagaaaaccagaagcaagaccccaccaaaaaagaatgtgagagtctattttaaaggctccggaagatgagttagaagtgattcaagagcaggcacagtaaaggaatatgtaagccttggtagacattcagtaagaagggtaacatttccaacatgaccagctgattaacaggtattctctaagcagggtgtctgctggtttagaatagagcaaaaatattgtcatctgagagcccaaaatggggaaaggctactccttggtctcttggtgaggcccagcctgttttgttttttgtttgttttttttttttttttcactttcccactttattttcagaatagattgatttgggtctctagaagaatatttaagcagtggcttacaggcgagccataaggtagttgtccgttctatgcttacaaattttcaagaagggccatctgtaacctttctcagtttcctgttcctatgtccaatgcccaataagaggtaataaactaaggcagaaaggccccaaacacagatgtaagatgcagagcaaagaataacacacagtaggggtttcaatacaggatcattaacccagaatccaagcaggagtgagggaagtccactcaggaggaatgggaaccacctctccaggctgctcaggaggaatttaagcatcagacagtgtgtaggagaagatgaccacgaattctttgacatctaagcaattctgtattttaaaggtttgagtctttgaaatgttaaaattgatgcgccttaaaactcatgagagacaatgaagacaatcaccgaacctgtctagttaaaggttaccgggactcaagatgcaaagaaaagttacgagatggaattgatggtttggggtgcaccattgccctctattggattttaaataaatcagacctcttagtgtaggtatgttgcactatctctggctgagtttgctgagaagtcagggcacctctgagtgggaagttaattgatccttttaaatggctccttctgtctcctgctccttccctgaggaaatcaaccagagtaatgctgagggcaggtcatttgcatgtcttcattcatccaacaaacatttcctggctgcctgctaagcccgggctaggcattgtagagaatctaagaaaaaataacaactgccattcgttggacacctactgtgtatcagagtctacgcattaatacagaacaaccccacggagtaactctggtgactcccatcccacggatgtggaaataggacactcaggaagtggcacattttggattcaaatccaggttcgtctactactaggcctatattctgtccactaaactacaacttttccccttaagaagtttataaactattagggggagataggatatagatataaatgtatatatcagggtttgacaaactacagccagtgggccaaattcagcccatcatgtgtttttgaccttgagctaatttacatttttacatggttgaaaaaaatatcaaaagaataataatacttcctgtcatgtaaaaatgctatgaaattcaaatctcagggtccacaaataaagttttatgggaaccctgctatgcccattcatttaccatcatctaaggccaccttcctggctacaaaaacacggcgagtcattgtgacagagactagatggccaacaaagccaaaatatttactctctggctctgcacagaaaaggtctgacaattccacatctgtactccaaggtgaaatgttctatatcaacaggagaggtgttttttttttttgtctgtttgttttgttaagtgcttgaggagttcagaggaggggaaacaaatgtttatttggcccacagtgtgcagagctggaggggataggcaggtgtgctctgttttaagactcaatgcatgaaaaccctgactttaaaacagataaattaaaaggtagttatttgcataacaaattttcctttcattttataaagcgattcaccacagggttcctttatagagtgagcctccataatacatgctaatatgattccatttacaaatactctattcattataacttttcaagaatatacctattgtgtacagtgaggcttaactgtaatcatttttcctggcagtataaggtttcctacttctgaaaagtgattaagctgaccttgtcaattcgactgggggaggcggcactctcctctactgtctccgagaggggctttacctgtcgaacaacaaggctgtggattctgtctctgcattgtgtgatgttgagtagctggtataattttacattttcactaagctcctctcagtagtagcagcagccaaagtcctaaagtgtaaactactctcactattctcttacttcatttcgtatacaagatacactaataaaaattatttgttggctggaccacggtggctcatgcctctaatcccagaactccaggaagctgaggcaggtggatcacttgagcccaggagttcgagaccagcctgggcaacatagtgagaccccgatctctaccaaaaaaaaaaaaaaaaattagccggatgtgatgacacacatctgtggtcccagctactcaggaggctgaagtgggagaatcctgtgagctaaagagttcaaagcggcagtgagctatgatcacaccactgcacatcagcctggtcaacagaggaaaactttgtctctaaattaatgaactaattaattaattttgttgctgatgtcctgacaaatatgtgacaagcaattcttgtaaaaagcaatgtttccctctctttttaaaaaatttcaagacattatcttatctgaattacaacataaactggggcaagtattcagattagagctctccccagcaaaataggaagtgatagcaatttaggacctgtctccttctctcactgggtcctgagcctgaatcttcacatagctttgtggtgttatgcaattgccctttgtaagagatacataaaatggaaaccttagctattcatagccaacttaggaggagctgaatttgatcaagaagtttcttgccgggtgccattttgatggtaactacgtgtttctgaacaaatccacttataatctgggtttccaatggaggttattttaaagagctgtagcatggcttttgttttcatcctctgtggtggctatattttagaagtagacaagcattcctggtatatagcctgaatattttttaagatttttttggtagtaaaagaagctcacatggaaaggcaagggtagaaaaaatcatgttcagggcagtcctgtgtggcattaccctctggtgaagcagatccacactgcatgctgctaatggctattgcgtgacagctcttaaaggggtaagcgagagaggtgcagagggctggtgagaagcagagctagcactgaggccctacaaatggcatcaccatctatcaggttggcggggtgggggttgggggctgctgctggaggtggtttggctgcccctagaggctgcagcgtctcacactgtatgggcaggtagcatttcagccatttctaaagcccatcactggcagggaaagcacatttaatccgtctgtgaggttctctaaaaaggggcctctcttttctttcttttttttttttttttttaagatggagtctcactctgtcgctagactggagtgcagtggtgcaatctcggctcactgcaacctccacctcccgggttcaagtgattctcctgcctcagcctcccaagtagctgggactacaggcacacaccaccatgcccagctaatttctgtatttttagtagagatggggttttcaccatgttggccaggatggtctccatctcttgacctcatgatccgcccgcctcctgggattacaggcgtgagccactgtgcctggccgaggggtctctcttttcagaagtcagaagcgctgaaattgaaaacagcagcaagaaggcttcattgcattcttgaattcaggctgttgcactccgccccccacaactctgtctaaattgttgctacccagtttatatctgcatcatattttttgttgttgtttctccaatgcagtatgtagtggtggcaggtacagatcataaaacaaatggataatcagattcctttttccctggtggtaatttttaaacttttcaaaattaatgctaatggatatagaggaatgggatatacatttccatgcatttttatgaccaaacagaaaaccgacccctgagggtgacatatttactattctctactactaggggtgcttcaagggaagagtttttgaagccctgtggtttaaacaaaaagagaacataccccaccccaccctgaacaaacagcagctgggcagatttcatctcacaaatggaaatgggagcaaacaaattttttcaaagcgattttataaagagtgggcctgtttagttgggttttttgagccaggattaatattacaagctggggagctctgtgacatggctgtgtcgttggctttgccataccgcctacctcctgggggaaggcagaggaaagtgctgctattcagaagcaattttacttctgcctcggccttctcacttctcactgaagtgatttacagccagcctggacccagtgcccaagcctgagctgagttacatgtcatgttggaaagatcttccccaaatcaaggtcttatctagagcttgcctgggatattttttcatttctaatttatgtaactttctaatatgtttagcatttgcccttcccttgtctccatcctgcttattaaggtgaatttgcatacaaatgggaccttggtcttcaggaccattcacctgacacttgatcccacgaggcgaccactgtctactgttgataccatgaggatgacccacagaagtcatgtctctctgcaaactagaggcaaggccttaattagaagaagccttgtgtgttaaaatgatggggtgaatcaaatcagcaaaggcatttagcattaacttaggagggcagaatactccttcctgttgagtgggtcgtcctaggtcacaacaattttaatttgccttcgatagatggatcttgaagaaagtgtacaaaaagtatatttgtgatggtgttgtttgggagtacgttttgactcaaagagttaactgtgacattttactttggctcctggtctattttttgcttaacatctacctttgaatgggtaatagtcatctctataaattaccttcgaaagattgaacaattgtggagaatcagagaaatgagccccttgctatcaccctgttgcagtcggctttaatcctctgatctcctggcgtttcaccctctcactggcagccaccttccttatttacccaaatcttgttaacttgggtaggaattcccactgagaggacaaatgtggtcccagttgactggtcgctgaaagtctattaggttggagagtatttattttctaccctaaagggtttgaaacttagggaaattttgatcaacaagaaaataacagctttcaagattgtcctgacagttaagctgtcttagcagagaatcacaggatttgatagtcatggagattagttctcaaatttcaatgagaaaagttcataggagatggagtgaggaaagaaaacttgtgctgattttggtcaggctacctttgctggggaaaaattcattccataaaattattttaaaacgtaaatactatttagctttatctggtgtaatactttgcatctataatttttttgttttgttttgtttttgagacagagtcttgctctgtcacccaggctggagtacagtggcatgatcttggctcactgcaacctctgcctcccaggttcaagcgattatcctgcctcagcctcccaagtagctgggattacaggcacgtgccacggcacccagctaatttttgtatttttagtagagacagggttttgccatgttggccaggatggtcttgaactcctgacctcaggtgatctgcccgcctcgacctcccaaagtgctgggattacaggcatgagccacagcgcccggcctgcatctataatttgatttaaccttgcaactttattaattgaatattatgatcaccattttatagatgaggaaatggagactccaagggtttaattacttgcccaagagtctacagctatctaccaacaaaactgggattggagccagctgtcttaccattacatccccgctgcctcctaaagcacagctctagttcatactaaatgtattacataggccgactcatttatctttacatgggtctcatgcattacaagaagggggccactattttaactcaattcaaaaatgttaaaatcaaaattcccaaaatgtacttggtttataatatatcataaaataagtaatctgaccaattgagcctcccaactcgaagaccaagaacttctttctactcccaaaccatgcagaaggaagctgagttccccactggccaatgctgtctaattctcttaaatgattcagatgtaaaagaggaaatggcatccgtctaattaacactgcctggttaaatatagctgccaagggacagccttgggacagtgtttacagaatagtctttccagcccctcaggcctcaagttacagatgatagcaagccttccctccttatcagctgcaaacagagatgcccccaaaagtggtgtcaggccaggatgatgaaaggagaagggaaaggctgcggatggccttcatttcctgctcctggcatctggggattccgagaatgatcccaggacctagatcctatagattccggcagctcttcctgcaaacacaagcccttgttgtgtgcctgagccttgctctccggcctggagacatccatctgcccactctcctaggaactgctgattaccaggaagcaccatcggctctgctgccctccccctggcagagaggcacaatgaccacattatttctcttccagcttcacgttacagcatggaagctgttgccaagtttgatttcactgcttcaggtgaggatgaactgagctttcacactggagatgttttgaaggtaggtgacctggggccccaggggagcagtagggagtttcagttactcagtaatctgacagtccctgcctttgtctcttaagaactgcatgtggttccttttaaaaagagaagttcaccttgattccctttgtgcacccttataccagacaccaaccaggccgggtgatggaaatacagtcggcataagccaccatccttgtcctgggaggttcgtagtctggagaggggaacacatccacccaaagggctgttacagatgttcttggctaagttctcagggagcacaggtgagggaacaagtgattccatcttgaaagatgggggttgtaggagtgtgtgcaatgtgaacgtcaggaatgcactgaaggtgacttgggcttttagctaaagctcagagatgtgcaagcccatgctgaatgcagggagcagcgccaggctcagcagagctggaactcaggaggagaggttgtgggtggagacagcttgggaaaggcagccacagaggacatggctcaacaaaggccatgcacacctggccactcaggggctttttaaagcttgtcctcatcctgcacttgagttgtagtggccacttgctgagctgaagtggccttggacttctcccacattcatgcaccatactttcagactctgcatcttagcccttgggtttttgttttgttttgtttgtttgcaaaagagcataagcccttcaaaagggcatttgggagtgtgtggagccagaccccctctgcctgacctcagagcaccctcagatagcctgatccctggtcctcagatagcctgatccctggtcctcagatagcctgatccctggtcctcagcagtcccaatgagccttctcggacgcccagcaacactgaggccattagtgtctcaccaccgagaattaggtttgttatacaaagaaccttgtcagcatgtgagagggtgacattgaaagtgtctgaggagcacaaaacaccacagaatggcttcttttggaatatgaacatgcccattaggtagccttctaactgctctcaactttcaagatctagtaacatagtggcaaagcataggccttcacaaacttaaaatatgagttgggcctcctgacccaggaaaacctgtctgtcactgctttggggtcttacgaagctcctggagggacttgccaagcagcgagaagttcctgccttctctgtggggcactgtgatcatgtgactgtcatccactggagaccatccttgtaccaacttccaccctcgtcttccattacaaagagaacctggtatcttaagttttctctattcctcagaaaaggaaaaaggaaagaaaaaaaaaaaaaactttgctcaactctgcttcccaatccagctcctgatttctttcctcccctttgttgctaatactgggaagaattctctacactgggcgtgcttcacttcctcacttcccactcattccacaactctctggaatctgccttttaccctccctgcaacattctcttgaagttcaccagtgatctccttaatgtgtagtataatgaccctatggaaatgtctgtgggattgacactgctaactggccctctcctggaagcccctttctccctggctttggcagcaccaccctctccgggttcttctcctcccttcctgaccactcctacaggtctcatttccaagcattctttttcctctcttgatcctgaaatatacacttccctgaaggtgctgcctttggctttctgatttttcttctcactctgagccacctcatccacttcttcagctgcaactatcacctctgtgccaaagaccctcaagtctgtggctcgtgttctagctctggccttgctcttgaactccagacccagacttccaattgtctgctggatgtccccacatgaactccagcccctaactcaggatgccgagaatcactcaaacccccatgcccatctcacccccatttccacccaagccactcttctttccatgttctaattattatcctaggtcagtcacaagctagaagccccaattatcatcaatgcctcctttaccaaatcctggtgaccagtaaccaacgtctcctgagctcctgttcagggccaggatctagctaagtggtttgcaggcatgatttcatcatctcagcaaacctgtgaggtaggcattcatttcccctccatttcatagatgagaaactgaggctagggattaaatcacatgtccacagtcacacagctagcatgtgaccaatccaggacctggacagaactctgtctgactcctaagcactaaactctgctctgaatgtatttttttcctcatatctctcaagcaagtctcttcttcaccagaaaggagtgtgaggcagtaaaaaggagcatagactttgagtcagatggatctgagtttgaatcccagcttactaaccatggagactggggcccagtcatctgccccctttgagctttagtgtcttcctcagcaagtggaggtagtatccatcttgccgggttgtggagaggattcgaggtgatgaccctgtcccaacgtagacgcccaataaatggtggcccgcattatcgggatcatccatccccgctgcttctgactgctcagatcattgccacagctccttgactgacctcattacctcttgtctttttcctccttcactcattcttcttactagtcccagagggatctttccagacaaatcagatcatatcatttccttgctcaaaagcattcaggggtttccaattaccaattgattgagactgaaaacatctggccccaaaccactgtccagtgtcattatgcacatgtacacatgtgtgcacacacccacacagagacatctttgtagatgtaacgcccccaggttgcactgcaatgtatacaccgccctttctcagcctctcccctatatactctgattgcccctctcctacacacacatacttgacctcctctaccatggaaacctcgctggtcctctccactccctaccatcccagggaaacaaatcactccctcttcagctcctccccaacatttcacataaacttcactcatttccaggcacttatgactttgcctcacatggcagctatttataggcaggccatgaccctgtggtctcatgcaccctctatttctacctctcattgctgcctttgccccgtgggatcctaattgctcgtttatgtgttgtctactccactagcaaaagctgtgcaagggcaggggctgtttctgcctcaatgtctagaagagctgtgcctagaactccctgacacttgacgaatgaatgaactttcaattcctctccattccctgagagcaatgtcatgcacgtgtgcacacaatgccaggttcgtctttgtgtcttcacagcatctaacacaagtcatggcccaaaatagatgcccagtacatatttcttgaattgctaaattgcatttcttcctgttcatttagaattccattggaaagccaaccccctccctcttttcaaattctgtccattgcaggtaaagagcaaaatggggagggcttgttgactgagccccacagaatgtctacaggatggtgattggttcccatggctgggactccccacatgtgattgcaatgtctgccccccaccttcctcaatgggtaacacacccaggatcctcacaaatactttcaaagccagctcctgactaccccagcaattcgcttctgggattctctgacttgtttggccttttgtgctaaagactaaacagaggttttcattagaaaggtacaaaaaagtctgagcagccacccaccctcaacagaccatcagtttcctggggcagaggccccagcttatttatctccatatttcatgcacctaagtgcaatcagcaggtgctcactagatggtgatctacacggcatgtagatcaagatggtggacaggaaaacgctgccaaatgacttgatcctgcttctcctatgacggaaacatttggaaactcaggaatcagatttttttcctattcatgccacaaaccaccatacctgcagctacacacagcaccagcctcacatttgaatttgccattaaatttgccagtagctttgaaaaatatctcttgacccagtccatttctgtctccttctgtaatgcagctaatgcgacctcatttcttcctgctaaaatagcaacctaaaagcactaagagttaattccacataattcatttcttcaatacttcagatttttgctatgtttctaaaagctacaatttcatccaatttaaaaattcttccagccgtaatttggcccttctcttcccacgtctaacttattcacaggccatgtaacccaaaaaatcatctcttagggaacattataagaattaagaaacagtcaagagtaaaacttcaagtgttcaggctgaacgccttgctcaggtttacacgatgggtacacgagatagggggaaccgaacagatggagagatgagaagaacaggaagtgtggggccctgggcccacaacggcaggaggaaaccatctcccctcccctcaaatacttttctttgcagaaaatgagaattttttttaaaaaaaaacctcaccttctatacatggtaaagagcctgcaaattcacctctctagaaacacagtgttaggcagaccaagcaccaggtggcggagagaaatggctggcattgtgggataatctttcagtttctagaggaggtctgaggcatgataactaaaattacagagctgctttcaggtcagaaaatgaagtacaaagtgtgtggtttttttttttttttttttctttttgagacagagtcttgctctgttgcccaggctggagtgcaatggcgcaatctcggctcactgcaacctccgcctcctgggttcaagcaattctcgtggctcagcctcccaagtagctgagattacaggcatgcaccaccatgcctggctaatttttgtctttatggtagagatcaggttttgccatgttggccaggctggtctcaaactcctgaccttaggtgatccacccgcctcagcctcccaaagtgctgggattataagcgtgagccatggcacccggcctcaacgtgtggttcttacggtgacaaggtagtttccaaatggcctcttttacccctttctgtgtgacatttgctaccctggccaaacaccacattcccatgtgacgggagaaaggaattccaatgccatgaattcagaagcgatggatggagtgcagtgtgctcttgtgtttttacgtggctacgaggcgctgctgctgggtttcctagttcttttgacctagattttctgcttcctcccttgccccctcagcacacacatacccacatgtccttagtgacaccagcagtcacatttgatgttagaaactataaagttttctgttctcagcaatctcaaactcaaatatgggacacacttttattccttcagaataaatgactaaattcaaaacatacacacataatgctttaaagaacgtataaacccttccatgtcctattcagagctggaggcctccctcataagaataccacatttgatggaattgtattttttgaaaagagtctacactttctgaaggactttcaggtaccagggctcatttgatcctcacatcagctctgtgaggtgctaggtggctattattatctccatttttcaaatggctgattgacttggccaagatcacatatctagtgatggagccaagctagaaaccaggtcttctcgttcccaactcacaacactgtccccttccttccaccttggagtgatgttagaaataggtcatcatctccactcaagcacttagttctttccattatcttcccatcttcttttctgggagaaagaagcccaagggccctgtgacttcaactccacccactttctgatgactctgaaaccccaagccccaaccttagcctctctcctgggtccagactgacatatccagctgctccctgagcttttcttcttagttgaagaattcaactcacagtcacccgcatgcaatctgaagcccatgagccctttctcagccctgcctcctctcatgtatcttctatttctgtaaagccgtcaccacctactcagtctcccaagccagaaatccagtggcatcccagagtcctcctctcccttagcttccaagattggtcaagaaatcctgcctgtttgcttcctgaatttctctaaaatatatcctcacctcctcttagcctaggccctatcatctcttgactggaggcctgcgctcatcttcctgcagtttttctgccgactttagccttgcaatctatcttcacattctgatctctgatacagagctctgtcgctctctcgctctctcttaattagagacagagtctctctctgttgtccaggctgtagtacagtggtacaatcagagctcactacagcctttaactcctgggctcacaccctcctcccgcttcagcctcctgagtagctgggactacaggtgcgcttccaccacgccttgctaagttttatttttattttcatagagacaaggtctcgctttgttgcccaggctggtctcaaactcctgggctcaagcgatcgtccacttgggcctcccaaagtgctgggattacaggcatgagccatcgcacccagccagagctctttctgaactctaattcttactgttacttccctgctcaaaatcctttaagggctccccctacatttcaagatattcacagtctacattccagccacctggaggcatttcattcccagaacacaccacacctcctcagagctgaaggaggaagtccattgccatctgacttggcctcagtaactcctttcgttgccaaggcaagtggtctctcctctacatatggatgccttttctatctatttctgctttcttctttatcatcacacttctatcagttaagatattttcaggagcaagaaacataaactaaaaatggcttaaacaataacaaagacttgtaatttctcaaagtccagaagtaggaaggctcctgggtatcatctaattcagcggttcagtgacattatcagagttctttccatcttttgctctgctatccttatttagaattattgttctagtctatatcaaagacttaaaaaaaattttttttttgagagaggcttgctctgttgcccaggctggagtccagtggcaagatcacggttcactgcaaccttgcctcctgggttcaagcaattctcctgcctcagcctcccgagtagctgggattacaggcatgtgccaccaggcccggctcctttttgtatttttagtagagatggcatttcaccatgatggacaggctggtctcgaactcctggcctcaagtgatctatgtgccttggcctctcaaagtgctgggattacaggcgcgagccaccacacctggcctcagactttcaaaacattctcagtggcggtgtcaaatattttgtcttttaatggtgaatctcattttttgagaaaccagaagccacatacagtcaagtctggtgagtaatatgagtaactgaggtagacaataacatttggggtcacagtcaaagtcaggccacagagtaacaagacagaacttttggttttgtttgggatctggctttaaaagcaagtttagaaaaggcatcccaagtatcttgggttccagccaaatatctgtgaaatacacagcatgtgaacacaaagagttactgtttccaaagctggccccactgggatgtttaagttttaatctgcctgtttaaaaaacaataacaaattgaatttttgaaaagtttcctgggcctggtggctcacgcctgtaatcccagcactttgggaggccaaggcaggtggatcactaggtcaaaggatcaagacagtcccggccaatatggtaaaaccccgtctctcctaaaaatatgaaaaattagccaggtgtagtggcgcatgcctgtaatcccagctactcaggaggctgaggcagggggatcgcttgaacccaggaggtggaggttgcagtgagctgagatcccgccactgcactccagcctggcgacagagcaagactctgtctcaaaaaaacgaaaaacaacaacaaaaaaaagagaaaagtttcctggttacctggaagagaaaaaaaaaaatacaccgtggagtaaccattcttccttctcaccatctgctgagatgaggaacttaaggtgctaactgggacaaatgaatttccaaaatagaaaaagggattcagggaagtccttgagtgctgaatttgggaggccaagccacagtggggtgacatgagtggacggcacaagtggacagaaataacctggggtcaggagaagctgactccaaaggtaaacccacggctcctccacaggcctggggtaaatcctagaacagctgttgagttctttcaacttattaacatattttcctctaagtccaaaagggccttctttgcctggcagcccctttctcttgtttttttggtgtcctccctccaatgtctttgtctttccttttcttccatgtagattttaagtaaccaagaggagtggtttaaggcggagcttgggagccaggaaggatatgtgcccaagaatttcatagacatccagtttcccaagtaagtatctgcagcctgctgagatgggcctagccacacacactcctcttacatttccagcagtcactacagttatccatgggaacccaagacattgtcaaaaatggctgcctctggagctctctccggagagcctccagagcatgcagctgaaggccagggcaggagggagactttgcatttcatttcattcccttttgatgtttacaccatgtgcatgtattgctattttaagttgttcttaactttttttttttttttttgggagttggggtctccctctgtcacccaggctggagtgcggtgactccatcaccactcactgcagcctaaaactcctgggctcaagccatcctctcacctcagcctcccaagtagctgggattacaggcacatgccaccacgccaggctagtttttgtatttttagtagagacagggttttaccatgttggccaggctggtcccaaactcctgacctcaagtgatctgccgcctcagcctcccaaagtgctgggattacaggcgtgaaccaccatgcctggcctattttaagttttgggtttttttgggtttttttattcatgtgtttatttgttttgagacagaaccttgctctgttgcccaggctggagtgcagtggcatgatctcggctcattgcaattctcctgcctcagcctccctagtagctgggattacaggtgcatgccaccacacccagctaacttttgtatttttagtagagatggggtttcaccatgatggacaggctggtctcaaactcttgacctcaggtgatccacccgcctcggcctcccaaagtgctgggattacaggtgtgagccactgcacccggcctattttaagtttttataaaatgagtttgtaaactcaaattatctatagtgatttcaatcacggcgttccccagaattccaaaggggacgctattggccaccccacttcgggagctgctctcctaagcgcttctctgtgacctcctaatcctaaccatcctcaccaggctctcacccttcactcagtgggtggacagacactccctgccttcagtaaagcatgctcaccccaatgagagaagtcagcggggggaaggggaaattctcttcctaaagaggaaatgaaaaattgagattgggcttcgtttgtctcaagaattgaccacaagggttagatagaaatctaatcttgcctcagaaccagggtctagctcaaagagcaaaagcttgttagaaaaccacagtagtattggtgactccagcaaggtgcaagagcaccagtcttggtaaacctgaactgaccaccaaaccaagagaatgaccactgaccttgacggaacccttgatgctgcccaggaatctgctaggtgacctctgcataccccacgtgctcctcaaaccttcagcccctccgtgcatcactcttagcccgtgaccttgattccaggttctctggaacaatgaaagccaccagaagtgaagctcccagacccccctcccccaccgcatccacctgcctcctgcaagtgtgctcaaacagtcggcctttcctgcagctggctggaaggaactgtcactgcttctagcagaaattctcctctctctctcttccacgtcaacctcctttccctctctgctggatcattcctgtcagcaaacacacacgctgcaatttctcccaacttaccaaaacacaaacaaacaaaaccaaacccagaggccaggtgggttttgttgtggctgatgcctgtaatcccagtcctttgagaggctgagggaggaggatcacttgtggctaggagtttgagaccagcctgggcaacatagcgagccccatctctacaaaaaatttttaaaaattagctggtcgtggtggcatgcgcctatagtcccagctgcttgggaggctgaggcaggaggatcgcttgagcctgggagttcaaggctgtggtggaccatgattatatcactgcactccagcctgggcagcagagagagactctgtttcaaagaaaaaaaaaatttaaataaataaataaatcaagaaaattcttaatcccaaatccccttccacttgccactccatctcttcaaaaggagtgtgtgcatttgctacttccaactcctcatctcccgacccttcccaccaggctccccatgggctgtagctcccaggggtcatctcagcatgacctgccctggggatcccccctcccactggaacacctctttcattttggctccaggacgtccttcctccggttgtcctcccactgccctggcttctcctcctcagtctcttgtgttggttcctcccactccccagtcccctataggtttagaatgtctccttttcagtgaggtctttctcatcaccataccttacattaatctcccacccacagcgccccatctctcctctcagttttcatgttctccacagcacttaccatcatctggcacgcttcagatcttaattattttgttcttttgtgtgtgtccccctcgactagaatgtaagctccctgagggcaggggtgtgtgtctgttctgcccactactgtgtccccagtgcccaggaggggcccagcacagtactagatgttcagtaaagctgttgaatgaatgaatgaatgaatgaacgaacgaatatgtattattgaaaccatgaccactcatgtctaatatgcaatgtgtggtgatttttacaaatctttaaagaagccccctatcagattgcagtcagaggacaaatgtgtatttcctaaatccccttcacttctgaaatgtttcctttgcgatatggctgctgtggtgcatactccattcctcttcccatccccattacatttcccacacgtggcagtggtgtgtgtggtggcctcttgtttagccctgtagaattgtgtggcaaatactcaggcagaatctccaggccaccagaaactgctgctttcagccctctcagagcacagccaaacttccccctcagtcccagtgggggactcagtctccagtaagtacatccttcctgctacctatgtctcagtttcccaaattctagaaagcacagagaattgctcacaaaggaatccaaagccaaggcctgacgggcttttatcttaaaggaacatgcgtatgagccttctggtgacagcaattagagcagccaccttgaagcaatgtgacacagtcccacctttggccgctgagtgattgcagacactcattttgcttgtctgtggtggagagaggtctctggcctcctgctttgaggctgcagccacagcttgcctggccctgtgtaagtgtttgacctatttcatacatgccacgctgtatgcagctgtacctccaggggctgccaccctgaccattctgctaaaagagtaatttctcctgtttcttcttttccacagtaaagattatttcccagcctggatttttggggcaggcccaggatctggttgtatagacgccgctctctggcggctgccagcctcgctgatttccaagcatgtacactggactccctaggaacactgcagcctctgctaggcacactgagcaaagcccccttgtgctccatgccagcctaggtaacgtgacgccctgggctgtaactttcctttaatacccagggaggaacctctaggccactgagacctcagggcaggcatgagcaccccaggccctgctcagccggctgcacctggttggctccagtgcctgaagccttcccttccctccccagtgcatcctctgtcctcgcagctctggtctatctcttccgcagctgccggcaggcggctgcttcctgcagtgagtcactcccacactgccccattttggtgcagcgacacatttccatgattcgtttcccaggctggagagagacttctcctggagagaaggaacaaagagggtgaatcaaggggaatgctccctcgcctttcctgaaagctgcctggagcactggtttgatttcaaacagcacctggtctctctctgctccctactgtacagagtccccagcctctttccctctgggtcacctcttctccacgtctccctcttgtcactcctgtgtctcatcctgatccttttgtttgatctcgcccccacagatggtttcacgaaggcctctctcgacaccaggcagagaacttactcatgggcaaggaggttggcttcttcatcatccgggccagccagagctccccaggggacttctccatctctgtcaggtactgaccattcctgacactgccttggcccttctcggcctgttaacctcacagaatgctgaagccatgaagggacctctggaatatgacccaatggtcagaagcatggtggcctaggggccaagcatggcagcagcttcacaacctgctgctcccagtgccttcccaaaacatgcacacaccactctttagaacactggtgtgtgtttgaaattatttctacgcccatctgcctccccttctagcccaggtgcttctggaagggcaggattttcctctacttcatctttatgcctttaacagtgtcttgcataaaagagagacactcagtgagtatttgtggaaggaaggagggataggaggaggagaactcccacttgtccagatccatctgggggtttaaatcttaaccttttcttttatgattgatgcatatctgaagaagagtcagagaaaaatagaaatctcaagtcactgctgtaggatatacaggggcggaaaagttgtggcacctttctttgcccatcagaggagtcacagctgacactcctacaagacaggttaacaagaggagagtggacacatttatttaatcaaagacttgtgtgacacagaagccttcagaaatgaagacccaagacccagggaaagccgtctatttttatgcttaggtttgtcaaaggacagacagccctgtagaaatgggattggacaaagggggtttgatctaaggtaacagactgaggtaggaaactgaacaaggcctgtcccaagtcttcttttttttttttttttttggagacagctgttgcccaggctggagtgcagtgacgcaatcattgctcaccacagcctctgtgtcccaggctcaagccatcttcccacctcagcctctcaagtagctggggatacaggtgcacaccaccacacctggctaatatttttttaacttatttctttgtagagactaggtcttactgtgttgcctgggctgatctcaaactcctggcctcgagtaatcctcctgccttggcctcccccatagtgacccttctagtctctctgacccactgtggggaagaggaattctaatttctatgactcactcagggggagaaagaggagcgggagacaggagggcaggagaaggccaaaggaagactttgcttccaaggctgcttctgaaaccttcccatctcctttggttcgaagcactcagcatgccaaggggtgtcgttttctgagccccaacaaatacatgtatagttgtaggcagctgaacaaaaagaaaggctacttcaacacagtacagtacagcaagaccgaaaaccacagaacagagggccaggagtgggggaggactgtaacagcgaaatctcactaaggtgcagcaacccataggaagtgactcagtccacgcgtagacattacacagccccaaactcagaagcccagttcggaacacactgtgtgtggtcagcatgttgaggatcgcaagtcacgtatcagacttcaccacatgtgaaactgcaagaatataatgctgttagcagatcaggagaagtacagcaaaaccttactgtcaagttattggcaggaaataccgatctggtttattcaatatattttgaaaggcataaagctttgttttaaggacagaaatccaatctcaagtaataaactgtggccactttgctgtttagaaagaatggatatttgaaaggataggtaggaaggacttaaaaataacaggtcaacaatttgtatgcatacatacctttaaagtggtctctttagcattgcccttgcaatcttgcttaaactcttttcttcagtaaaaactttattttcatagcttggagaatggttaactttagttcaggccaatattgatgtatcacaaattctaatcttgttaggtcttaattaatgaaatttcgctccattaacatatattacaagtcagggtcgggcgccgtggctcatgcctctaatcccagcactttgggaggctgagttgggaggaatgctttaagccaaggagttggagaccagccggggcaactagtgagacctcatctctactaaaaataaaaaattaacccagtgcagtggcgcatgcctgtggtcccaactacttgggaggctgaagttaaaggattgttggagctgggcggttgaggttgcagtgagccaagatcgatcgcaccactgcactctagcctgggtgacagagcaagaccctgtctcaagagaaaaaaattatttacatatattatatacatatattattagaaaaaacaattatacatatatttaacatgcgtgtatatatattacaagtcaaatctatttcttaagcctcccctctttaccccatcataaacttgaccaagtaatttgttagactgaggggtatctcttgggcctttggtttgcatgaagatgactctggctttttcagctagaaactatggtttttgtggtttcgttggttttttgagacagactctcgctctgtcgcccaggctggagtgcagtggcgcaatctcggctccctgcaacctccgcctcccaggttcaaagcaattctcgtgccttggcctcctgagtagctgggaccatgggttcgcaccaccacgcctggctaatttgtgtgtgtgtggtttttttcagtagagacggggtttcgtcatgttggccaggctggtcttgaactcctggcctcatgtaatccacccgcctcagcctcccaaagtgctaggattacaggcgcgacccactgtgcccggacccagaactatggtttatatttccttaattaaagtgagttctacaaaacagtaggccttgacttctaccgaagtcttcccctgatattcaggcgatgaagcttctagttatggtgacaattaccgtaatccttatcacgtctttgcagaaatgtagtataatattttccaaagcaaaatcattattaattatttttacatctgtcatgggcacagataattaagagctaattgtagttctatcactcagcatttgttaagggcctgaaacaccagattttggagtccagcgccctgagtcgcatcctttcctttgttcctcttcaggcttgagacaatggtcaggccatcctctccttgtagacccagataaccagctgcaaccctcacacccatccttacagcttatgagagtaaaagggtcaatgtttcacactctgagttctttgaggtggtggatgaaaaattataatatcacaagaatattttctcctcctcacctggatgtgaaggataatgactttgagttgatccatgttgtcttagaatgaagaaagtatctgttggtggccaaaaccaaggggaagaccacaaagtgattgcaatatgttgattaccacccgaaatcagtcaagcaagaggccacttgtacaacctgtggcttcacccagctatgagcaaatcccagcacataagatgagattgagggtcagaatttccatctccttcttaacacaggtccctaaatccatccctaagaaacctccatggtcaggcgcagtggctcacgcctgtaatcccagcactttgggaggctgaggtgggcggatcatgaggtcaggagatcgagaccatcctgtctaacacgatgaaaccccgtctctactaaaaatacaaaacttagccgggcgtggtggcgggcgcctgtagtcccagctacttgggaggctgaggcaggagaatggcatgaacctgggaggtggtgcttgcagtgagcagagatcacgccactgcactccagcctgggcgacagagcgagactctgactcaaaaagaaacctccacttactctcagaggtatctttactctccgagaccctttaaaattcttgacctttcttttacatcaggcaattggcatcactagtgccagtttatttttagatataaatgtatgtctgtttgaaaaataaactttacatccaaaagagaatgacttggcaatgaagtaaaactggatctaatggtaaaggctcagcccacccttcctagatggataaaatccattttctctagccctggttcgaatgtgtcccatcacttgtgagtccagactggcaacaaaaggtgctgatctaaaagaagttatcgtccagtggcagggtctggggaaggggcggcaggcgccatgtccagccacgaaggtggcaagaagaaggcactgaaacagcccaagaagcaggccaaggagatggacgaggaagagaaggctttcaagcagaaacaaaaagaggagcagaagaaactcgaggtgctaaaagcgaaggtcgtggggaaggggcctctggccacaggtggaattaagaaatctggcaaaaaataagctgttccttgtgcctaaggagacggtgaccctttatttcatccgtatttaaacctctctattccctcctataatatcttttgccacctatagttggaattaagtgtcgtcttggagctgttgtacatttaagaataaacttttgtaaaaaaaaaaaaaaaaaaatcttccagtggctcatcatctctttagttgttttcactaagtcattcctaccataactgtgaatttaaagtaaaaccagctcagaatcttgccagaatctgctctttggtcgttgttctaccctaaactttgtatcacctgaaattaaaccaactcatttgaaagaaaaaagaagttatcatgtttaggtggcgtgacaggccaagctcactagactggagtcagagactcagggttctggcctcagcccttactcagcagtgaccttgaccaagcccctgcacctctgtgagcctcagtgtcctcatctgtaaaatggagaagtaaggctaaacaatctccaacatccttgccaattaaaactctatcatttcacagggcgcagtgcctcacacctgtaatcccagcactttgggaggccaaggcaggtggatcaccggaggtctggacttcaagaccagcctgaccaacatggcgaaaccccgtctttactaaagacttggtggtgggtgcctgtaatcccagctcctcaggaggctgagacaggagaatcgcttgaacctgggaggcggaggttgcagtgagcagagatcacaccactgcactccagcctgggcgacagagtgagactccatctcaaaaaaacaaaacaaacaaacaaacaaaaactctgtatttcatacaaagctatttcaccaaaagctgaaaacactttgtaaccttatttatgcaaaacataaaccaagatcaagagatccttattacatagagaaaaaatgtgacatatttcttaggaaagagagtagcttcttacctgccagtgctagcttatgggcttaaaggagatggttcaaagaatttctggtaacagaaagataataggagcttgaaatacccctgttgacatcttgcgaataaacattgtgaaaaggtctttgatctctttgtcgttaagtcacttggaacatgcttttcttgtaaaaggttagttccagtgtccaaaacaaattttagctcatctgattaccttctgctgatgtaaatcccgtctagcatagcctgtatcctaagtggtccatcctacaaagttcctgccgaagcctgactgggctggcccacctgcccagtgatgagtgagtcatccatatctacatctcctgctcaaagagaactccaccatcccagatgtgagcagcctggaggtggtgacattatcaccgtgtaacatacaattttgttttgccttgatctccaggcatgaggatgacgttcaacacttcaaggtcatgcgagacaacaagggtaattactttctgtggactgagaagtttccatccctaaataagctggtagactactacaggacaaattccatctccagacagaagcagatcttccttagagacagaacccgagaagaccaggtatgctccagatccagtcgaccccaatctagagattttaggcagcctgagttctcacatgaaccaccaggaaaaatgcataggatgggtagatcctctgagtatactgaaagacagagctcagagctctgaggtcagatctcaacttaacacttcctagtcgtgtgactttggaaagttctctgcgcctcagtttcctcatccataaagtagggacaatggtaatatctacctcccagaatggctgtgaaggttggagaagataatgtatcccacgcctcatgtcattcctcatcacactgcgctcagcaagcatcagctcttaccacaggtgctgtttttttgttattcatagacattgctacaccaaagttttcaacctagctcaagagttgcccaaggatgaaggagttgggggtgctacagacagggacattagggaacagcctagagttcaggagttaaatcagcatgtggagttttatgatgggattgggggtagggaggacatgggaggagaaaactgcacttggaattattgctgttgcaactgtttgcaatacagactattgctttaaaaggaaatgcgtcagacagacctggtatgaaatcctgctttaatcgcttagctacctgtattacctagccaagttaagaaaccatctgagtatcagttttctcatctgtagaatggagagagcaataaaacctccctcactgggctgttgtgaggattaaatgacttaatacagctaagcactaccagagtctggtccatattaaacactaagaacatgttaacttgcctcccataagtaaattcacacatgcacacactcacacacacacacacacaccaatttatgaactatttttcaaaggaaataacatggttataagagacaggtatcataggaagaagcattcactagaatagctgaaatcctagggacaggttatttgaaaagatattgagactgtgaaagcaatgtgtgctttggggaagtcaagaaaatcctcctttttcgagtccctagttgcttttaagcctgagaagttactgccaaaggagaaaagaagttaccaccaaatgcacacagaagttcagaaaggaaaacaaaggctagccaagaccttgtgaatcactctaaccaggaaacggacagaggtattaactcactaggatgggcattcagagaagcaatataaaattgcattaaatgggattaaatgagttgatatttgtaaagcgcttagaacagtgcctggtatatgctgccctcagggtcctacataattgtttgttaaatgaaactaacaatacggtatttctgatttgtaaggttgttgtaacattagggaaaaaggccttacttcttcccccacgtccagcccggcggcaggcctggttcccatggtgttgcaagaatgttgctgtttgggtctctatcaccaggctgtaaatgacagttcaaaatcatgcaaagtcaacagtggagcttatctggagggtagattgtccagtggtgtggcaacatgtgataagaaggggtggcattgtatcagtaaaatggaatatttcagcttgattacacagagaaaaaacgagcgccctggaaatggactaaatggctaccaggcaaaaagtgttagtctgtgaaccagagacctgcactcctaaaactgggaggatctgagaatgcagaggccactttggaaaatgtgaaggtctaaagcatcaattatcttttagctgcccccaccccaccagctatttcttggagccagatgagcagggtctgggaacaactgcccgagggtagggtagggccagacgatcagagaggaggatgcatctgcagcatctctgttctttctcccagggtcaccggggcaacagcctggaccggaggtcccagggaggcccacacctcagtggggctgtgggagaagaaatccgaccttcgatgaaccggaagctgtcggatcaccccccgacccttcccctgcagcagcaccagcaccagccacagcctccgcaatatgccccagcgccccagcagctgcagcagcccccacagcagcgatatctgcagcaccaccatttccaccaggtatctggaaagaaggcagtgggcacagtacggtggaaaggagaacctgcctcccctccaggcctggcccagcctcttgagttctcagagagttcatgatgaagaccctggacccccccaaatggcagaaatagggaaactgttcttggcaaagacatctctatgaattaaatggctcccacctgaacacacacacacacacacacactgtctcacacacacacacacacttaaactcacacacacacacacttcccctgaggacccagtaaacaattgcttcattttcctatcagcacaattccaaatctattcatgccccttagcccatctggctgtcagatccacaagagaaaaaggcttaatacccacaacagagccttgtttattacttatttatctccctccacccttgttcccgatgggatttcaggcggcttactgagatggacaatacggccagataacatcattcctgaattccttagcagggcacacaaagtcctttgtgagctgccagaatctatttccccagcctcgtccctgctgcctccctgccaactccccgtgcaaacacacattccagcaaccccccacgctgccttagttacccgaatggtccattgcgtttcctctcatgcctttgtggcgttttatatgctgatctctctgcctgatgagcccctccctgggcagtcctacccctctaagctggagttcaagcatgacctcctctgtgaagccttccttgatttcccgggcagatacagacatttcttctctctgctcacttaccacttaaatgtgcatggttccccctctaaatggaagctccatgaagccagagaccttctctttccagctatatttcccttgtgtctgctactggaaacatggtaggtgcctgataaatatttcttgactgaataaataaaacctgcctttgccttctttgccttcagaatctaaggtgcctttagaccttaggtcctcctcaacgtggagggtttattgtcattatcagtaagtattcctggaatataccggctctgtggatggcatctgagcaaggcactgggggaaccggtgggagatgtcctggcagtggggtgaccagtcttctgttgtatgtttctaggaacgccgaggaggcagccttgacataaatgatgggcattgtggcaccggcttgggcagtgaaatgaatgcggccctcatgcatcggagacacacagacccagtgcagctccaggcggcaggggtatgggaactgtccttctctgggatccctggggaaaggccttgggacagaggtcaatggaggagatgaggcaggagagactcaaaccacacagatctggctgggcacggtggctcacacctgtaatcccaacactttgggaggccaaggcaggtggatcacctgaggtcaggagttcgagaccagcctggccaacatggtgaaacctcacgtctactaaaaatacaaaaattagccaggcatggtggcagatgccagtaatcccagctacttgggaggctgaggcaggagaattgcttgaacccaggaggcagaggttgcagtgagccgagattgcgccattttactccatcctgggcaacaagagcgaaactccgtctcaaaaaacaaaacaaaacaaaacaaaaatgcacacacagatcaacgagaggtgatggaatgtttggggaggcctggggctgagccagcaccgtccagtctgttgatctcagtctggtgccaggccttccctgttctcatagttctcagttctagttctttatcatctttatcatagtcctttaccattgcctttatcattgcatcttttttttgttttttgagacagggtctcactctgtctcccaggctcaagtgcagtggcacaatcatggctcactgcagattcaaactcctaggctcaagcgatcctcctgcctctgcttcccaagtagctaggtatattatttgtagcgataagctcttgctatattgcccaggctggtctggaactcctgggctcaagcaatcctcctacctcagcctcccacagtgctgggattacaggcatgagccaccgtgcctggcctgtgatccatcttgacttgtgacttgattgccctaacaccaagggctgttgtttggggcatgttgcccttctgtttgtcactcaagataaaaataccacctattgatgtggagagagtggttctcagggagtctattggggctttggacaataacatctgttggtaaaagtcctgggtctccagagtgacgctggtgcgttctgggaacttcttgctcaggcctgtgcataggtatctgatttaaattgcagcagggtagccgggcatggtggctcacacctgtagttccagctacttgggaggccaaggcaggaggacttcttgaggccaagggttcaaaaccagcctgagcaacatagcaagaccccatctctacaaaaaaagtttttttaagctgcagaggggtcagccttcagggaatgttgctctcaaagacttggatgtggtgggaggagccagcagaccctcccctgcctgcccagcccacagctcagcagagcctcttctgtgcttcccccaacagcgagtgcggtgggcccgggcgctgtatgactttgaggccctggaggatgacgagctggggttccacagcggggaggtggtggaggtcctggatagctccaacccatcctggtggaccggccgcctgcacaacaagctgggcctcttccctgccaactacgtggcacccatgacccgataaactcttcaggggacagaagctttttgtctggagctgcccacaagaaagagggcaaggaaaaaaggctggactccatgactatatatacatacatctatctacatctgcctgtgtacacacacaactttttatactagtaatttattggcaattgggctggtaattagttgatgcaaaagggaactcaggtggagaataatattgacacttgcttttctgcccccctcaggggtgtgtggaaggcagtgggggagttgggaggggggcagggaaatgaaatggagttttgtcctggc

SEQ ID NO: 1738 - DNA, 3313 bp, Homo sapiens
acgtccggcttaccgtcgtttacgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggaggtgagagtaggtccggctcggacaagggtgggggtcgtctgaggggagcttgacccctacgtcttatttttggaaaaacatcctctgtcccactccttcaactcctgcagagaggacagaagtcgcaacattgaacactcaccccgccacagtaaccaaggcggtcattaagaggagaaacagcaaactaagcctttctccaacctggggtgatgcaacagggacccgggcggggaagaccgtgagggtctggggaataagacagtgagcaagtgagcaggaccttgggagagagaggagggactggggcacactgaagaaaaactgggggaaggtgtatgaagggagctgcgagctgaggtctgactttgattaaaaaaaaaaaaaaaaaaaaagaactgtcagccattgtattaatgttttgatgtggcagccagtcctccgaccctctccctagcttcccagaccccttgctcttgtcccactttgccacccatgagttgatttaatggcttaaatagtgctgaaatattggtggccaatctgcctccactctcagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctggtgtgtggctttccctaaggggcaacctgtggtttctggtgggttggtgggtgaaataaagagcctgcagggagtagctgggggatgggaagtgtgagaagactgatgatttcagagagattaatagagcccaagtcctttcccatcccagcaaacacctgccacctttctgcagaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaaccagcaccagactggggctcccagaggccatttcatagggtgagtatcccatctggtcctgaagtgagagcttgtgagagaccactaataaagtgcaaagactggctaggtgcggtggctcacgcctgtaatcccagcactttgggaggccgaggtgggcagatcaccagaggtcaggagttggagaccagcctggtcaacatggtgaaaccccgtgtctactaaaaatacaaaaaattagccgggcatggtggcaggtgcctgtaatgccagctactcaggaggctgaggcaggagaattggttgaacccaggaggtggagactccatctcaaaaattgtttgagacccagccttgctctgttgcccaggctgtagtgccgtggcacaatctcagctcactgcaacctccaattcccaggttcaagtgattctcctgcctcagcctcctgagtagctgggattacagtcgcctgccaaacgcccagctaatttttgtgtttttagtagagatggcgtttcaccgtgttggccaggctgcttttgagctcctgacctcaggtgatccacccacctcggcctcccaaagtgctggaattacaagtgtgagccatcatgcctggccaaagattgcaattcttgtttgaatctgatagccttgggttggaatcctaagccctccatttagtgttttctgttttctatattaagcttgtgggattttctttggggggagatgggtgttctgtttcttttaaaaaacaaaaacaaaaaaacaccactggtctagataattcttggataaggcaggattgtgcacagaggataggaatatatcagttcaggaagtctttctggtagaaggatacataaaacagccaggaaggagtgtgtaaataaggctattctgaatggaattatctcttctgtggaagggggttttggagctcgggagtagtttgaggtctatgacctttcaaatttcagattggaaggagtcttttcacttactatggtttcttctgcagtttgatgatgtatggcctatggacccccatcctagaaccagagaggacaatggtaagtctggaggaaggggaagtttaccagccttttgttattcttctgaagttctgtgtgttctccctccctgaagtttcttcctgtacacttgtctccttttttcctttggactctttctctcctgcttcttcatctctctgctcttccagatcttgattcccaggtttcccaggagggtcttggcccggttctacagccccagcccaaatcctatttcaagagcatctctgtgaccaagatcactaaaccagatggggtgagttgaaagaaagaggtaaaggaaagtatggccagggaacgaatgccctgaaacagggatctgtgtaaagaaactgctgagcataacctttagtaacattcggaatatggtggggacttctctttgtagatagtggaggagcgccggactgtggtggacagtgagggccggacagagactacagtaacccgacacgaagcagatagcagtcctaggggtggtaagttaaaagacaaaggggttcatctcaagattccttggggaagggaaatcttactcttctacccttgtcctttgcttctgcctagtctctttcatttagcctatttacgtgtatgactttcttccttagatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgctaa

SEQ ID NO: 1739 - DNA, 3313 bp, Homo sapiens; identical to SEQ ID NO: 1738

SEQ ID NO: 1740 - DNA, 56283 bp, Homo sapiens
ggggatttggctagaaggctgggccggcagcggttgtgaggagttagctcgcggcattgcaggctctgagaggaggggacccggttcccgggtgagtgtccaggcatgccagcggaacggcccgcgggcagcggcggtgagtgaggaaaaccttttgggcgcgggtggcagcctgcggggctgaggtgggcaagcatggaggctgcggcggagtttcggggagggagccgaccccgggcagggactgaggaggaaaggagggttgggaaactgcaacggtgagtggaggacaccccggaatcgcacgtattagcatgccggtgaagatttcacataggcaactgcattttcccgagcatcccgagttgtaaactgtggtccaggcgacttgtagacattgtgaagacttacggtgtcttctgagaggtgatgctggcgtcccctcggtcttcagcttttgctccagtgcatctcgggtgggagaaaggctgtttcttgttggagttgagtagttggtaatttttttaaaactgcaatttgaaagctttctcccccgtcaggctcggaggctccagcaatggttgaacaactggacactgctgtgattaccccggccatgctagaagaggaagaacagcttgaagctgctggactagagagagagcggaagatgctggaaaaggtaatttaggcatcaggttcgtcgtcgtgaaagcctgtggtaacctcggctttaacccggaggtgtggtttgtgttctttgctttcctatttagtgggctttttaataactgaaagaaaacagctttattacttgtcttttttgtatgtttacagatattgcctttgagaatcctttcgcaagtgctttgaatggtgtgtttctatgagatgtagtcttggtagtcccatcacttttaaatgagcatttcagattgcttgtttagccatgaaaagtctttcaaagtccatagtgagttttttcgtttgtcatccttatttcctttaaaaattaccttaaatgtatgtctcatggcaaacaggaatcgctaaaacctgcagaagtaatgtactagactgagggcaggagaagttagcatcaatcaaaggctgggctggaatccaagtctaatgatttccttatactgtagtgctgttttccacctaagtgatcaacttgctgtttgtttttcttttggtttcatggcctgtgtattgctacataagattctttagctaaaaatgtgccgtactttttcaatgacaagttgctgtagttttcttgtagagagcattttgtaagttactaaaaacagtttttaacctgaaaaattcttgtttattctaaagccccaccctgctgcttgattcatatgcaagaaaaagaatgatcgttgactcttaagtactgcctagtacgtggttttcttgtgctttattaatttattaaactctaccgatattatgatataggttattttttgttattttcatttacaaatgaagaaactgagggagaagggcacatagtaagtgttgaagtcaaatttcaactcaggctgcctgcagaatttctgtccttaataatagtgaattaactcatgattataaaactacttaagttggaaaataatgcattccaaaaacgagtaatgaggccgttggttccctgttatgtcaacaataatttttttgtcagcattgttaatacttcttgaacatttattaggagtcatgcattgttttgaatgctttatatgtatttactcattgaatcctcaactattctgtaaagtagatgttcattattactattactgctattaaacttactagtttaattactagtataaacaattgctattattgaactacacaaccaaataggttttattagtcatcttattttacagatgaggaaactgaggcacatagaggttgtttgggtgccacagttggtaaatggcagagctaacattccagtgtaggccatgtggttctagaatgcacattttttaactaccatgctatagttccactccagtaatactccttccgttattactgatgatctctggttgactataaccagttaaggtaatatattaacaaattttctttaagtaacatcaatactttttgcttcagggtagatgtgaattaacagaattgagaggtctgacctgaaccaccttttctcattctttgaattttcatagtactttattacacagaatttaccatgaccaaataagtaatgataaatacttcatactactttttgattctttctcactttgtttcttgagggtgcatcacttgctgttttgtttttgtaggctttgcacctggcacatagtaggcaatcagtaagtgcttattgaatagctaacgatgataaaatggtattttataatatacaagattatatacatatactaaatatacttattagctatataaccagatgaattataaagtataaattctggggcaagtgcccagaatggaatcaactgaagaagtctaagagggatgtgataattttgtcttgagtaatgtatcttcagttttatcttgtttcttcatatacccattatgagtgttgggtagggaaatagcatttaaagaaagatatgcctgagatatgacaacagtacattttcagaaggtattattcattcaaggaagaaacacttcacatttaaaaaagataagtcaaatatgtagtattttatatatttgctgaggtcaaatgacctgctacttttaatgacatttttaagcttatgaacaaacattttgcagttagtcctaaatttaataattatgcatcatagaacctaaagagtaatttttaatccttccattaaaaaagtatatggctgttttcatggcctggcatggtggctcacgcttgtaatcccagcactttgggaggccgaggcgggtggatcacctgaggtcaggagttcgagaccagtttggccaacatggtgaaaccccgtctctactaaaaatataaaaattagccagatgtggtggcgcatacctgcagtcccaactactcaggaggctgaggcaggagaattgcttgaacccaggaggcagaggttgcagtgagccgagatggcatcactgcactccagcctgggtgacagagcaagattccgtctcaaaaaaaaaagtatgtagccgttttcaatcttaatataagtgtgtaatttgctaaaacattagtgttgtggtttcgtattacattgtcttgttatgtacagataaggaaagtttttgattattttttgcactggaccctcataaaaagtgattgcctagatgacactagaaaattctaagaaaagttttcagagtctctacctacttgagattaataaacatgtctttggaggccaaacaattaactatgcacaggtagagattccttttcttttgggagaatacagtctgtatgggcatgtatttagaagtacttaacagaggaagagctagcttaagttccttaatgagaagcatttggctttaggaaatcctaaggtttgtgaggaacctagaaaatgactttgacattcattggctacagttattttctttgacttttcacatgtatttccctttaaaagaagtcattgttagtctaggagatttgagtactgatagtgcctgtgaagtggaggagggggaatagttggagtcaggagatttcttggagaggtaaaaggatcatgatatgtgtaggctaaaatagaactcctcccaccccccaataaaaaatctgggattggtgttgggagagataatggggtagataatgaggaatttctgccctcggtgtccattggcatactctgtactgtagttacccagagttgtttcctgccaggcactcagtgcttttaatagatggagttgcaatttaccgtaatataatcatgaaattgataaataaagaaaaaacagtgataggaagatttgaaatacagaagaccaggtttaaggattaaccacttacatggtattattttaatattaattgtatattatttttttccatgatggcatcttaaagctttagtgatttttatttttatttttatttttttgagacagagtttcactcttgttgcccaggctagagtgcaatggcgcagtctcggctcactgcaacctctgcctccggggttcaagcaattctcctgcctcagcctcctgagtagttgggattacaggcatgtgccgccaagcctggctaattttgtatttttagtagagatggggtttctccatgttggtcaggctggtctcgaactcccaacctcaggtgatccgcccgtcttgacctcctaaagtgctgggattacaggcattagccaccatgcccagctgatttttttttttaggaaaaatttttccaggagcaccaggcaagtatttaggttttttttgcttgtttgtttgttttgagacggagtctccctctgtcacccaggctggagtgcagtggcgtgatcttggctcactgcgaccttcacctgccgggtttaagcgattcttctgcctcagcctcccaagtagctaggactacaggcgcgtgccaccacgcccagctaattttttttgtatttttagtaaagacggggtttcaacatattggccggcctggtctcaaactcctgacatcgtgatctgccttcctcgacctcccaaagtgccaggattacaggcgtgagccaccatgcctggctgtatttagttgttttaaaaatatgtgctggccaggcgcggtggctcatgcctgtaatcccagcactttgggaggctgaggcggggcagatcgcttgagcccaggggttaagaccagcctgggtaacagggtgaaaccccatctctacaaaaaattaaaaaactagccggcatggtggcacgcgcctatagtcctagctactcaagagggtgaggcaggaggattatcgcttgagcctgggaggcgcaggttgcattgagccgagatctcaccactgcactccagcctgggtgatagagcgagaccctgtctcagaaaaaagaaaaagtgctaattctgtacaggatttaaggtatcaactatatctaagttaaacccacgttattttaactgaacttaaattttaaaagttaaaaatttaagaatccatatattgtgtaagtaattttcatctccctgttttcatattcacctcagtagttgcgtattgtaaccacagtagtatactggtaatagtaaaagaaattctgtcctaaaagaactgaaaattgagttcaagatattaagaattatctgtgtaggtgggattatgggtgatttatatattttttgacatttagtttttctgtaatgagtatgcattacttttgttaggtccattcttagaatcttactgtagtcactgattttataatagaaatatattttgatgccgggtacggtggctcacacctataatcccagcactttgggaggctgaggcaggtggaccacgaggtcagttcaagagcagcctggccaagatggtgaaagcccgtctctactaaaaatacaaaaattagcggggtgtggtggcaggtgcctctagtcccagctatactggggaggctgaggcaggtaattgcttgaacccgggaggcggaggcagaggtgagccaggattgtgccactgcactccagcctgggcaacagagtgagactccatctcaaaaaagaaaaagaaatatattttgaaagaaagctatagtgatgatgtaatagctaggaaaatgtaaggcaatataaaatgatatcttagagatattgataagctggagcagcaaaactacccaagtgctagggcattatttagagtataaaaatgaattcatacccccatttcttttcttttttttttttgagatggagtctcgctctgttgcccaggctgaagtgcagtggcgcgatctcggctcactgcaagctctgccttccgggttcacgccattctcctgcctcagcctcccaagtagctgggactacaggcgcctgcaaccacacgcggctaattttttgtatttttagtagagacagggtttcaccgtgttagccaggacagtctcaatctcctgacctcgggatccgcccgcctcagcctcccaaagtgctgggattacaggcgtgagccaccgcgcccagcctcatatcccccatttcaaacacgctgtaaacaatgctcaattactttcctcttaagttgaaaccaccaattactggggaaaggggcagttagattttattggttgactttgtgtttttactaatccttgttgaaaagtagaggaattggtttagttgagaaaacaaaatactaaaaaatctgccactagactttttaagtcaagagtttgtataaaatgaaacatatctactatctaatctataaaatttagaatctttttaattctaaagttaacttaagtgtgatttttagtgctgttgctgaggccagtgttgcttaaagcaggaacttctacagtaattgacaaaacttgagtttttctgctctcatttatccatccttcagacccctcagatgtcatctatttcctgaaatctgacttctccagttttagtaattcttacaatttttcaggatttagatagtactgtacagtttactgctatgtatatgtctttaatacttgttgttttcagatattacactaatgtctcatctgtagtataaatcagactttctgtcttctaccagttacataatttatataattgttgcagtacatgtttgttgatttactaggctggattcatgttacagaattggtaatcttggttgggcatggtggcacatgcctgtaatcccagtactttgggaggacaaggcagacgaatctcttgagtttaggagttggagacctgccttagcaatatggtgaaaccctgtctttacaaaaaaaaaaaatacaaaaaattaacagggcatggtggcatctgcctagagtcccagctacttgggaggctgaggtgggagggtggtttgagcccgggatttggaggctgcagtaagccacaattgcaccaattacagcatgagaccatgccttaaaaaacggggtgggggtgttaatcttggctagatgtctgttttgattgttaggatgaattgtgttggtagtatttttctaaaatgttctatccaaatcaacttgtttattaatctcaaatagggagagactctgaaaacttgtcttagaattctctagtgtcacctaggcaatcactttttatgagggtcaagtgcaaaattaatcaaaaattttccttatctgtacataacaaggtaatataataacacggaaccacaacatcaatgttttagcaaattacacatacctttttttttttttccggacggagtctcactctgtcacccaggctggagtgcagtggtgccatctcagctcactgcaacctccgcttcccgggtttaagcaattctcctgcctcagcctcctgagtagctgggactacaggcatgcgccaccacgtcctgctaatttttatagttttagtagagatggggtttcaccattttggccaggatggtctcaaactcctgacctcaggtgatccaccctcctcggcctcccaaagtgctgggattacaggcgtgagccaccgtgcctggccccaatttttttttttttttttttggtacggagttttgctcttgtttggagtgcagtggcatgatctcggctcactgcagcctctgcctcccccgggttcaagcgattctcctgcctcagcctcccaagtagctgggattacaggcatgcaccaccacgcctggctaattttgtatttttagtagagatggggtttctccatgttggtccggctggtctcgaacccccgacctcaggtgatccgcctgctttggcctcccaaagtgctgggattacaggtgtgagtcaccgcacccggccttcaattgttttttaaatggaccttccaactcagtagtgccagaaaccatgtgttcaatatttgaaattataatattttgatatacgaattgcatctatcagattgcctgttaaacccaaaaactattttttttttaacagttatttgttccagtttttggtttgaaagtgtttggtttaaaaaatgttattttagccatttttattaaactttatgccaaaaaaattaaggtatgtcagaaagtgttcataattatggaaattttctctttggataggctcgcatgtcttgggatagagagtcgacagaaattcggtaccgtagacttcaacatttgcttgaaaaaagcaatatatactccaaatttttattgacgaaaatggaacagcaacaattagaggtatgtatatgtaactgactacaagtgaaagcttaaaaaaatttaaaaatagctttattgaagtgtatattatatacagtaaaatggacagattttaagtgtacggtttgctgagttttgactagtaaatatatagatctgtgtaaccaccagcacaatcaagatacagtgcacttccatgaactccaaaaaattgtcttgtgctgacagtaatccccatggctggtgtccagcaactactgatttgctttctgtcactatagaccagtattgttttttcctagaaaattgtataaatgaaatcatggtattgtgctagtgagtaaatagttggtcttcatcaccatttcctggtatacaactcttgaaatccttggaatcttcaaagtaatagtgtttttttttttgtttttttttttttaatgctaatgatcaatggctagctgcccttaggtagcttcaggatgggagcctaagaaagacaaaacctggattagagggttgggatttagcctcaccctcaactttgaggaaaagagactgaaagttaacttgttcaccagtggtcacgattgaatcaatcacgtctatgttatgaggtcttcattaaaaacccaaaagggctgggtgtggctcacatctgtaatcccagcactttggggagcctaggtgggtggattgcttgagcccagaagtttgagaccaggctgggtaatatggcaaaaccctatctctaatagaaaaattagctaggtaaggtggcatgtgcctctagtcccagctacttgggaggctgaggcaggaggttggcttgagccaaggagattgaggctgcagtgaactgtgatggcaccactgcattctagcctgggtgacagagcaagaccctgtctcaaaaataaaacaggctgggcgcagtggctcacgcctgtaatcccagcactttgggaggccaaggcagacagatcacttgagcccaggagttcgacaccagcctgagtaacatagtgaaaacccgtctctaccaaaaatataaaaattagccggtcatggtggtgtgtgcctgtaagcccagctactcagaaggctgaggcaggaggatcgcttgaacccaggaggcggaggttgcagtgagccgagattgcacccctggactccagcctggatgacagagtgagaccctgcctcaaaaataaataaataaaaaaaaccccaaaaggggacagggtttggagaacttctggatagctgaacacatggaggttcctggagaggatggcgcatccagaaaaggcatggaagctctgcgcttctttctccataccttgttctatacatctctttctctggtgttcctctgaatatgttgtaatctttctttctttctttcttttttttggagacagagtcttactctgttgcccaggctggtgtgcagtgcaccatctcagctcactgcaacctctgactcctgggttcaagcagccctcccacctcggcctcccgagtagctgggactacaggagcacaccattatgtctgtcttatttttgtattttttgtagagacagttttgccatgttgccgaggcttgtctggaactcctgggctcaagtgatctgcttaccctggcctcccaaagtgctgggattacaggggtgagccactgcgcctggactgtcatattctttataataaaccaataaactttaatgtttctttgagttctgtaagctcctctagcaaattagtcaaacccaaagaggggcttgtgggaaccctgatttatagctattcagtaagaagcacaggtaaggcgacttgggccttgcgattggcatctggaactggtagttaaaagtcttggggactgaaccctcaacctatggggtatggtgctttcaccccgtagatagtgtcagaattgaattacaatagaggacacccagctggtgtcactgcagaaatgcttgtttggtgtatagggaaaacccccacacattgggtcacagaagtcttttgtgttgattgttgagtgtgtagggagaaactgagtttgtttttttctcaatattcttgcacatatgcactctttgtcttgttacttttgctcagtgtatttttgagattcattcatgtcatgtttttctgtaggttattttttttattcctgagaaggattccattaagaaatgtcgttattggggtgtaattgacatacactaaactgcacatatttaaaatgtacaattccctaagtttgatatatggatatacttgtgaagacataacaatcatgatagtggacatacccactgattccaaaaaattctttctgcttatttataattcttctcgcccgtccctaccccatgttctatccacagatagccaattgatctgttttctgttattataggttcatttgcattttctgttggtgatgggttcttttagctttcatatgtctgaatgtcttcacttaccttcatttttgaaatacgtttttactgggtaaagaattttttttctttagtactttatttcttggagtactttaaagatgtttcactgtctcctagcttatgttgtttctgaaaagtgaaagtcctgataatgtctatatgtctgtaagcaatttgactgcctccctcaatcccattacctttcagacctgtctccagatgtgtttcctgtcttgggcttttgcccttgctattttatgcctggaaccttcttcctctaaataactgcatggcttaacttcatcttcaagccctgacttaaatggtttctagatgagacctgccctcacaattttaagaaagttgctaacacacctgattctctttaccttgttctgttcttcccattgcacttttcatctgatatacatcatttattgtatttattgtttgtctttccactagactgttatgaagatttaaaaacttgtgcaaattgagagaatacagtaagtcccggtgtccccatcacccacatttaaaaattatcaatttaaattttgctgtatttgtcaaatctcctttttcctttgtttgaaacccttttattacttttttatggtaaagtaaaacaaatggaaaaacaaatattcaacttaatgagttacacagcatctacccctttcatcacctcttggaaatggtttgaatttttggtgtctttaaaaaatttgtaagagtatgtctagaatagcttttagtctaggaataagttgatcccttttctgagcactctacttgatgccctttatattaagaggactttctactttggctgagagaatgtgaggtataccttattatgcctgaccccttggaacatgagaggttccacctgcttctttctggtgactcttctcctggccttggttaccatgcacttaccagtactcagcctgagagagagataacagctgcctttgtgcagctttgtcctctctggtacttgaccctgggaatgctactgctcttaagttttggattctgtctcctcaacacaaagagactgttgggctctgtttggatttttctccattatttgtactttaaaattgtatcaggcagtaagctgggcagtcagaagattaaccttgtttccgttttgtcagtgtttacagtccgttactgcatgttgtctgaaaaccattgtttaataaattttatctggattttagttgtttaaggcaggaggctaaatctgtcccattagtccataaaggcttgaagtacaagttcctccctggtttttaattatgatagaccttagtttctcattgtaaacataagttatttgagaattgatatgcgttttttttttaaatgttgcactttccacttgtgacataagaaaaaattgtcttacaggaacagaagaagaaagaaaaattggagagaaaaaaggagtctttaaaagttaaaaaggtaatatagccagccggaatattttttatgtcatttaaatattgaagaaatacttttgtattcttctgacttttttgatcatctgtttaattttaagtttctttagtgataaacctaactttgttacaagcaatgcagaaacatgtaaaatctgttcctcactatttaagaaatggagaaagagccaaagtatggtccactttagtttcttattctatggattattttggacgttggcaaaatttgactttcttaattggaaagaatctgcaaatttaaacttcaaggcattttgtaagtggccaccttctttgaaacctgtaatgaagttttgctagtgaaaagagaaataatttattgaatacatactgtgggtcaggtgtgctatcatgtcttctcttactctattttttttttcttttttgagacggggactcgctctgtcacccaggctggagtgcagtggcgcaatctcggctcactgcaagctctgcctcccgggttcacgccattctcctgtctcagcctcccgagtagctgggactacaggcgcccgccaccatgcctggctaattttttgtattttcagtagagacagagttttactgtgttagccacgatggtctccatctcctgaccttgtgatctgcccacctcggcctcccaaagtgctcagattacaggcatgagccaccacgcccagcctgttttcccttactctcacaacagttctttttaggtagaggtacttttttcccccattttacataaataggctgatgcaaggagataaagaacaatcatattcaaggattctatatttgtgaattcgcctactcacttacatttatttgtaaccccagagtcaagattcctgacaccgtcatggtcatttttggatatgcttatgttcagagcagcaaagaattttagtcctccaatacatatgttccaagctcagctcaaacatgggttgctgttctttgttttctgctaccatatgtatgtcaagcatatatccttttcatggtctttatttagcaccataacttttgcgtttttttgtgctttttcatggtgattttgctgttaaaatggcccccaactattgtaccaaagtgctgtctagtgtttctaagtacaaaaaggctgtgccatatggagaaagtatgtcttgggtaagcttcattgaggcatgaggtacagtgctgttggccctgagttcgatatttatttatttattttattttattttattttatttttttgagacagagtcttgctctgtcgcccaggctggagtgcagtggtgcaatcttagctcactgctacctccacctcctgggttcaagcaattcttctgcctcagcctcccgagtagctgggactacaggtgcgcgccaccatgcctggctaatttttgtatttttagtagagacagggtttcaccatattgggtgggctggtttcgaattcctgacctcatgatccacccgcctcagcctcccaaagtgctaggattacaggcgagagccactgcacccagctggccctgagttcaatattaatcaacatatatattaaataagatatctttaaaaacagaaacacaaataaaacagggttgtgtatcgtttggttgaaaatgtcataaccagagtcagagacccaagcttgtatttttcctaggggcaataagtcaatagtcatagtgattttatcgaaccacaagtactgcagataatgagagctgactctaatttgctgaaaattacggatttgaacccaggattagtttaagagcttctacttagcttctgtgctaaactgccttttatttatttattttttttttgagacggagtctcgttctgtcacccaggctgggatgcagtggcgtgatttcggctcactgcaacctctgtctcctgggttgaagcaattctctgcctcagcctcccaagtagctgggattacaagcacctgccagcacacccggctaatttttgtatttttagaagagacagggtttcaccatcttggccaggctggtcttgaactcctgatcttgtgatccacttgccttggccacccaaagtgctgagattaagtccagttatttgattcttagactagttaatggtgatgttaaaatgcctgataaagtattttgcagactgttttgcaacaaaacccattatttaaaactggtaatactgctaggtgtggtggctcacgcctataatcccaacactttgggaggctgaggcagatggattccttgaggcaaggagttcgagaccagcctggtcaacatgatgagaccctgtctctgctaaaaatacaaaaaattagctgggcgtggtggtgtgtgcctgtagtcccagctgcttgggaggttgaggcacgagtattacttgaaccacggtaggcagaggttgcagtgggccaagattgcatcaccgcactctagtctgggccacagagggagactctgttcctaaataaataaataaataaatacataaaactggtaatactgagtcactgagagagagagtattaaaaaataaaaatgggccaggcacggtggctcacgcctgcaatcccagcactttgggaggccaaggtgggccgatcatctgaggtcaagagctggagaccaacctggccaacatggtgaaacccagtctctactaaaaatacaaaaattagccaggcatgatggcgggtacctgtaatcccagctactcgggaggctgacacaggagaattgcttgaacctaggaggccgaggttgcagtgagctgagatcatgctactggactccagcctgggtgacagagcaagactctgtctcaaaaaaaaaaacaaaaaaacaaaaaaaaaaccctctgatccttgactcacttgctaatttcagagacttacctagggcttttcagatttttattttcatagagacagagcttcactatgttgcccaggctggtctcgaaccccttggcttaagctatcccccacacccacacccataccttggcctctgaaagtgctgggattacaggcatgagctagcacaactggccttacctaggggttttgaagaacatgtttttatttatatgacaattttactggcttagtcatttattccctgctctttaacctgttaatttaatatatccttcactttattccacctaactttttataccagggttttgatttttttcccctctgcttttttcataagggcgtcaactattttgaaacttaaaaaatttttttagaggtgatgtctcagtagcccaggctagagtccagtagcaccatagtagctcactacagctttgaactcctggggtcaagccatcttcccacctcagcctcctgagtagctgagactacaggtgcacaccaccatgctcagctaattttcgcattttttatagaggtggggatcttgctttgttgcccaagctggtcttgtactcctggcttcaagcaatcctactacctagtcctcctaaagtgctgggattataggtgtgagccactgcacctggccagaaactgtttcttaacatctcatttctcttaccttcctcactaataattttccattagtattctcttttatttctgctttgggttatatttaatgtatgaatttcattcacaatgaatattccttcaataccctacctattgaagggtattccttcaataccctaccctacaaaaatacctatttttgtatttttagtagagacagggtttcaccatgttagccaggatggtcgtgatctcctgacctcatgatctgcccgcctctgcctcccaaagtgctgggattacaggcttgagccaccgcgcccggccaagatgtacatggtatttctaaataaaaatgccaactatgggctgggtgcagtggctcaacgcctgtaatcccagcacttggggaggcctaggcgggcggatcacctgaggtcagaaattcaagactagctggccaacgtggtgaaaccccatctctactaaaaatacaaaaattagccgggcgtggtggcaggtgcctgtaatccccactactctggaggctgaagcaggggaatctcttgaacctggcaggcggaggttgcaatgagccgagattgtaccagtgcacactatcctgggcgacaagagtgaaactccgtctccaaaaaacaaacaaacgaaatgccaactatgtttaattttgaaatttctcttctaaatggaaaaaaatggacagaagtagagcccttgggaaaaagcagagattatgaacaagttatagtagggaaatacagaaaaatattacatgtaggtaagtataatagtgaaaaattgtggatgtggctcaattgcaggaaacatattttttctcaagttaatcagtgccttttaacgtataatactatgaaggtccttaataaaatcaatattctgaatccttgttttgtagggtaaaaattcaattgatgcaagtgaagagaagccaggtaaatatccttattctagttttgaagaatatgcgtttatatttctattttaattgctatcaaaaataaaatttttttttatagttatgaggaaaaaaagaggaagagaagatgaatcatacaatatttcagaggtcatgtcaaaagaggtaaaaataaaagggagagggcacctaacatttgatgttgagtaaaatgtaggttttaaaccaccttaaatctgtaaagattgaatattcaatatcacatgaaatatgttttgaatttaatattatatatcatttataggtgaagctgccaaaatgtttgaagctatctaccaacctacagtagacttgagactaatctgaaactaatgtcatctgaccttcatagacttttttttttttttgagatggagctctgtggtccatgctgccttgcagtgtcactatatctgctcactgcaacctccacctcgcgggttcaagcgattctcctgtctcagcctcccaagtagctgggataacaggtgccaaccaccacgcctggccaatttttgtattttcagtagagatggggtttcaccatgttggccaggctggtcttgaactcctgacttaaggtgatccgcccgcctcggtctcctaaaatgccacattacaggcgtgagccattgcgcccatcctcacttaagtggcaaataggcttacacctttaggttgttctggttttcttttctttctttcgtttccttcctttctagcttccttcttttttttcttcttttctttttttgaggcagggtatcactctgtgactcaagctggagtgcagtggcacaatcatggctcactgcagcctcgacctcatgggctcaagtgatcctcctacctcagccccctgagtagctgggactacaggtgtgtgacaccatgcacagctggctaatttttaaattttttgtagcaatgagatgtcatatgttgcctaggctgctcttgaactcctgggttcaaatgatctttttgcttcagcctcccaaactgctgagagtacaagtgtgagccagtgtgcccagctttttgttggttttcttttcttttttttttttttttgatgagacggagatttacccttgctgcccaggctggaatgcaatggtgcgatctaggcttaccgcatcctccgcttcccaggttcaagcaattctcctgcctcagcctcctgagtagctgggattacaggcatgtgccaccacacccggctaattttgtatttttagtggagatggggtttcagtgtgttgcccaggctgatcttgaactcctgacctcaggggatccacccgccttggcctccaaaagtgctgggattacaggcgtgagccactgcacccggcctttgctggttttcttatttgggttattacagataacagtaatagctttgactctacctattatcttgtgcttgttaagtacctagtggacttgtatagcattttgcaaggaactgtggaaacaacaggcatgggcatagagcttaaaattacatatatgttgcggagagttggggggaaagggtagggtagtaaagacactgtctgaccagagcagataagtatttcagggaaaaagatggtaccagctctttgttaaacgagtctgagcctggcctagtcagaaattgtcactataatttaactttttgtaacccctaaccttgtcttaagaactttattcttgttttttgttgaagacttttacgaaactgaaatcatatgctcttttctaaaaccagcttctttttttcatttctcactttttacttaaaaatatgaatgaattagagcatcttcagttctgacaaaccagttccttagcatgtttttaatgtgtcacattcttcctttttttttcttggagacagtcttgctctgtccctcaggctggagtgcagtggcgcgatctcggctcactgctacaagctccacctcccatattcaagcgattcttatgtctcagcttctgagaagctgggattacaggtacctatttgtatttttagtagagacagggttttgccatgttggccaggatggtcttgaactactgacctcaggtgatcctcacgcctttatctcccaaagtgctgcgattacaggcatgaggcaccactcctggccacattcttatatttaaaaaaaaaagcacaactctattgtctactgttgttcttttacctgaagttcaaactctagctcttcagaagaaaaatttacataatagttttccttttctctagggatgcaatgatagtttttcactgaaaaataatcgtcagggggccgggagcagtggctcacgcctgtaatcccagcattttgggaggctgaggcgggtggatcccgtgaggccaggagttcgaaacctgtctggccaacatggtgaaaccccgtctctactaaaaatataaaaattagctgggaatggtggcttgcgcctgtagtcctagctactcaggaggctgaggcaggagaatcacgaacctgggaggcagaggttgcagtgagctgagatgatgccactgcactccagcctgggcagcagagcaagactctgtctcaaaaaaaacaaagttagggtccactgaaattcattatggtatctattcaacttgcagtttaaaacacttttaggctgggcgtggtggctcatacctgtaaaccccggcgctttgggaggccaaggtgggaggatcacctgatgtcaagagttcgaggccagcctgaccagcatggagaaaccccatctctactaaaaatacaaaattagctgggcttggtggcacatgcctgtaattccagctacttgggcaggctgaggcaggagaattgcttgaaccccggaggcggaggttgcagtgagctgagatggcaccattgcactccagcctgggcaacaagagtgaaattccatctcaaaaaagaaaaaccacttttaatatgccatactgaagtttagccagtcatacagctgtttatttaatttgttaaatggttgtggaatatcggttttgggcaaactttgtcataggtggatgaaatccattagtaaagaaaggtaaatgctgtcttcaccttagcctgcatacagagagagatataggagtaagtagtcaatgaaattgaatttttttttttttgagacagtgtttctattaccctggctcgaatgcagctggcacaatctcagctcactgcagcctcaacctcccagactcaagtgatcctcgtatctcacactccccagtagcagggactacatgcctgtgccaccaggcctggctgatttttgtattttttgtagagatggggttttgtcatgttgtctaggctggcctcgaatttttgggctcctgcctcggcctcccagagtactgggattacaggtctgagccactgtgtccggttgggaattggatgtttatacaccatattagaggggctcttcactctggcatgcagttcctgaaccttttcatctatgaaaaggaaatgatatctgtgttgtgacttgaaggataaaagttaaattatttaaaggtgggattaatagggaaagagtaaagtacaggtaagatagtgggggaggtgttttaggaagaaataatagcattgaacaaatatccagggtcaagagagactggcagtttcaaaaaacttgaagtaaattatatttgcctccaatttgtatataagtgaaaagagtgatgaaggaaggatgaagctgtcgatgtaagcatggtcaggagtttaaggctgccataagtaaagtaggaagctattgaaagattttaagcaaatttccattttggtaaatcacttggctagtttattcagagatctgtgggcatagtagtttttctttctttctttttcttttctttttttttttttaagacagagtttcactgtgtggcccaggctggagtgcagtggtgatctcggctcactgcaacctccgtctcccagttcaagcaattctttcacctcagctccctgagtagtccagcgcctgggactacaggcacgtgccaccacgcctggctgtttttgtattttttcatagagaggtggtttcaccatcttggccaggctggtctcaaactcctgacccgaagtgatctgcttgcctctgccttccaaagtgctgggattacaggtgtgagccaccatgcctggtcccataccagttattctttcatttactgttacttctttcttctgtatatttactgaatttcctgctctcttttcctcttcgcctaactaaattctttccattgtttcattctcaccttacttgctgaagaatctctaaatctgtgaatgcatttggaggggtataacccaattgagtgttctgccactgtggaccctgctcctccaagttatcccttctgtttcttcaccttttccttcctcactgggtctttgcctttcaattatagatacattgtgttttcctgtctgcagaacaaaaatttttgatccagtctttctagattgccctgttttttattctttatttccaaggttttttttgagacacagttttgctcttgttgcccaggctggagtgcaatggcgccatctcggctcattgcaacctccggctcccaggttcaagcgattctcctgcctcagccttccgagtagctaggattacaggcatgtgccaccacgcctggcaaattttgtatttttagtagagacggggtttctccatgttggtcaggctggtctcgaactcccgatctcaggtgatccacccaccttggcccccaaagtgctgagattacaggcatgagccactgcaccggcctatttccaagctttttaagagtaggctggactggacatgatgcctgacacctgttatcccagcactttgggaggccagggtgagaggatcacttaagcccaggagtttaagactagtttgggcaacatggcgaaatcctgtctctacaaaaagaaatacagaaatagccaggtgtggtggtgcatgactttggtcccagctacacaggaggctgaggtgagaggatcacctgagcctggggaggtgaaggctgcagtgaggtgagattgcgccactgcactgcagcatgggcaagagaatgaaaccctggttttttttttttttttttttttggagagagagtctcgctctgtcgccaggctggaatgcagtgctgcgatcttgactcactgcaacctccgcctcccgggttcaagtgattctcctgcctcagcatcctgagtagctgggactacaggcacacgtcaccacgcccagctaatttttgtatttttagtagagatggagtttcaccattttggcctggatggtctagatctcttgaccttgtgatccatctgccttggcctcccaaagggctgggattacaggcgtgagccaccgcgcctggcccttttttttttttttttaaagagtagcctgtgcatatttccttacacattatgcagttgagcagttttacgcctaccagttgaatttattggtatctttgaaattgatacctagcacaaagcaaacaatttatcttttcctctcttccgaatcttgctcttttgttttctctttttttggtgttaatatcagaaccagtatctactgtgtcatctaaaacaatttaggaggttatctgaatttccttatatatctagatttttatcgatttctgtgagtcatttcatttgctgctactctggtgtttatgcccttactgtgccctatttatagtagtttcttaattgatttttataatcctagtctagctctcattgtcaagagtaccagattggtttttctgaaactcaaatataattactcataacctccattactttttatggtttcacaaggaattgcattttcttgtagaaaaatttgagaataaacaaaatacaaggaaatcacctgaaaagctgtcacacagataatcactaacattttggtatatgtatgttctttttctttgtattacggaaaatctcaaaaattacaaatgtttagaggatagtaaattgaatgtccacctttatcactttttttttttttgagatagagtttcactcttgttgcccaggctggagtgcagtggcatgatcttggctcacagcaacatccgcctctcaggttcaagcgattctcctgcctcatcctcccgagtagctgggattacaggcatgtgccatcatgctcggctaatttttagttttatcagagatggggtttctccatgttggtcaggctggtcttgaactcctgacctcaggtgacccgcccgcctcggcctcccaaagtgctgggattagaggcataagccaccacgcccagccaatcgctttttaattctgggatattttaacaaaaagctcagcaagactttttttttttcttaaggtggagtctcgcactgtcacctgggctggagtgcagtggcatgatctcggctcactacaacctttgcctcttgggttcaagtgagtctcctgtctcagcctcccaagtagctgggattacaagtgcccaccaccacgcccagctaattttttgtatttttagtagagacagggtttcaccatgttggccaggctggtctcaaactcctgaccttgtgatttgcctgacttggcctcccaaagtgctgggattacaggcttgagccaccatgcccggccaagactattttttagaaccataaccacaatacagttaccacacttttgaaagtcgatgggaattccttaatatttaaatttctcaataggctaatttttatttttagggatgggggcttgctgtattgacgagactggagtgcagtggctattcctgagtattgtcatagtgactacacctcaaacacctgggctcacatgatcctcctgcctcagtgtcccgagtagtagtgcagggactataggcacttaccgctgtgatctgcttagctcatacattttaaaaaaatagttggttcaaatcaggatccgaaaaagttacataaattgtgtttgattaatgcgtatcttgggtctcttttagatctagagtgtctctcatcttttttaagaaacattatttgttgaagaaaatgagtaattctgtataattccccacattctagactttactgattgtatccccatgatttctctgcctcttgtgtttcctgttaactatagtaactataagttaaatacggaagtttgtgattaaggtgtttttttatttttttttttatttttatttttttttgggagacaagatctttctctgttgcccagggtggagtgcagtggtgccatctcggctcattgaacctctgattgctgggctcaagcaatcctcccacctcatcctcctgagtagctgggactacaggcgtgtaccaccaagcccagccaacatttatattttttgtagagatgggatctcaccatgttgcccatgcttgatttttaataagaatacttcattggtggtatttatagattttgatttatttccaaattgttctttcaaaagtttcattttatctagtcattttacaggacagcttttatcagttcctggtataaaatccttttagcctcagccttataatatgaatatctatacatacataatacttcatacacacacgatatacatatattcccatgtatatatatgtgtgtgtgtcagccacttacatgtcctgttactcttctatgaatcttaaatttgatattgctgttttgaatctacttcatcccctatgccttctatattctctctgcttgaaatctaccctcactatcttgaatgatgaagcctggtgacaactttttagataattttatgtaagataattatttgctaagtcatccagtgacatactcgggtattgtttgtctccctaccagcagcatctagtaggtacttcaaaatcagagcactttattctgtatttttaattttttctgtctttgcctcttacccaggaatgcaaactcagatgtctatccacagaggcctaaagtgggctgtaacatggtttggcaaactttttctgtaaatagccagatagtaaatatttttagcttttgagtagttttgtgggcaactactcaaccctgtactctgctgttgttgcttgaaagcagccatagacaaaccgtaaacaagtgaggctgactttgttccaatttatcccatttctttgcttttaaaaaaatacctgtgtattcgcttagctggagttggtctacaggctgtagtttgctgaccccaggactagaggtttgttgccatgtgtgaatttgtacttaatctactcagattaaaagaaagaaaagctggaaaatcactgtatttgatgaaatatcccattgtataagtgttcccaaattagcctagaatgttatgaaatattatgagccagtaatgtctataggcttatttctgcctgaaggctactagttttatcttgagaatctcatcctcatttcctggcaaaatgagcacagaataaatgcttgttgaataaataaataaatgaacttcatacattattaatttgtttttgttttctcaaactactaggaaattttgtctgtggctaaaaaaaataaaaaggagaatgaggtaagaaatttataatgtaagattaagtttagaagtcatatttactcctcagttactagtcctttttctttaatcagcagtatacgttcttctcactattatcctgtttctttgctttaaaaaaaaatacctatgtattcacttcttccatatccaacattcttcttttttatgtatcaactttagttagttgttttattgcatgattcttgatgtataaatgttaatttatgggtctagcaatgttgcttttaacttgtgaatctggcagtgatacaagtgctcgtaaccatgtggatataaaccgtgaatcatcttatggaagctgtgagggatgccttaatcttgcttcagaccttaaagattttttaagtttcttaaaagttctgtttgagaaggcttgatttccgagccacctcttcacttagcccatttcatgtagagaggttccttgttatctgactttttattgttcaagtacttaaaattacaaggttgcctagggaagcaaaataatcatgacatgaaaatattcatgaatggatatgaacttcaggtagttaatttacatattaaagatttttaggcctttgggaaattaatgttatgtttataaaatgagagataatctatttggtcatataattttgtccaaaatttatattgtaaaagtgtcttggtttttattctttgttaagttattaaggactggtttatgggtgcagtttagttggatttttaaagatttagttagataaacatttagttggatttttaagataaagtctagatgtaatcttctgtaatttactatgggattttggcttcattttataacttacagtcagtaagaaatagttgttaagtatggtattttaatgaatttcgacacttgcatacacttgtgtaaccaccatccaaatcaaggtatagaacatttccattgtaaagggatctcttctatgtctttccacccccaaacccagaggaggccactttttacaccttttataggatggcttattatttcctttccactcaacatgtctgtgatactcatttatgttgttgagcatattagtaaccggtttcttcttattgactagtattctgttgaatgaatgttacaattttctcatccatccccttattgatgggcatttgggttgtttgcagtttgtgacttttatgagtaaggttgctatgataatttgcacacaagtccatgtgtagacatgttttcatactttctgcctgtgtacctgggaatggtattgttgtgttacgtggcaaatgtgtgttcataagaaagtacagattttcccccccaaagtaaacacatcattttattctctcgccagcaatgtttgaaaactccagcttacattattgtcagcatttgatagtctttttaatttcagccattttattagatgagaaatggtaacttgtgtggtttttaacttgcattttcctaattactactgaagtagagtatatttttatgttctttgataactatgttttctttctttttttttcttttttgagatggagtgtcactctgtcgcccaggctggagtgcaatggcacgatctcggctcactgtaaactctgcctcccaggttcaagcgattctcctgcctcagcctcccaagtagctgggacaacaggctcatgccaccatgttcagctaatttttgtatttttagtagagacagtgtgtcaccattttggccaggatggttttgatcacttgacctcatgatctgcctgccttggcctcccaaaatgctgggattacaggcgtgagccaccatgcccggcctgtatgttttcttttgtaaagtatctgttaatatcttttgcccgtcttatttatgcgtactgtattttctgtgtaacagtttaataaattattgagtatcacaatattagaagtttggaagagagatacaattctaatgatcttttcaaaagtatgtgcctgattttaatttgtaagggttattctcagatttttatattttattttattttattttattttattttttgagatggagtcttctgtcacccaggctggagtgcagtggctgtgttcatggctcactgcagccttgacttcctgggtttaagtgatcctcagcctcccgagtagctgggatacaggcagttgcgtgcaaccacacccagctaattttttgtatttttagtagacacagggtttcgccatgttgtccagggttgtcttggatacctggactcaggtgatcctcctgcctcagcttcccaaagtgctgtgattgtaggattagccactgtggcagcctgttatttttttttttagtagcttttcatttgtagagggatggcgatgtctccagttttttaatccaggtgtgatcttagtcttctatacttaatgattataggactcagtagattttgttagttgcattttctgataaatggtggcatacagcagcattttgtataacacatcttattaaactttttttctctacaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttagggtaatgaattggaatttttaatacaagatactggttttatttctatagtagcctaatgatttgaggtaccacaacttgagtcatttctatcatgtttcactattatacatttgtatgtggatacttgctttctgatttctttaccctgaatttttagaagtagaaattaccttgttaatggcttccagcacttttatggctttgataaaggactttccagtgttgttataatttatggtgtgaatatatcagctttaacataattctcatctttgggtgtgattttttaaagagaagaaataaaatattgtaatcctgtagttgtttatatccaagtttaaatacagtatctattattttgtccagatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatgtaagacatgcttccttatgttaaaattataattttacatgttttcttatgctttgttgtagtaggaattaaattgtagaactcttataattatattggtttctgtataaatattttgtctgatttgacttactcaatctgcacaataccctaatttaaatttatatagtataggttttggaaatccctgacatctttcctaaaatattcctgaatgattttcagtgcattggtaatttgattcgactgagacagacttaggtagagattttattaaaaattctgcttgttcttcacttgatctttgccaaaaggctaagaagagagttttctgttttttctgtacttgttaccttctgcaatttttttttttttttttttttttgaaatggagtctctgttacccaggctggagggcagtgatgcagtcttggttcactgcaatctctgcctcccatgatgaagcaattcttgtgcctgagccaccggagtagctgggattacaagcatgtgccaccatgcccagctaattttatgtttttagtagagacgatgtcttgccatgttggccaggctggtcttgaactcctggcctgaagagatctgcccactttggcctctcaaagtactgggattatagacgtgagccactgtacctcccgggcccagcccttctgcacatttttgccttatgagaaatatatatattctagacgtagtatcaccatctgtctcattttatatatttatatatatattatttatttatttattttgaaatggagtctgtctctgtcaccatgctggagtgtagtagctgggactacaggcgcacaccacaaggccaggctaattttttgtattttggtagagacaggatttcaccatgttggccaagatggcctctatctcctgaccttgtgatccgcccaccttggcctcccacagtggtgggattacaggtgtgagccactgcgcccagcctatatgtgttttatgtatttgtaggttttttgttggggggggggttgtgtttgtgtgtgtgtgtgtgtgtgtgtgtgtgtgtgtgtgtgtgtgtatgacagagtttcactgttgttgcccaggctggagtgcaatggcacgatctcggctcagtgcaacctccgcctcccgggttcaagcgattctcctgtctcagcctcccaggtagctgggattacgggcgtgcgccaccacgcctggctaattttgtatttttagtagtgacggggtttctccatgttggtcaggctggtctggaactcccgacctcaggtggtctgcccgcctcagcttcccaaagtgctggggattacaggtatgagccatcccacctggcccgtctatttgtttttatgcctttttttttgtcttcagacaggatgttgctctgttgctcaggctggagtgcagtggcgtcattctggctcactgtggccttcacctcccaggctcatgtgagcctgctatctcacacgcctgagtagctcatgtgaacctcccatctcactccactgggtgagtagctggcactacgggtgcgtaccaccacaccagctaatttttgtattttttgtagagatgggatttctccatgttgctcaggttgatctcgaactactggactttagagatcggcttgccttggcttcccaaagtgttgagattataggtgtgagccattgtgctgggcctgactttgtttttttgtttgtttttttttcattttctcccataatagttcaatgatttgttagaattgcttggcttattttgctatagaaaaatagaaataaaattttttaaaattatattttttccctcagaatgatttatattttctaaatagtcaatatttacattttgttcttaagtctgataaaaatcaatataaaatttttcagatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacaggtacaaatgatcttcattggtttctttgtaatacataaaacatgcttttcttcatttatatcactttctcaccatctgggagcatttgtctaatttttttttgttgtcgaaataatagattatattgtgcatatacctgtagaagctggaaacttttattaacagaatgattgggatgaaggccatcatttgtaacaatataattaaagcttatggcagtttaacctatggcttagaatcatccagaaatagacctaatctcggaatgtattacagatatatttgtgacaggtactttgaatatatggaatttacttatcgtattttaatcaaataagagtatttgaagacaagttatttttagagtatcttattggactatttggtagcattttcgtttctattttcttgatgttctagctacttatttaaataatttccagttagcataacagaattgaaagattgaccttttttctttcatgccttctgttttcatttattggtgttttgaacttcttcctcactgctctacctcattcatttataattcttgactgctttttttttcctttctctggccatgtgagaaccctcttagtgcagtccccttaggtttatcttgcttgcttggaaataggaaagtatttaatggtttcaacataaaatcaaaacacataagtcataaatagaataattatgacttgcataattatgaccagtattgtcaggttttatgtgtctgctggtaaaactttggaatatgatttgcagaaatctcagttcaggagtttagcaaagtttatgaatgtgtacagcattaaaaagtatttaaaccaggccgggcatgaaggcttatgccagtaattccagcacttgggagtctgaggtgggcagatcccttgaggccaggagttccagaccagcctggccaacatgacgaaaccctgtctccactaaaaatacaaaaattaggccggacgcggtggctcacgcctgtaatcccagcactttgggaggccgaggcgggtggatcatgaggtcaggatatcgagaccatcctggctaacaaggtgaaaccccgtctctactaaaaattacaaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggccgacagagcgagactccgtctcaaaaaaaaaaaaaaaaaaaaaaaaaaatacaaaaattagctgggtgtgatggtgcacatgtttaatggcacaaggattgcttaaacccaggaggtggaggttgcagtgagctgtgattgcgccactgcactctagcctgtgctacagtgagagtctgtctcaaaaagaaaaaaaaatttaaaccagtagtccccaaccttttggcaccaggaaccggttttgtggaagacaagttttccatggaccatgggtgggggatggtttcagaatgattcaaatgcattataattattgtgcactttatttttattattataaaattgtcatatataatgaaataatagggctggccgtagtggctcacccctgtaatcccagcactttgggaagcttaggcgggcagatcacttgaggtgaggagtttgagaccatcctggccaagatggtggccaacatggtgaaaccacatctctacaaaaatacaaaaattacctgggcatagtggcctagctccttgggaggctgaggcaggataattgcttgaacccgggaggcggatgttgcagtgagccgagatcatgccgcttggttggctgggcaaccaagtgagactgtgtctcaaaataataataattttacaactcaacataacgtagaatcagtggtagccctgagcttgttttccatctagggatgatgggagacagtgacaaatcatccaccattagatttttataaggagcgcacaacccagacaacccagatcccttggatgtgcagttcacaatagtgttcatgctcctatgagaatataatgtctcctgatctgacgggaggcagagctcaggccataatgtgagcagtggggagtggctgtaaatacagatgaagcttcccttttctgtaaatacagacgaggcttccctcgctcacagctgcttacctcctgctgtgtggcctggttcctaacatgccatggacccctacaggtctgtgacctgggggttggggacccctgatttaaagcatttctttacagtaaaagtaatatataccaattttttttaaagggtagtgtacaggaagatgtaaaagcacctgtaattctacctgagaactactacttttttctttttttttttttttttgaggcagagtcttgctctgttgcccaggctggagttcagtggcgcgatcttagctcactgcaagctccacctcccaggttcacaccattctcctgcctcagcctgccgagtagttgggactacaggtgcccacaaccatgcccggctaatttttttgtatttctagtagagatggggtttctctgtgttagccaggatggtctcgatctcctgccctcgtgatccgcccgcctcagcctcccagagaactactacttttatactaaataattatagctaacatgtaggtataatttacacatatgatcatactatacattcaatttttttttttttggtccgagacagggtctcactttgtcacccaggctggagtcctgtggcacgatctcagctcactgtagcctgaatctcctgggctcaagtgattctcctacctctgtctcctgagtagccgggactacaggcgtccgtcatcacacctgactgattcttgtatttttttgtaggaacagggtgtctcaagccatccaactgtctaggcctcccaaagtgctgggagtacaggtgtgagccaccacttccagcctgcattcacttttgcaacttgtgttttctactcagtagtataacatgaagacccttcctgtaatgaaatagttaagcttccttgtccatttcctttgccagtggctagaaacttttgactttttccatttaagtgagcttatattatcatttcaaggatcttagcttactctggtaacggagtgtgaggttccagggcttttgttgctgagtgcgagtggaagtgactgagttcacttgctaatttggctttcagattcctcatcatttatttccttgttttcttttctctcacatacccattataaaagtatatatatatatatatatatatatatatatatatatatatatatacacacacacacacacacacacatttttttttttttttttttgagacagtctcactctgtcacccaggctggagtgcagtggcacgatctcggcttactgcaacctgtctcccgggctcaagcaattctcctgcctcgcctcctgagtagctgggattacaggcatgtgccactacgtccagctaatttttgtatttttagtagagacggggtttcaccaagttggccaggctggtctcaaactcctgacctcaggtaatgcgtctgcctcggcctcccaaagtgctgggattacaggcctgagccactgcgcccggccaaggatattttatatttttatctggatttttagatagctgtcttacagtgagagataattcaggttttttggtttaacatattgccaggaaaataaatcctttcttggttattttaataaagaagatacagtactataaacttttttcattcttttgggatgtataaagcaaaatgcaaaacgttctctatactctttcctcaatttgtcagtcccattttttaaggatagttatatttttcagattgttatttatatttccagaaatacttcatatttctgtatgttaatataaattagattaattataaattttcctgattaagatatatgagaaatcacagatattaaaatgagaaagttaaaacaatttccttgataactttatgaaagtgagtgggtgactttctgtgaaaatataaattgcttaaataagggaaaattctagtgctatttgatgtttcagcacatatggaactaataaaagctcaatttttagtagtctagtgtaacattaatatcaaaacttgggaaaatattagaaaagaaagctacaactgcgttgactaaggtgtgaatagggaaatcttaaattcaaaataggtggagttcaaactttattgcatattttagtaggtctcttccaggaacagaaatatctatcagttttaggaatccttgtaagtggatcaaatgaaaacatgatcatttcagtagttactgaaattacatttgataaaattcaacatccatccctcataatagaggttttatttttagaattcttgttagaaaaattgtgagatcattgtttaaaaatctttttcctcaattcgttttctagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaaggtgggtaagccagttatttaatgatttaacctcaaaaatctgtgctgttagttaaaattactttcttttcagtgactgaattaaaatgccaaatatttggcaagttctttgtggtgtatattgtatgttctactcctgccacaaattatgtgagagcagattaagaaaagattatttaaaacttacttgcattgattaaaggaagactgctgaatgcaactttaagataatatttttataataaggttcttttatgtgttacctttgtaaaacattttaagatggatttttcttactatatcctcattaaacaaccagggacaatagagttgttaaattatttcctatctcacataaaagaaaacctaggtgtaaagttgttacaagataagactagttagttagcaccagagccaaagttaaaaccaaggtctcccaatgtaaacacagtgttttaattctggaaactgtttgaatcttagcttatataataaaatcagacataaaagtagttttcagaaagtaattagtagcttcagaatggaggaggaggtaatgttgacataatttaaaactgattacaacggaaatataacttgggcaaaaaataatttatacttgttttggcatcagtgaaggaagtaagctaattgggtgtggaaaaataattttaaattttgggaatttatttcaaatctggttaccgaatggtggctcaaggcaggctaccttattgtgactctgggcgcttttattgaaagacaagaattccaggtcctgtgcagacatactgagttacagtgtcaaggtaggagttgagaatctgagttttttgaacatgcttctggtgatccaagtttgggaacttctagtctactgcataaatgttactagcattttccagaattgggtataatgttacctattctatattattaatctgcatgctcatacttaattgctcattgtaatatatatattttcaacattgggaaggaataagcatgtatattattgtcaagttatgtatatgttgaattttaaaatatttattgtagtgggccatacttagactgatggagaaaaatcatatggctttggttttcagagatagttctcacttttgtaatgtaaaattataaatatataccttaatcttatttttgatttttatactactgtacaattgttaatctatttataaatcagaaaagtgttccctttaagctcacagttcttgatggttcaaaaatgcaaccaatttatctttgttgttggaatgtgttctcttccattataaattttaaaaattgcacctaaggatttgatgcaacaataccacgtttcattatcagattattactgtaaatgataaatcatgtatcatgttgacataattgaatttatgtgatggttaacttaaacatttttctcttccagctttgagtcttggtttgacatcactagtctttctgaaactgctgaagatattattgctaaagaaagagaacagaatgtattgcatatgctgcaccaggttttccatgttttcttattctgcttaaccataggctcgatagagtataaaaggaactctggagatcacctgtctaaccctttgtagtagagatttgaaaaatgaagatcctcctacatttaaatgactcctttgtcctttcttctcccagaggtcacatggttttatgacagaactcaagtgcttacctaagttttgtccttttcagatagtatactcattttacccctaatggttactgataagtttgtcaagcacaaaacagaagtatgtggtttttatggaatgcttgccaataatacttttataatttacatccttgcatggctgctgtctaatctatttttattgcttcctgtaattcctaccccatcctacctatctttaatttagagaaacattatctttcaagggtaatctagtcatatgggcctgaaaagcttctcagttgtggtttagcaattttattcaaagtctttatcgttttttctgatattaaagtttatacatgttcatgagaaaaacgtgaagcaggagagaagtgaaaagtaaaaatatcacttcctcttaaaattgtatttcctagcagtgcatgtggaatgattatgttgtgttatatgacaatccaaactcttttctgtctttgtgtaaacacgtgtgttttatctatattttatgaagaaaaggactttaaaaataaaattgttccttaagatagtcttttaaacagttatcagaaaattattttccttttactacatgtagatttaaatcagtttttaatagctgcttattatcccattgtcttgttctactataattaataatatctatctcttcctcttttcaaaattttcaacaatataaacaaggttgtagtatctgtatttaaaactacacctttgcccatttctggctatttccttaggaaagaattcctagaatgtatgtgtcagagtttacagatgagggcttctttgaaggcaaattgccctccagaaaagatttatatgatatacgtccatatgaaaatacttatttactcaagcttcataccaattttgaggttagaagtccttttcagtgttgcagagattaaaaaggatgattattgctgaattgagatgtttattgactattggtagttccttgtggccatattccaacatgtgttggaatatttatttattaatggtttataataactatatgttaaaaataagttaatgttgcaaataatttctttcccctcactttttgggataaactttgtttatggtatctttgtgtgtgttcatgtgcacaagcgtgtgtgtttatatttaaaattttctttttttcccactgtgactctgggcaatgacagaaatttcaatgcaccaatagttatagaagcttttaaatgtcccagtctgaattattggagtaaatgacttatttaggaagagatgtgtttggatatcacatcctcatcagtagtgtatacatccatatagtgtagcaaaggattaagtttctgttcttaggaaatttaattagagtcaagacaatgaatatttatagaatttgtcacttacacgttacctcacagtgtatacaggtagatagatattccttagaaatgatcatctgccttttgattgaacatttgtagtaattgtcatagttgataattccataagagggctcactggaattgttttactatagataacttcagatttccattaatattaagatatgataatgaacttttattatatccaaattcaacagttttatcaaaaataggggcagttttgaatgttctagcaataagaatattctctgtaatactgtgcttaaatttgagtttatattacttttacgctttgtcctaattatgttttaatgcattactacaggaaaaagttttcattcaaaatgaattcagattaggtggagatagttttaaatcgctagtatattttcttaactattttctatatgaaagaattcctttcctttttttatgcaatgtttacataaaccttgcatagtaaaaaaaattttttttactttccgtttaaagttctctaagcttgctacttttctatttccaccccatattgaaggccaaaagcagtataacctttacaaattaattatttaaaattttttattttaaaattatgcgtacacggtaagatatttttaaatgttataaacatttagaaattaaaaagtaagaagtaaaaatttctgttttccttctgcacttcctttcttatctccaaagtataactaatagtttttttgttttgttttttttttttgtttgtttttgtttttttttttgtttttttggttttttttttttgagacagagtctcactctgttgcccaggcctggagtgcagtgagcgtctgcctcccaggttcaagcgattttcctgccttagcctcctgagcagctgggattacaggcgtgtgccaccacacctggctaatttttttgtatttttagtggagacgaggtttcaccatgttggccaggctggtcttaaactcctgacctcaagtgatctgcccgccttggcctcccaaagtgctgggattacaggtgtgagccactgcacctggccaacagatttttttttttttttttagagacaatgtcctactatgacatccaggcaggagagtagtggtgccatcgttggttattgggttgttatctgcagcctccaactcatactcctgggttcaagtgatcctcctgcctcagccttctgagttgctggaaccaaaggtgcatgccaccaggtccagctaatttttggtagatgggtcttgtataagtcttgtttttgtctgctttgaaagcttgtatactaggaaaaacatatataaataccttttttatacatgtgtttcagcggtatagtgtgcctcttcttccacatatttgccatttcagttaacatcaaactatagcatttgtcagtgcatgtggtagaaaaatatctggttatttcatgttttccttacagacatggacatgttttttttaattttatttatttatttttatttttttgagacagaatcttgctctattgcccaggctggagtgccgtggtgcaatctcggctcactgcaagctgcacctcccgggttcacgctattctcctgcctcagcctcccgagtagctgggactacaggcgcctgccactacgcctggctaattttttctattttttagtagagacggagtttcactgtgttagccgggatggtctcgatctcctgacctcgtgatccgcctgccttggcctcccaaagtgctgggattacaggcgtgagccaccgcgcccggccggacatgttttaacatgtttatgaaacatttacatatttttcctgattgcctgtcggcatatttgtttttgggttggtagataccaacactggtaatgtgtttactatctttggtaatagtctgtctatgattagctctatacctgttgggtatttaagtccagagtcctgaaaatgagctttattatatatgattactatatgtaaaccattgtcagtatttaatggcaggggtataaagagtatacaattatttgtttattattattagtagtagtagtagtattttttttgagtcaacgtctctgtcgcccaggctagggtgcagtggcaagatcttggctcactgcaacctctgtctcccaagttcaagccattctcctgcctcagccttccgagtagctgggattctgtaatcccgccaccacgcctgactaaatttttttgtttttttagtagagacgggatttcaccatgttggccaggctagtctcaaacttctgacctcaggtgatctgctcgcctcggcttcccaaactgctgggattacaggtgtgagctactgcgtccgacctagagtatacaatgattttaatctagtatttgtgctcttttagtgacccgaatattttaatgcataattattgtctgttgcttctgtgttctctttataaatgtgataatcatttgtaaccaccccagctaatgaaagagaataattttaagcctgaaactttagaacttatagaaggaaacttgtatgtctgcatccctaggtcagctggctttttactgagtcttaaaacctcattctattaaaaaatttttaatttttaaaaaaacttttagttttttgggtacatagtagatgtatatatttatgaggtatatgttttgatattgatacagaaatgcaatgcataataatcatatcatggagaatggggtatccatcccttcaagcatttgttaccctttgtgttacaaatgatccagttatacacttttgtgtgtgtgtgtgtgtggagacagagtcttgctctgtcacccaggctggagtgcagtggcacaatcctggttcactgcaacctctgccttccaggttcaaacaattctcctgcctcagcctcttgagtagctgggattacaggtacccgccagcacacccagctaatttttgtatttttagtggagatggggtttcaccatgttcaccaggctggtctcaaactcttgacccaggtgattcacccgtcttggcctcccaaagtgctgtgattacaagtgtgagccaccgcacctggcctctagttatactcttctttatattttaaaatgtaaaagttaaattattattgactgtagtcaccctgttgtgctaccaaatattaggtcttattatttctactttttgtactcattatttcaaatatttttaatttttattcatttttattatttccccttttgtatggtgctgataacatctcattctaaaagttgtgggctataactgaaacttcaaccctaagaaatacaaatgctacctttatatttttacttttaaaattatttgagatagattcttacagtttttaaaagaaaataaattctgaaatgctgcggacaactgtgagtttatcatttggtctggtctgggaaaatctcaagatattttcaccttttgagatttggcattatttatataggaagtcaaaagataaggtaaaggagtatatggggacagtattccttgaaaaacaagaatgtttaatactcatatttttctgttcatgttttaattttagattttaacacctttcttattgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgaggtatagtggttttgaaatgtactgtaaatgaaacttgacatataaaatttctcttttttccctttttttttgagagaaggtgtcgctctgtcacccaggctgtggtgcagtggcacaatcactgctcactgcagcctttacctgcctggctaaattttttgtatttttttgtagagactggcatttcgccatgtttcccaggttggtctcagactcctgggcttaagcagtccacccaccttggcctcccaaagtgctgggattccaggttttagcaattgtgcctggcctaaattccagttttaaggtccccttgttcatttttaggacttgggtgaatttctaactggggtataaggcataaggcttagtggcaaaagttgtttcctagtatctggagtcctgctaaaatgttaagtgataatctttgtattaattgctttacagtcatctggaatacttactaaaaatttaggccaggcacggtggctcatgcctgttatcccagcactttgagaggccgaggcgggtggatcacctgaggtcgggaatttgagaccagtctgaccaacatggagaaaaccctgtctctactaaaaacacaaaattagctaggcgtggtggcgcatgcctgtaatcctagctactcaggaaggctgaggcaggagaatcacttgaacccgggagacggaggttgtggtgagccaagattgtgcctttgcactccagcctgggcagcaagagcgaaactccgtctcaaaaaaaataaataaaaaaaaaatgtatatttccgtacagattaactctaatcatgctttctggagatgaacttggaaatgcatttttaacaagcacacaggtaggtatttgagaatccctgtactaaggacttggcaactagactaatctccagatatacagattgagcatccaaaatctgagttgctccaaaatttgaaactttgagtgctgatatgaaactgaaaggaaatgcttattggagcatttgtattttcccgttagggatgttctacctgtacagtttccttacagaaggttattgataaccaaaaagattaataatcaatttgatgatgattattcatcacccaccatattataggagatagaggtgggatgttattatcatgtaactgaaggagacccttaagttttgtttaactttccaggttttttattgtacactataaacctacgtattttcttttcaaaatatttattgtgatgcatttttaaacaataggaccaccagactcttctccccccgacttttttttttttttttttttttttgagacagagtctcgctgtgttgcccaggctggagtgtagtggcatgatcttggcttactgcaagctccgcctcccgggttcatgccattctcctgcctcagcctcccgagtagctgggactacagtcgcccgccaccacgcttggctaattttttctatttttgagtagagacggggtttcaccatggtagccaggatggtctcgatcttctgaccttgtgatctgcccgcctcggcctccgaaagtgctgggtttacaggcgtgagccaccgtacccggcctcttctccctttttaataattaattataattaaaggaagggtctagccgtttacaaatttacattatttgtctgttaatgagcaatttcataatgagcagtttcatgcagtgttacaccagtctgaagaaatatcctctgtactgcaaatttccggagccatatttcaactttaaggtattaaatccttttgtgtaagttcaaagtagttttatacacccttcatttttacctattgagatatgaaggcccttcctcttactttcagatattgttgtccatgttaaaattaaactaatttcccacaacatttgtatttgtctatagattgtcattttgtacataaaatatgccttattttgtttacatttagaacctaaggacatagctttataaactgaatttcttttaattcgttcccttttagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaaggtttgaattcaaaagtgaatttaagtattctttaaactgtgaccattttttgcatttcccatatatgcattatttgttttggtagagctgttgtggaagtgaatatccctgtagaatctgaagttaatctgaagctgcagaatataatgatgctacttcgtaaatgttgtaatcatccatatttgattgaatatcctatagaccctgttacacaagaatttaaggtgaatactgtttaattctaatttactgttttgatttccattacttttatattggtggaaagtgttactttttttgattataattattaaaaataagtatggtgctatttgtcatgaagattgtaatccttcagtaagctgagacagtcttctttccgaaatttcagagaaccttatcagggttagaaaaatggtcactttctatgagcaactagttttttaaatttttttattttttatagagacagggtcttgctatgtttctcaggctggtctcaaacttcctggtttctcaggcaatcctgcctcagcttcccagagtgctaggattacaggcaagagccaccacgcttggcctctatgcaacttatatttttatttacatattttatgtgaacaactaagaattctaaatttagtaattgatttgtactctgcatgtttacttgttatattttagagagagtggtcatcttttcactatttcttttatcattaatatttggcttatcaaaatcagcctggttgctcattgcttaaagatcaacaggtagccatagaataaaaccagttttgatttggaggttttcaaattaagtaaatgaagttgctttcttgggtagttgatagaatgatagcataatatcaatagaaataaattcttagtaaccctcaatcacagttgtttcaaggtagtttacaataggcttttccactcctggcaatattgacattttgggccagataattctttcttaggaggtaatgttctgtgcacttaggacatttagcagcatccctgtcttctacccattagatgccactagtattcacttccctcagttatgacaactaaaaagtttgctgccgctgccaaatataccctggggataggtggagggcaaaattgtccccatttgagaggcactgctttacatctttattagagtaagaaggaagacaaaactttcccactcaaatgaaagtagctctctcatgagggaatttcaccagaaggtgaaaaagtctttgtccacaatatttagattacttatcagctcctgtattttctcttaatttctggtaagaattctagcagtagtttacatatacatttagttggaaataactcacttataaagaataagcctgagtatgtacccattaagtttgacataattgttttctttcacaatgactttgagagaggagtgttgaggttagatcaaagttatatttgtactttgtttttgtgaaattgctggttttacattctagagtatgtctttgagtaataactatcttctgattttacaaagattgaataacaggtcagtttttaagttttttaagtgacttggctttgaaaattgaactttccaaatggcttttgttttaacaaagcaaataacagttttctctctattttttcttcctttgcccctccttaagatcgatgaagaattggtaacaaattctgggaagttcttgattttggatcgaatgctgccagaactaaaaaaaagaggtcacaaggtggtacttttgattggaattttggattgttcaattatttttttatcaatcattagaaatattaagatatgtttaatttcaggtgctgcttttttcacaaatgacaagcatgttggacattttgatggattactgccatctcagagatttcaacttcagcaggcttgatgggtccatgtcttactcagagagagaaaaaaacgtaagactacttatgtcatacataccaaactattcttttataattcctatcttgatttctgaagtaatattccaaatagacccacaaattgataaaaagatagaaatgaccagaaaccctgtggttttatcaaaaacaaacattttgatttagtactaagaagtcttaatttttgattcacaaatatatatatcttctggcacaatcttattaataatatcctacttaaccatcactgtaagaatattgggatagcaggaaattttttgcctttttgccctgtcctcaactttctattatgaaaatatcaactatatggcaaagttgaaaaaaaaaaagcaactgtaaatccgcctacaatctgctgttaacatttgactatacctttttaaaaacacatttcctgtaatagcagccttgctgtatccattcagcatttaatcctggttttttggtgcatttaaaaataaaatatagatgatactacccttttccgtaatgacttcagcatattttatcttttggggtaaaatttacacatactgaagcaaataatgtatacatttgctgaatctttctgacaaatgcatatgtaaatttatacctaacccctattaagatatagaatgttaccatcagcccagaaagtttcctgtgcccccttctagtcaattctcccctgcacccaccccatgtgtttagacaactacaattttttcatcattttttgatattagcttttcttatttaaacattgttgtgatacatggtttttaacaaaattaagatctctttaatataggtgcttggacgataaagctaacagcacaggttttgttaacataattgttttatagatctgaatgatttgtttggcctcctttgtttaagtctttaatagttgtaattgaaaacatttttctccttcagtcttgttggttaatttattttaatctgttgtatttacatcctttttgcttttagatgcacagcttcaacacggatccagaggtgtttatcttcttagtgagtacacgagctggtggcctgggcattaatctgactgcagcagatacagttatcatttatgatagtgattgggtaagttggaagtatagcaaggaatatgctgattatatttccattttgaatttttttttttttttgaaatggagtctcactctgttgcccaggctggagtgcagtggcacgatctcggctcactgcaaccttcacctcctgggttcaagtgattctcttgcctcagccccctgagtagctgtgactataggtgtacaccacaatgcctggctaatttttgtgtttttagtagagacggggttttgccatgttggccaggctctcttgaatcctgacctcaggtgatccgcccacctcggcctcccaaagtgctggcattacaggcttgagccaccacacccagcctccattctgaatttttttttttttttttttttgagaaggagttttgctcttgttgcccaggctgggattaagtgctgggattaccagcatgagccaccgcgcccggccattctgaatttttaatttttaatggtacatgttacaaatttacttatctattttgaaaagatacccattttcagctaagagttatttcttcataaagttttttgcaagtaaaaattgaaaatttttttttacttttgtttttagtgacagggtctcactatcacccaggcttgagtgcagtggcaccatcacggctcagtagccttgaccttttggattcaagtgatcctcccacctcattctctcaagtagctgggtctatgggtgtgctaccatgcccacaaaaaatgtaaaaattagtgagaccacgtctcactgtttgcccacgctggtcttgtatcctcatatgatcctcctgccttggcttcccaaaatgctgagattataggagtgagtcatcgtgcccatcctgaaatgttttctttagggtatttaaacttttttgttaatattgtcaaggatctgtggaatgataattttgtctatgaagccactctggaagtttaaattaagacaccactatttaaaagttcctggctagatcattcatgttgactttatccacatgagtttatgttaattttaacctaataccgttaaatattatttttctttttaactttaagaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaagtaaataacacttatgtagtgctttattgtttaaattgtgcattgtgtgttgtggattttgtttttattttgtttataaaatattacagcctgggccgagttctgtgtctcacacctgtaatcctagtactttgggatgccaaggtgagtggatcacgaggtcaggagttcgagaccaggctggccaagatggtgaaaccgcgtctctactaacaatacaaaaattagctgggctcggtggcgggcgcctgtaatcccagctactcaggaagctgaggcaggagaatcgcttgaacccgggaggaggaggttgcagtgagccgagatcgtgccactgcactctagcctgggtaacagaacaagactctgtctcaaaaaaaaaaatattaacagcctgatatgacaggatttaaataagcagtggggaatttgggagcctaaactaagttggtcaccatagacataaaagaaagaatgttagcgagtatgtagatatgtagatgaagagcagatgggcagagaaaaggggtcaaggataactacatgttcctgataagagattggcttgctaaaagttttaagataaatattttgcaagttccatgtattaaaatattaagtgtatttaagtgttataaaaaatctatttatttattgaacccactgtttcacagaatatttcactgcagaatgccctttttatagttttggacacttttttttcctttttcatttccttatcataaccagatgggtctcaacaatgctttttaatctagaaaaaattctgaggaggtggggaactgacataggtgaaaaagttttgttcctgagattccttagagaagttatacttctatccattcaccataaaattttctttgaataaatggcttgatagctacctgaagaaatgttgaaaatcatttatgtaaatcatcaagccctagagaaatgggaacatgataatgttaatgtgaaaagtaatgttggaaatcactaataatttattttatactccttttccacttgtaaatactttctctgggttttgaggtaagagtgtattaaggtttagacaaaattaatttggtgaaacatttagattgtaattggaacttgcattggggaaaaagcataatttttttttaagagaccatttaacttttttacccaggttgttctcgaacacctggactcaagtgatcctcctgccttagcctcttcaagtgttgggcttataggtgtgagccactgtgctcagccctattttcgattttttagtagattaattttgtagaaaattttgaagggatttttttaaatgctgacatttttcagttgagttattacatacatacagcaaaatgcacagatcttaaatgtacaggttaatgaagtttgaccagatttatgtactcctatgtaactatcatcgagatcaaggtagcattttcatcatccaagaaattttctttgttcaccctttccagtaattcctatgctccccttaccatcactaggaagcatccagtattctgatttttgtcacactgatgagtcttttttctgtttagctattttgttgaatatattttttcaacacagagtcatctgtgttgtttttagtagaatttttttcttttaattggtgaatagtttgttttttccattctcctgttggtcgacatttaaattatttctagattctggttattatgaataagttggtcctgtacaagtctttgtggacataatgcattttttggtccttgatcttagggagggtgcgtgtttaactactggaaactaccagccttttccaaagtggacatatcattttccagtcctaccagcgaagcctgagagcttcatttgcttttattttttatcaacacttttttttgccgtccttcttaatgcaagccattgtgattggtttgtaatatgttgtattgtagttttaaaaggaattttaatgtttttaatttctcattttttttagatcatttcaaaggtggtcagtctggattaaatctgtctaagaatttcttagatcctaaggaattaatggaattattaaaatctagagattatgaaaggtgagtttttaattttagaaagatttaatttgtagctttgaattattcacatagacttgaatattttgttttctatagggaaataaaaggatcaagagagaaggtcattagtgataaagatctagagttgttgttagatcgaagtgatcttattggtaagtattatgcttttttttaatggaagcttcgaaacatacacttaattagcataatgtaatgaaccccttgtgcaattcattcagccacatgtatccaatcttgttttattgtcatttttcttcttagagtattaaaatcaaatctcagacatgacattttgcccataaatgtcattatctttaacttcttccataattcagatattttctgtaaactggtaaataacacttgtaaatgaatatattcaagttcctgtcttagttaagaataccagtgctttgttctcatatttttcgtcataccaggaggcacatcgtatctggatttcttatttccagtgagctaagattaatcaagataatgttataaagtgtcttgtcagccttcatcctttacttaacacgatgatttattttattttattttatttttttggagacagagtcttgccctgtcgcccaggctggagtgcgctgacacgatctcagctcactgcaacctcagcctcctgggttcaagggattctcctgcctcagcctccctagtagctagtattacagtcgcctgccaccacacctggctaatttttgtatctttagtagagacagggtttcgccatgttggccaggctggtcttgaactcctgatttcaggtgttgtgcccaccccagcctcccaaagcactgggattacaggcatgagccactgcaccaagcctaacgtggtgatttttagtatcccttgaaagtggctgataagaaccattattaacttaatcattgcaaaatggtgatttttcttgttctgtcattcttttattagctgggttatttaagaactttcccttacagtttccctgagatagaagagagccaggatatattgcttcttttttttttttttatcagtttttagaataccaccttatgatctgatgcctacagtgatgaccatgaattattttgaaaacaaaaataatattttgtacttcataatttcctaattattttacaacatattactgtcgtctaggctattgattatttgtctgttgcatctgtatggtggagatactgtataatctttttttcccaactgtattccgtgacattttggtcttttgaaattggtgatggcagtaacattcatatcacggatacaggcagaaactagaaaccccagtctttgtttttaacaaaaaagggtcttgctttgtattcctggctagaatgcaggagtgcgactatagctcattgcagcctaaaagtcctgggctcaagggatcctccagcctcagcctttggagtaagctgggattataggcatgagccattgtgcctcagtttttgttttttttgagacccaattgttaaacatttacctgcgtggcactggctacagtgtcatgatatcttattttcaaatatgttgttcattttaaaattcaattctgtgtcttattgaatcaaaataaaatatattggttggaagtttttttttttttttttttaatcagatgtattttccaaacattttcttctactctggcctgtctcttcacttacttacttagtatcttctgaagagcaaaagttttaaattttaatgaatttcaattttaacaaatttttttctgttcactcatgatttttatgtcatctgtaactactctttgcctaattcaaggtgttgatattttcttttaatagttttatagtttttgctcttacatttagatctatgatctattttcaatgaattttcatctttttgcatgtcaatattaatttgttaaaaagatgatcctttttctattggatggccttgtcatccttgatgcaaataatttgatcataaatataaggatttatttctgtattctcaattctgtcccattgatctctgtggtattcctatgccagtatcgcactgatttaattaaggtagctttatgggaagtgtactttctctagttttgttctttttcaaaattgttttagatattctggattatttgcatgtttatttgagttttaactttgaaatagtttagggagaaatatgagacatacagcatcatggtcaaatctaaactatattaaaaaacaacattatgtgaggcatgtaaggactgtttaacatctgataatataattcatatcaattaaataatggagaactagatgatcacctaattagataccaaaaaccaacttgccataatatcgtaatcatcttcataatttttttttatttgagacaaagtctcgttctgtcaccgaggctggagttcagtggtgtgatcatggctcactgcagctttaacctgctgggctcaatcaatccccacacctcagcctcccaagttgctgggactgcaggtgtgattactatgtcctgctaattttgttttgtgtattttgtagagacaggggtttgccatgttgctcaagctggtctcacactcctgggctcaagtgatctgtctgcctcatcctcctaaagtgctggcattatcgaaactgcttttatttgcaagtggtctggtttgattatcttcataggaagtccaagggaatccagaatcttttaaaatagaatttaagaagattgcttattaataatatgtgtaacagcaataattgtttaataatgaaggtttttacaacagctacaaaattaacatgcctacaattaaagtttaacaatttttaacatgtttatataaggacagaattatgaaacattgaaggacgttaatagaaagactgagtaaacatgcagatttagctgtatttgtggatatgaatggttactacaaagtgtaagtcagtggtccccaaaactaacttatattcttgaatttttcttctaattaaaatcccagaatgatggctgggtgtggtggctcatgcctataatcctatcactttgggaggctgaggcaggtggattgcctgagctcaggagttagagaccagcctgggcaacacggtgaaaccctgtctctactaaaatagaaaaaattagcggggcatggaggcatgtgcctataatcccagctactcagaaggctgaggcaggagaattgctagaacctggcaggtggaggttgcagtgaatggagattgtgccactgcactccagcctgggtgacagagcgagactctgtctcttaaaaaaaaaaaaaaaaatcccagaatgactttttgtaaaacagactgttgttaaaatttatatgagagagtaataaagggccagaaccaagacagttttgaagcacaagatattctataccaggtataaagtcttattaaaaatttaaaagtcataataatcaagatggtagaattagcacatggtgtgatatattggctagaagtacaatatggtgaatctagaaagacaactttcacgaaaagctaataaatgtgaaatggaacttcaaacaactgataggaaattcctattaatcaatagatgatctggggaaatagtaattaataggggaaaaattaacttagattctcctctcctcacactgcacttacaaacttcagataaattaacaatccacgtgttcaaaacctaaatattaaaggtagaattttaacctaaaaagacaagaaaatatatttatgattttagaattagaattctttataatacagaaatcacaaattatatgataggtttcatagattttaattacattaataggaaagactactataagacagatgacaccataaagagataagagacaaaccacaaataatatttgcaacatataacaggaagtgtttaggatatgcaagtaaataaaagttgataatgaaaacggataatataagagcaggctattaccaagagagaaagaaatgtctgatgaacagacaaggatgattagaaatcagtaatacaaatgaaaatcagatttcatttcacagctgtcatgttgataaaaatttaggagactacatattgtcattgattcaaaatgtttctcaaggtaagctttttgtggtgtgttttcagctattaaacgaatcgtgattgggcctctttttaaaacgtttctgacaacatgattcaaattgatattatttattgctctttgacttgtttatcttaccttaaattcagcaaaagcgattttgactagcaaactgatgctttagattgtatgctcccaagagtctgattctagttgttgtattaagaatagtgtacctttttgctttcactgctattaaatcttggtgattaaggaagagagtgccctgtattactgtgagttttataattttggacagatgactcacttctcataacatcatattggatgtttcttttacgatttcttcttcttatacttctaaaatgtacctgttttaatgtttttcccttagatcaaatgaatgcttcaggaccaattaaagagaagatggggatattcaagatattagaaaattctgaagattccagtcctgaatgtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttccctcctttcttctagtaatgcagttcatgggctttaggtacttcagttatgaagtaggcttttcatggggagagattgggattatgctctctgttgtttaagaaactgtttgattttagagtctatttctatgagatagtttaccaaataaatgttccttataagatga

SEQ ID NO: 1741 - DNA, 152509 bp, Homo sapiens
gcggccgccgccatcagcagcgcagctccagggccggctgcagcggcagcggctccgccgggcgtcctggcagcaggttcggcgcgggctccgcggcgggggcgctgcagctggggagggcggcggggcggaggggggggggggcaggagcacatcccttcggcgggcggggggcgtgcgggcgcgcgtgtgtgtgtgtgtgtgcgtgtgtgtgcaaccgccgaccttgcagaggggatggctgcgtgcgggagacccttggcacttctgggcgccctcgccgcgcgcgagccgagcaggtacagagggacccagcctccccagccgccttccagccgcagacgcattttgcaagagggtggggggtgaaagagaccaggcctcggcatcccaacctcccggctttgtgggtttctttccctttcgttctttgctctaagtgcctgtttactcccggccacctgggtagtttctttccgggttgggagtgcgcgccagctgcagttgggaagggggcggtgggttggggtgcgggtcggctcgggctcgccttggggtcgggctcgggaaggagttgctggctggagaggggagggggcggcggcggagcaggcggcgaggaggagtctcagggctgccgcgctcgcctcatctcgtcctcctcctcctcagctctctgcatccactccaggctccttcctgagctggcacttccattccccccctcctcctggcatgcgaagcgctttgttcagtgcagcgttgcagaggggttttcccaggctccgccctccacattcattcatgttttttctccttgcaactgtctttacgctttttgatcgtgtcatgtttttgctccatgtagtatttatttctttcccgtaaaggaacggtttatcactcgtcctagtcgctacaatgctgctgtctttggaaatacccacttccccccacaaggatttaaatatgggatggacagctagggacagtgggtaggcaatgaacggggtagcagaaagcctttacggacagggaatgtgcatattttacatttatgctccggatcccatgggatcacatgattggattacagtcagagttcacgctttaaaaacttccaaatatcgttaccatttaaaagctttaagtttaacaacgaacgtagttaagcattcatgcaatttatttggttcagctgtgtctcaattctttattgaatcagaaccttcctgaattagatagtggatgtttctttagagcaaggagctgagaaaccctatcttttatagatcacttagcacaatgctagatgaaatacttagaccatcatttttttttgtattattttaccatgtagttaaaaattgcaaataattttgtgctgagctgacatacagccagatcagggataaaatactgaagttaatcgtggccttctttaccttctgtttctttgctgtaatgaaaccataaatttctaaaaccttatactgggatgttagacacattccttcccatataggctttcttaaggagaattaatagttcagcgtttttgtgtgacaggcaaagcgtctacaatgtttagtttagtccttataacaaccttctgatgtggataatatttcctaattttacagttgggaaatctgatcttcagagaggttaagtaacctgaacaaggccacacagtaaggggtaaagcctggctttgaacccactccggtttgacaccaagataagtcgtcatgacttgctgcgcctcttgaaagaaatcctgaaagtagatgttatcagctccacaaaataagcactggatataactgagtcatgcagtaccacattctttagttgtttatcttggacaagttacttatccaatttttttttaatctgtaaaatgaataaatgatagctaccttcttagttaacagattaaattagggaatgtgtagaaagtacacaggcacatagtaggtgctcataagtgttctcttgtcttctacagtaccactaataacaaaagctttaagccttccttactgttctattcttgtgtctttgcttaatgactaaacattgtttcatgtttaacagtgacagtgggctttgcttctcagttttcttgcagtaagttaaaatttcagctttaagatccttgagaatcttgtggaagagcctgaggtggctgatttggggagataggtgattcggttttgggtcattcttatcttggcctattatatttcagatcactgtgttttaaaatctgtaagtcaggacaggctaggttgtgctgcagtaacaaataactctcaaacctcacttatttaagcaaacaaaaaggtgtttctggcgtatgctgtgtgatcacgtgggttagccagagctgactttgtggtggtgtcagatttgctgtctggagcagtgctgatcccatggcagagagagaagagctctggaggatcatgctgtggtaataactaaatgctccagcctggaagtgaagtctcatccgctcacaggtcgttagctacagctcctcacacgttcctgggaaacacagggaagcagaaagtgtggtcctaccatgaacctagaggtctggaataactggagtagccacagtagcaaccccttgtattaactgagttaactctaaaacaagatgaacaagacattgtccctgcccctatgaatgggcagatttactatacatgcctaacataatccttttgtagcctgatgcgatactttacttgttcctggtattgttgttttaaaacacaaagtgagtttttttactcttgtctgataaagatacggtgttttttttctgttttcttaatgagaagtcccgatactgacaaaatgacctctgtttaattaaaagttagtaatcttttgcagtggtgcccagcttggttactttttcttgagtttaggttagtgctctgctaggcagtaacttttaaagtatctttctcctctgaaggtagtaaaatgtgcttctccgtttttttctttttcagcacatggattaattgatgtatgttgagtttatggagctgccttttggtggcttgctttatctgcagtttttaagaagaaaaagaaggccctgagtcaaagaagatgcctcgaactaaacaaattcatcccagaaatctaagaggtaaagcattgcattaagtagaagtaaggcttgctgtaaatcttttaacaaagtatctctttggtgacaggaatggccgtttgttagatgttgaccctgcctggtgaggagcgctatttctcttgctcatttccagcagtcctgcacaattcctgtctctcaggagatacttaataaatatctgttgaatgaatgaattgaatttgacgaaattacagtgcattccttccaaaccattagatggggtattaaaggctgaaagttgctatttgttaataggaaccatatttgggtcaaggaatctgaaagtaatggttaaatattctttgccaactggatcattaagaattttatgtttttttttcactcttcctccatagttcttttgaggtttatttttgtaccactccatcagttagattaacaagataagaagtgaagagaattgtaggcattcactcagaccattacttgcagaagtcagaggcaaactgagttattttccacgaagaagcagtgggtcacaaatatatatatgatacacatttcatgcaaagacagaaaagtgtgtgttttccatcaaccgcgaatacttttaatagtagaaaagtaagtgtattctagcttattgtttaaaaagatttgtattgttctcgtgttatatcaatggtgaatagcaattatcttttatattaaacttcaggagataagaatgtagtagtgctaaaaacaagaactattaaagcaaataattccaaactgactatggtgttttatgaaatatttaccattacagaaaaaaaattctgaagcgtatgtaggggagaagtgacttaaaaatcaaataaattaatttgaaatgttttttggtaaaatcaatttggctagtcaccataaggtgatctttgaaaatgcagtcaattttatggcctccgtgaatctggaaatagtgcttgtttcctgtctagaaatctctgttgcctcaggtggatgcctcagcctaagttcaaattgatgattgtagtaaccagtgttcaatgaggtggagatttacatgagaacaagtgtggtgtgtggaaatctgattttttatagtcatatagaaaacgttgaaaattgaatgtgtttgcccgtccccctcactagaatctgaactccctagagactcactctcatttgttactgtaggaaaagcctccagacccaagggtaccagctgaggtgggcatttggagacatgggccctgctttatctgtccagggagggcaccctgttctagtttgcacaagtgcagcatacagatgagcagcagccctagcccagcacagttcctggcagctaatggcagcccaaatatttgttgaaggaacgagtgcatgattgatctgaaggtgttatttattaggccataagtattaaacatttttcatatttaaaatatatgttcataacattctagataaaatgactatcctgagaaacacagatttacaggccataggctcttttcctttctgtatcaaataaatgttcaactcagcacatgtttgttactgtgtctggaattggtgggttcttggtctcactgacttcaagaatgaagccacaggccctcgccgtgagtgttatagctcttaaaggtagcgtgtccacaggttgttccttctgatgttcagatgtgtttggagtttctttcttctggtaggttcgtggtctcgctggttcaggagtgaagctgcacacctttgcggtgagttttatagctcataaaggcagtacagactcaaagagcaagcagtagcaagatttattgcaaagagcacaacaacaaagcttccacagtctgcaaggggacccaagcagttgcaactgctgcctccggcagcctgcttttattctcccgtctggccccacccacatcctgctgattggtccgttttacagagagccgattggtctgttttacagagagctgattggtccattttgacagggtgctgattggtgtgtttacaatccctgagctagacacaaaagttctccaggtccccactagattagctagatacagagtgctgattggtgtatttaaaaaccttgagctagataaagagtgctgattggtgtattcacaatcccttagctagacataaagtttctccaggtccccactagactcaggagcccagctggcttcacccagtggatcccgcactggggccacaggtggagctgcctgcgccttgtgcctgcactactcagcccttgggtggtcgatgggactgggcgcctaggaacagggggcagcgctcatcggggaggctggggccgtgcaggagcccatggcgtggggggtgcttaggcatggcgggctgcaggtcctgagccctgccccacggggaagcagctaaagcccggcgagaaatcgagcgcagcaccagtgggccggcactgctgggggacctggcgcacccttcgcggctgctggcttgggtgctaagcccctcactgcccggggcctgccaagcccacgccaactgggaactctagctggcctacaagcgccacgcgcggcccccgttcctgcccgcgcttcttcctccacacctccctgcaagctgagggagccggctctggcctgggccatcccaggaaggggatcccacagtgcagcggcgggctgaagggctcctcaagcgcggccagagtgggcaccaaggcggaggaggcgccgagagcgagtgagggctgacagcacggtgtcacctctcattactaccttcatgtacttcatgttcttatgatagggataaaatgataaaacacaggtctcgaaagaagaatggagttgaagagctgataggtaaacatgtaactatgtactatggtgagaaatgaatagtatggagattccacagagatagggagtcattattttgtccccattgtagggggcgcagtttggggtgaagcagaatgatgatttagggaaggaaagttaacacctggatttggttcttaaggctgggaagttatctgcgaagctgacaaggcaaagtgagtgcatttcatcctggggtagcaggttgtgaaataacttggggactctgagcaactttaaatggttctctacttctagagcataagaagttctcttcaggagggatgagaaggagacagagaggcaggatactggagcaggagaatcaggaggaatcagatcaggaaaggccctcagatttaagcctacatttcatatgtagagttaaaagttttaataagaaaacttgcttctttaagatatttttaaagttttcaaagagaacttggaataaattgtgtctgacttgtctgtgagcgtttaggaagttgtttgactaaggtagttaagaactcacagccactaaagaaaagattggaatagattagctctagtaagcacactaaagccacctcagtgggacttctgatggggaaggggaagacttcagggaagcggcggcttctgagccagtgtagctcactcagcagcgggggacgggagtgaagctctaggtccccatgggaaaccctgagtaagcaaagggacagaggggttggtgctcggcggtgacacctagaaacttccgcgctcctcacaatgtctgtaaggactcgagccctgggaaggatgtgggggttagagtaagcaggtaaccatcagctcctgagattaatttttgagcgtatctttaatatctcattgtgacagtttggaatatcaggtttgttgtgccctacctgtgatccactgctttgctttactagaagacatctctaatgcgatgagataagaaatgcggggagaggaaattgggagaccagaagaggagtcacagcccagtttgcccctactgtttctgccgtcagctcaggagctttcaggaaacccatcgcctctttttaggcttcctgggggaaatagtctgaaatgtttgtcttgtgcttggtaatcaagtccgtattaaaaggcagatacctgatactttctcaaattatatttttcttatgcttccatggtagtttcacctcttagaatgtaatctttctttgatttattcttggttctcctgctgggacagatatatccctacggatgtgcaaagccacagggtaacatgtatctttcaggaatgtgaattttacttggggaaaaatacgtatacttgtctgtgtgtgcacacgtatacacatattaaagtattaggcaagcataaaaatgtgcaataccggaatctatcatggaagagtatagaaagtttgcatggatttgaaaattaagcctgcatagactgcttttataaggagatggagtatctacttctttgctcttagaggttgtttactagaaaaggtataagaagaattgttaggttaagggcaggaaacaaattggggacataagtgagacagtgtccgacttgatgggtgatctgtatactgtgtaggactgtggttttgttgaattcagtctcttcacccttggcccagcgttaaaccagatagaatcagttctccatgcctgtttcccatctgcaggaaacgtggtgggtgccgttttgacaccgacctatcctttgtgaggttgaagaattttggaagagcatgagagcagcacttggtgttcagaagaaaggcttagcatgttgtcctgggttccgtggagaagggtcactggactgcacggggtggctcttccgcatggtcttggtgagttgacagcagggcagcgctgtgtctcccagccatcattccttactcatcgctgctctgtggaggggttatctccaccaccttctcaggccttcgcttggacccttgagtaacatggaatggaggagttggtgacttgcagggggttccatgcctcttccgttgtgataaagggctctattcgtgttttgccactcattcttgtgaatgtgtttcaaagctttgaaaaaaaggaaaagaggtgttacttactttagttgtatttgggcctagggtttcagagcttcatttcctttaagattggaagtcagtgtggaaaatactaagtattaaccttttgcaaaacatgttttgaaaatttggtgtagctgtttttcatttttattggttgagttcatttggctccgaacactctgcaaaaaatgagaactcttttcctgtctgagaaccagatttctttctttctttcttttttttttttttttttgagacggagtctcactctgtcacccaggctggagtgcagcggtgtgatcttggctcactgcaagctccacctcccaggttcaagccattctcctgcctcagcctcccaagtagctgggactataggcgcctgccaccacgcacagctaatttttttgtatttttagtagagacaggttttcaccacgttggccaggctggtctcaaaacttctaacctcaggtgatccaaccgcctcaaagtgctgggattacaggcgtgagccaccgcacccggcccagactccttaaaatgtgagaagtagcactgaggaatgtgatcagatcatggccttgattgacacatggggtcgctttccacggttggccttcttgttctccacggcatcttgtgcatagccatttgccatttcaggagctcagcatgcacatccggtatttctgtgcttggttgtctttctggaagttacttcttctccttttccatttctactgttttcttactctgtatgggagatgtctctgctaaagatttcacctctgagttttttcccccattttctgttctcttgtcagatatcctcctcccctccacagacatgccctgggtctcctttgcttgtgtccacatgtgccttcttgtacttacaatattacatcatgatcattcttctccaggtctcttatcttagcgggattataatatgttagaagagaccattttggtcatctgtgtgcaacagaagaatatttggttgtgttaactttttgtttttgagacggagtttcactcttgttgtccaggctggagtgcagtagtgctgtcttggctcactgcaacctccgcctctagggttcaagcaattctcctgcctcagcctccggagtagctgggattacaggcctgtgctaccacccccggctaattttgtatttttagtagagactgggtttcaccatgttggccaggctggtcttgaactcctaacctcaagtgatccacccgccttggtctcccaaagtgctgggattacaggcatgagccacttcacctggcctggttgtgtcaactttttagcaaactagagggttgagatgatttatactcagggaatttgtttacatttttgaacctcgagtaggaaatgcttcttccaatatttggtagcttctgattaaaaacttgtgataattttaattgcctgaacagataaaccaggtggttattgttaacttttgttttatatgaaattttacttcacatacaggattttttttttttgagacggagtttcactctgtcacccaggctggagtgcagtggcacgatcttggctcactgcaacctccactctccaggttcaaatgattttccttcctcagcctcctgagtagctgggactacaggctcctgccaccgcacccagctaattttttgtatttttagtagagatgggatttcaccattttggccaggctggtcttgaactcctgacctcgtgatccacccgcctcggcctcccaaagtgctgggattacaggcatgagccaccgtgcctggcccatatacaggatttttatagcttatccatttggtacatttaattactataaagacaaagagtttggcctcatgcagtcactgacttgctatgtggttggtttccttgtgtgtaaaatggagatgatgtgtgaagatgagatgatatggcaaatgtaagcatttgccacagtgcctgacacagggtacacgctcaatccagagagctactactttctgtaaaaaactggtttatgtcagactccttggttccatatgctttataaacacaggaaacaggaatatctacataaaatctgtaaatgcattttaggcttctcatgtgctcaatgttgattactgacatgtcccattcttgttctgactattcaaaggttgggatctgggggagagaggtcagtgcagaaaataatttgggaatattcttaccaatgtgctgctccctccatttttccacttaaattcatttaagccttgcctcgttttttgacagtgttagatgaggttaaacagaatatttgtcttcacttagttctcaagaaacagattctgagggcttctgttttattgttgaactcttttaaaaaatgtcggtgtcacagatcacgcgggattgaagtgaagtgctctccttaggttccaagatggcagccatctctctgtcccctcctccgcttctgtgtgacacaagagaagcccagccggggtttcagaattaatctgattaagatgaatgttttcatttgctatcaattgtgggcctactccagtggttattttacaaagtctactaccaggaataaaatcttacgtttacttgttatgtagggattatcttgttgagctgataagtggagtaggtttaattttgatgattttcagatggaattccagctgtttaagcatcgtttttcacatttgaatgttaggtcagcagttccatgctgacagccttaagatttgagaaatcaaaaatcttgtagtggaaacaaccccatggcttatttcaaaaacaaaaacaaaagaaattctctatattgtagctagaaaggaaataagtaataatttaaaaaatagtttttgttaatatgggtgaaaaagttactaggagcgatcatgtagatagctgacagtgcttagtttgaggaggataaaaatatgaaaatggagttaacatagcaagcctcctttttttttgcagataattatttttcggctcatgttgagagcttatttgatgctttctgaatgcttattaacgttagccaaatgcttctttttaaaagcaaatacaaaatgtagtaatatgattaaccagagtaatgattttattttagaacatttttgtacaaaatatgttctgatgaggtacaatcttatcttaccatagaacggaaaaatacataatttgtgtaaaatctcctatcatagaaaaacatttttaagcttcacatttaaaatggtgataatttgagcaagtctgggctaaagttgattcttgtattatgcagaaaaatattttatgaataaattaagtgctttactttttcatgtacatatttaactctttaaaaacatttttgcagtactcttctgcatattaatactatgctcattacaggtgatgctgttatactgttaaccattgttcactatagcacaaaaacttataaccaaagagagacctttcttctcagtgctcaagtcattctttgagaaagaagctctttttgatcatgaggctttaggcttacatttggtatacagttgcattgattttgatttttttttttttttttttacaattttaatgagaagttgtcaaaaggtttttagaaattttctatgatgaattttgttctagaaaatattctaaggctgtgctgtgatgcaaacatattgaaaaaatagaaagtgataacaaaacggttggctgctgtgtaatgagatagcagtccctaagcatgaattggaaccatacgatttaagagttacacctacttaatacaaagcttgatttttatggtccttatgtgtttctgtccacagaatttctgtgtgcctgtgtgactagagtatgaatttaaccaagcatacttgttattttgtactttgaagtgtgcttacataggtttatcttcaaattctttcagatttgccagtgaagaaaaagatagggtgagcatacaactgcttaatatagtatccagatggaaataggttaaatatacaattagggtggtatttgatagtttaaagataaagagaaaaataaactgggctgatacacagggacttggaaggtggttggttaagccacgccaggagtgaaccaaggctctcccttgtgttgctgggttcttgtgcgcctctctgagagaattacacattttacagcaggaaggatggaccttggaggtcatttagttcagcctcctcattctgcagatgggaaggcccagtggcaagagggaggtggttttatataggtcttacgatgataaaaagggcgaacctttccacaggtctctactaggctctgttcagagggcttttcatgttttctcatttgattcctacagctacctgagacaggtacttttatgattcccattttatagatgtggaaatgaggcacagaaagattgctatttgcccagggtcacatagctaggagtctgcagtgcttttgcttctaaccatcatgcttatacttgctgatgttgatagtagaaagttctttcctgattagtaagagtttagaaatgctctccatcccagttaacttgctaagcatagcacacagagctgaggttattcaggaggtcagaatttgaaggattttttttttcttaagcctttaattgtttagaatctatttcaagttgtatatgtatatattattccaagttagatttgctatcacaaacagtctagggaatttccaagctctttaagagggaaagaatagttgtctcatccaagacgtttgcttacatgatttgcttaattttatagttggaagtagagatgttttacttaaaatggagaatggcagtgtttaagtgggaatctccgcctaacagttgaaatttcggacctgaaggcttagaaaatatttctggggaaactaacgtgaaaacattaaaattctaagcaaaataaagtagataacattctataatttgtcttcatgtggtaggtacagtaggatatggaaaaagcatgctattttagacgtatgggcactcttcttccacactgcaggtaaagggcaaataaccatcgttggccaagctcgatggctcacgcctgtaatcccagcactttgggaggccgaagcaggtggatcacctgaggtcaggagttcaagaccagcctggccaacatggcgaaaccctgtccctactaaaaataaaaaaattagctgggcttggtggcaggtccctctaatcccagccacttgggaggctaaggcaggagaatcgcttgagcctgggaagcagagtttgcagtgagctaagaccacaccattgcattccagcctgggcaacaagagtgaaaccccatatcaaaaaaaaaaaaaagaacaatttttaagggatcatagagaattctgtttgtcttccgggagcagtgaaaatgctagtaggctatgcctagacaaaaaatcttgtacctgccctcttagagtttttaatacattgtgtctccaaacacaggaaaataaaagatctaagagcaacataaaggaacaaatataatttcaggctagtatgtgcagtatggaattccccaagggaaagtggagcaaaaaataattggagtggagtaaagcaatgaggaaatacctcgcggaggagtcaactttcttcttaactaaaacctgaatgaggaggagttttgagacgggtttttaaagacaggaaggatatattggcagagaaagtaagttgtttttagactttggtagaagaatgaatgggggaaaaattacgcagaagtgattgttggtttagattgcttggttagagtggatttcccagtgaacttgaaactctaaggaagaaaagaggaaaggaaacttattagatttaatgtgtttggtttctgtttatggtaattataaaattaccaggtcaaggtcttttatactgccaggtgggtcataaggtcataagtatttaaagaagatcgttcggtggctaggcagtatcttttatgttaacattaaaaaacaaccttcacccaaggtcagtatgatttgttgacacccaggaaactggtaacagtttaaaagaatgaggcagccattttttattgtttttcctatttcagaagatcatcatgtgtatgaataaaccagcaaaagagtaatatggctttgagcaaatatctttagtttcttcttagagaacaaggtggttaggggttggtaggggtgatgttgatctgcaatttactttttagttgtaaatggctgttattctagggatcagtaaatcctgactaaatccaatcctccacctgtttttgtaaataaagttttatagaaacatagccatgcccatttatttacatactgaccatggcttctttcatgcaacagtggcagagttgagtggctgtttgtggtcacgaagcctaaaatatttactatttaatgctttacagaaaagtttgccaaatcctgcctgggaaatagagagttaacacatttatttgtaaacccttttctgtttgggaataaatgagaatgctttatctttctgtggaggattgctgtaggaatgaattattattaggggaacctaggtactgctttagttagtatgtgagggtccgctgcctgccaagcataagggaattcacatttggttgggaagaagtccacttacttgtggttttaaaatgaagggaaagccttagaggtcaagttagtcttgccagaaatatttagttcttgattttctgataccaaggtcatgggtctcaacccaaaaggattagattgttagggagccacctgttgagtcaggtagcgtactctccttttttaaattgtactgtctccatctagtcacctttgtatttaactcaacttggtagaaaactactgcaggcaatccatttccaatgctgtacatgaaacgtcttgtgaaggactgttattcagcaaaatagagctgtctttgagaggtgcgccttctgacaaatgagccctacaaggaaggtcttcccctgtgagtggagtgccaggtcttgagaatgggaccaggtcatctgagtgattgataattgctgctagcacattaagcattataatttgtccttaggttgtgggaaacatgtttaaacatccaatatgtttgaattctcagtagtccctacaacactttctgtaatatcctaataattctttttttctggtggttttggggtagtgggatgagagtaagtaaatgatattttcgtgttatggttttgttttaatttattttgcttaagtttaaatttaaggataggctcagttgagctcatgataactgttgagttgtttggggaatactttggaaagcatgttaattctccacagatgaattggatcgttaacctctttattttggtccatgctggtgttagcacgtggctcaaaatagtatgagaatcggtaactgttaacatgtttcctttcccagcgacaggaagagcccatagtggtcatgaagtatggtggaatcagagggccactttggtggctgtcacttataagcccgtctggacttctgtggcccggctctgaggtgttggacatgttgtggagttcaccacctctgtccctgtcttccaggaaatttatagttgaagacataaaggccataatggcttcacgtgaaagtctagacagctgtatgaatatttgatgagtgagcatataaggaaatactcagttaacatatgtaaggagatgtatgactgcatagccaaggggttaaatgctttatttatccttctgtatgttgacagtttaggttgatctatcatgttttgatggaattaatgccatacgtgtgatgagttatatattcagcattcatgttaatatcttcttggaagagctagggtttgcaataagttgtatttgatggatatgctccttcatggaaagattacctttttcagtctccagtttactgccttagttatactactgtatactgtatttgttttacagctttattaagacataatttacatgcaataaaattcacccgttttaagtgtatgattcagtgtgtttagtaaatttatagagttgggaaacctttaccacagtccagttttagaacatgtctgtcacccccaaaatttccttgagcttatttgcaaccaatccttgctcccactgtcagctgcaggcaattgctggtctgttttctggctctttacatttgcctattctggacatttaataagtagaatcatacagtatatagtttttacatgtagctttttttcattgtttgagattaatctgtgtcgtagcatgtatcaggatcttccttaccttttatcgctacataatattctcttatataaatgcactgattgtattgattcattcactcgtttgatggacatttgtattgttttcagtgtttggcttgtgtgaataatgttgctgtaagcaatcccatacaaatctgtggttacatagagtgttctagaagtctcaggtcaagctggccattaacacctattttacttgatattactatagagactagggttattgtttgcatggcatgtgtgttcctgttctttcacgttgaactttttgtttctttgaacctctgccactgttgcaggtgtgtcttttgtggacagcgtgttgccgcgattgctttttcatccagtccgacaatctgccttttgggtgggtgtttattccatcacattgatgtaatttattattattactgaatttatatctgtgattttgccttttctgtttgcttcatacttttgttcctctgtacttccttaattgccttcttttgtgttaaattttttagtgtatgattttgatttctctttcttttttgtttttactatacttttgattaattttcttagtggttgccctagagattataatatgcatcttaaagtatcactgcctacttgagagtaatactaactgaactctggtaaaatatagaaacttttctccagtatctccttttctttctccttttatgctattattgtgatatatgcttaatccctttatattataaagcaggttacacagtgttaaatcactcctttacacaatcttttttaaaaataatttaagagaagaaatgagaaacatactaataggtcttacatatacctacatatttattgtttctagcactctcctcttcttctatggattcaggttatcatcctgtaccacttttattcaacctgaaatatttcatgtagcatttcttgaaagtcaggtcttctagcagcaacgttgcttttttaatatttatggaatgtctttatttttccttccgttttgaagcataattttctggatatagaattcttggttgatagggttttgttgtttttctttctgaactctgaacatccactattctctggcctctgttacttctgagaagtcagctgtttattgtgttgtgtttgttttctttgcaagatgaattgtttctttcatggttctttccatttgtttctcatctttctccaatttgaatgtgatgtgcttagttgtggatttctttgtgtttatcttatttggaattttattgaacttcttggatatgtagatcagtatttttgttttatcaaatttggggagtttttggccattatttcttcatatattttttctgtacctttcttttctctaatcacacatttatttttatgtttgttgttccacaggtctctgagggtctgttaatatctctttaatttttttctgttcctcagattggatacttttcattgagctatcttcaaatatatggattgtttctcgtaccagttcagatttgcggttgagtccctctagtaaatttttcatttcacttactttacttttcaactctagaatttctatttgcttctctgtctctttttaaaataatttctatcactttattgagattctatttgttgttataatcatactttaattctttaaatatggttcccttcagttctttgaacatataatagctactatgaaatctcatcctattaaatccagcatttggggatactagagatactttctattgactcaatttttcccctgagtatgggtcacactttcttatttctcttcatgtctccaattttttgttgaatattttacatttaagataatagattgtagcaactgtggattctgatccttgctcccttgtgagttattttttggtttagtagcttttctggactaaatatgtgaaggctatttctctcatgttgtgtggctgctgatggctctgcccaggtttgctttcgtttgtttgttttttttgttttcttatgttttactttaaatcctagcttcctagagggttaccctgtgtagttttgttttaaagccaaaggtagatcagagcttaattgtgagtcagtctgaaccttgactctctgcctgtgggtctgtgtgtgggctggggagcactttcaaatcacaggcagttctcacatctgtcctggctttaactttcagctggaccctcttatgtcttctttgtgtgtgtatgcccaggctctgtggcccaggagtgtgcagaggttaggagactgccctagtgttggtgacacatgtgcagagtctctggttaacctgggatacatgtggagagtttacccagcacactgtaagtggctcacctaccagaactccctagtaagtccctggctagtcttctagtctcttgcttgccctcagcaggacctcagcctcaggcggacattgccattgattttcttgagttctcttgctattgggattgccagtttaactgactgtgctccaaatctggtgaacctggcctggcaaaagcagtgaagttgctgcttttcccagctttcccctcttggttgaaccctggcactgacagaactgggatagggagacaggaacagccccgggcaaaaaatgccaatgtgctagtcttacctgcagttcagtactttccacgaagaaatgcccctccacgtgtatacggctttgggtgattgccagagcgctgacagtggtggttcttgacagttttgtgtggctttatggttgcgttttgtggagaggatttgtcactcctcactttgtccttgctgcatttcctatgaatgtgtaccattctgtcctcctgtggaccgtgaatgtggaccatgctgtcctcctgcagcaggcagtgtcctgggccctcataacatcaagttgcacagtgtgttttgacaggcctcttacttaagactgcatgtagagacccatcaagctggcagaaaatctagatgctttttaaaagatacaaatagtgtgatgattgtgtttttaaaatactgttgcaggcattctgcatatttaaaatccctactactgatgcaaatgttagttcactgataacctttttttttttttttttttgagacagagtcttgctctgtcgcccaggctggagtgtagtggcgcgatttcggctcactgcaagctctgcttcccggtttcacgccattctcctgtctcagcctcccaagtagctgcgactacaagagcgccaccatgcccggctaattttttgtatttttttttagtagagacagggtttcactgtgttagccaggatggtctcgatttcctgaccttgtgatccgcccgcctcagcctcccaaagtgctgggattacaggcgtgagccaccgcgcccggccatgataacttttatatttaaacttctataactgaaagtgtggtttagtgggggaaaaaaagcaagagtttggagtttagagttgtgggattgggattgaatcctggtacaacttactaggtctgtgattgacagaatgttacttaatctctctgaacctgttttctcatcctaaattggatataatattcctaccttatgggttattttgaaaattaaatataacatagataaaactggtacttagtagctattcagcaaacgtttgtttacccacccagaaagtttgtggttgtgggtgtgtttttggcaactttttcttcaccagatttatcttcttgctttacctagctttgcttcttaacgttttctcctttttgtagaataattttgctattttatatactaactgaaacatacagtgtatttctttcagggtacattttggttgaatgctcttcccagatatccaaaatttcccaacatttcatagtgatttcctttctaaagtataaatttcatgtgcttacaagtgatgatgaaacttcactgttattttacggtgaatgaactcatatgtagacggtccctgacttaaccaatcgtttgtcttatgatttttcgacccatacaaccattctgtttttcactttcagtacagtattcaatatgtgagatatctaacactttagtataaaagagcctttgtattagatgattttgcacaactgtaggctaatataaatgtgctaagcacattgaaggtaggctaggttgttacaatgcttggtaggttatggtgtattaaatgcatttgacttatgatattttcaatttatgatgggtttatcagttcatgaccccattataagtagaggagcatgtgtgtgtgtgtgtgtgtgtgtgtgtaaaagattatcaggtggaacatctgtacaatgagagacagtagcattgttatgtcgacattctcaggccatgattagaaggggcaaagcaaggtctctaagagagattatcaaagaatgtactgagaaacgttcttgaaccttgctggaccacagcccactctgctcaacctcagcggttctcttctgtgatatttaagttaatatggaagaagtggtaactttggttacatcaggttttaatgtcacctttagttttggggtggacacaactggactccagtatgtccaaaccctcttaataatactatattttcatagagtttttagaactgagaattgtatagtttatcttactattttacttactgacagagtaccttattctagaatactttttaaaaaaatattaagtttttaaaagccaaatctctagacacttcttgttccttggaaaccttcttgtctcctgaagagtacatttgttgtggatagtgtgttcctcaagagtaattcttaaactagttggataggtttaaatttcgcaacataggcattgcagaatttagacatacaggaaatcaggattcagggctcatttgttgtaaggtgaaatcaggaagtctctggttaaagattggatgggattaagcagacgttttgtaggcagtctcttcaccctgaactgcagccgtgtgctgtctggaatgcggtctgacttaataacccacccatgccagtaacatacatgatagagcagaattgctgtagttaaataatggattttataaacattagatagtcttttagcacctgcatttttttgtaagagtcaagcaagaagttatgtatgtatgcattttggtctgaatcttgtacttttgttaaacactgatataaatgtgtctcttgaggctggtctgtaacagatttataaaaatgattactgtttcttaggctttaaaaatcatatttttggcaaccgaatctatgagttttattaagtaaaagtttagaccttttattctttgcagattggataatttttcttgtacacttagcaaatgtttgataaatagccctgcaaggcactgtgcctgctgagtgctgtggaggttacctgagtgactctggcatacattgtagcctcagcgaccctgacgctgcagttcaataggagagttaagacaagcccaaaactgtaacagctgcaaagtgataagggctatggaacaatgaaaactgtcaggagagactgggaaaggagaacagtgttttctgattccatgtgaaagctaccccctcaaccccaagaattctctttactttctgtgcccacattgagctaattctctaagtcccagtttcgtaaaacctatgcatgtatttctgatttcttctcattgtgggtacttgaaagagaggaaaaaggaatttggggtcagagacttgggtaaggagagtaacctggtcaaatagtgtggtttcttgacctgggcgttgtaccaggctgtgtgtggcatcctgatctgacatgccactgaaacagcctggaagtgcaggatctcaacgaaaatgtagttggaaaaataatgcgggtaagcttggggctggcagcatgttagaattgggaaaaataccatttgtgtaaatcaagcgcttggtaccagatgtatgaagagctactgacacctcatggatgtggatgttattatttctggttacggaaagtgtgtatgtgtatgtaccaggatctatatatggtgggtatatgcacatggtcttggctaaaattgatctatgagtttaatctgtgacagagaaagctgttcagtatattcctcagttgcttgaaaataaacttggagtgtatctgttcaggagtcacagattaatctttctaagtgtatcctgatttgtctgacagaattctgcagataggacttactggaagtgaagagcaggtgtcatgtaaatgatgcattatctttttcaagtttagatgcatactgtttgaggaaaaaactgcaagcatgctttttcttcttttttaatgaaataagaatagttcagagtggtggagtgtcaggacccattgataggtgggtctttctagaaaaatctaatttcaatgaaaaattacacatagtacattttgctttttatgtattccttgtactctgaacctgtgtgtgtatatcagcaaaatttgttgtttctgaaatgtacttctaaagtgaatcttattttttaacatttaatcgttttagaattatttgtatacccacataagcagatacataaacagggaaggatcttttaaatatgatgttgggattaacggagtggatgtttggaggggaaagtactgaaattcatcccacaaatcaacatacattttcgagtagatatgtagaaaatcaatatatagaaagtaggaaatatagaaaaacattgagatttcattctagggcttagagaattacagtccagaaacaaaaagcatgacagatagaaaaatataaactgcttatttcagaactagtatgaaaaaggtagccttttctaatacgtaagaaaaggtacaataggtaaatggacaaagggaattacaaatgctaaagtattatatggaaacatcgttctctgtaataagaaaaaatggaaacaatgtggagacaatttttatttacccacgcatttgctattttaaagaaatggcacccagggctgctgaggttgtgtggaacaagtatactcatttattgctgatgacatagtagagctttaaagggttttatgtcttgaaatttatcctaaggaaataattcagctgaagcaaaaagatatttgttcaaagagcttgattttggtgttatctttaatagcaaaacagtagaagtgccttaaatgcccttcagtgcagactaataaattgatcttatgctctggcagacattaaaaatgataatttttgaaatcctgtggaaacatgaaaaatgttcattatatgtaaaaatccacgtatgtataggatatacaattgtatggtctttgtggaaatacttttgttagggtgacagcaacatgagaattttaagtaatttcaggcatcaattgagcatttaccctgtgactcttcagttaattcatcaatctgtgttctgagcactgctgtaggctccagggatgcacagccccttgggtgatctctgtggtcctgtaggcggacacataagcagctaacaacacagtatgaaagagcagctttctggctgagtgctgtggctcacgcctgtaatcccagtattttgggaagctgaagcaggtggatcacctgaggtcaggagttcgagaccagcctggctaacatgggggaaccccatctgtactaataatacaaaaattagctgggtgtgcgtggtggcgcacgcctgtaatcccagctacttgggaagctgagtcaggagaagtgcttgaacccgggaggcggaggctgcagtgagctgagattgcaccactgcactccagcctgggcaacagaagattcatctcaaaaaccaaaaccaaaaacaaacaaacaaaaaacagccctccagagaagatggtgtggaggctgggtcttggagaatgaataggagttggccagatcatttgggtggaggctggctgaatggaggcaaccatggaaataaagtagtgacgttcaagttttggaggatgtggatatttacaaggaccaagttatctcagggtgaccttaacagtcaggagcagtgatggaggggacggagtgggtgttgaggcccgggtcttggagtgggtgggtgtatatcgtattttggttggaagaggagtgcctcattttcacttcttgcaggtttttcatctttcaaagttcagtatgtattatttgtcttgttaatcatgccacattctcataatttttgagcaccttttttggttgcctggctatttagtaaacataagtgtagaatcaaaagagatgtttgtctgtgtcagtttcttcgtgtgtttgctactgtggtcattcatatattgatcagcgatgattttcctgagaccgtttattgcattggtggcaaaaattagattttctgactcccaatctgtgaaaccatattcctttctgcattttattgctggactgtaggttatgttgaatataaacatatttgtggataatgtagttgtatgtggctgagaggttgcactggatattatggaaaagaattttgtatatgaaatagatagtagcagtgagtgttttcctgttttctttttaaatgttcttcaacagggagaatgaaatctaaatgataattctgtttattgttttttcctttttttttgtagggtcttgctcttttgctcaggctggagtgcagtggtgtagttgtagctcactgcaaccccaaacttctggggacaagctaaggcttgtccccttcctgctttagcgtcccgaatagcttggactacaggcacatgccagtgtgcctagctactttttttttttggcggaggggaggggagttcctcactttgttgcccagactggtcttgaactcccagcctcaagtgaacctcctgtgttggccccccaaagcactgagattacaggcatgagccaccgcacctagtctgtggtttttcttcttcttatttttaaacatcctgtgcagaaaaaaattaaggaacctgatgtatctgttagacattaataccgtgcaaattcagtatgttttagtgttttgatctattgatatcctttctattgaaggcaaggaacaatagttattcggggctttattagattttatttaatgctttcataaagaagcacagatattactatttatcaactgtaatttttaatatttgagaactatattttggtgtaattgtttttttaatcctgtgtattttatgcattttaaaacattctgaaaaggggtccatcaatttggctaaactgcagaggcatacagggtacacagaaaaagttaagaatcatcctctggatgggcgcggtggctcacgattgtaatcccagcactttgggaggctgaggcaggcagatcacgaggtcaagagattgagaccatcctggccaacatgccgaaaccccgtctgtactaaaaatacaaaaattagctgggcatggtggcatgcacttgtagtcccagctacttgggaggctgaggcaggataattgcttgaagccaggaggcggaggttgcagtgagccaagattgcgccactgcactccagcctgggcgacagggcgagactccatctcaacaacgacaacaacaacaacaacaacaaagaaccaacaacaacaacaacaaagaaccaccaccaccaccaccaacaacaacaacaaagaatcattctccattccccaaaccctaaagccaggaagggagtaagattaactttagaaattaataaatagagttttggatctctactctgccttttaggagctctgtggatgggacgttttacttctgactgtcattctctgtgttataaaatgagtataatatatctgtcacagatttgtgatgagagttaaaatggacactttatataatatacctggcagagtaacaggcacatagaatgaatgttgttacccctttggtccttagtcttatcatgaactagctatgtccttagccaaattacttaccactttttgatctttgttacctatttatctacactgaaaggatttagatttgtatatttctacttcagctaaaaaaaatctgtgattatgtaaaaaaccaggattacctttttcaaattggaatgcttggtcagctaagcttttattttgttgattaaagacatgcatatatcaacaggcattgtcttttgtgtccatgccacctaacttttctctaccagttttctctcattaaatgtttgtcagtcacatttggttgaaaccatgctgtttatccaacgtcatgacttaaagtaaaggacaatttacttaattgtcttaaataccagtcagagccatgtggaagctatgcaggtaaacaagcctctttttggggttgggttgtaggaaccctgccttaggtctaatgaaagtgatattcttgtgtattttcaggggtcatcctctgtccttaccttcagttccagtagctctttaaacctcatttgttctattgacgccaagttggttagaaggtcatagcgttggtttgtgtgtaggaggttagagggaggtcctggcagaggcttataatcaagtagaagcgtaaagccagagttcttgattgcaaagagtagaagtagcctctttgactcagggaacgacctcattggaaggggtgtcaggttgctgtcataacccccaacacaggtggatatctgtgtttaaaagacagtgaggaacaaggggaagaagctatgcagccaggacaggggatatcaccacccatgagcagcctggatcttggatgctgcctccacagggagcactggacccctgtgagcacctgcagtggttccctggccggagttcaggcagggcgggcatctggcctggctgccctgctgagcaggactcaacagcagtggagtccccaactgtggggcgaggattctgatgctgggcggtcgaggggaaatgtaagcccaacaacagatgaaggttttctatagatgggctcagcagttgttggaactgcttattatctgtgtatgtgtgtgtgcctgtgtgggcgtgcatgcatatgcctgcattttggagaggaagggatctgggcttttatcaaagtcctgaaaggtcttttgatccaggagttaagaaacactgtaataaagagatttaactgtgttcgaatctttgcttttccaccaggtggtgcaaatcttttatgatgttcatagaggttaaatcctcaaaaataagaataatttaaaattgtgtaattttctctaagagtttagtcctgtcacacaatgtgaagcattgttgatctgattcttgctttccttctgtctttaataaagatacaggtagatttacatatctttttaaatacgtaactatagatctaaattatctgtagatttttgaggctgtactactgttttgttttttgtagaaagaaactgcaatgactgggaaaaacagtaatatattcaatatattaattgtttcacacactctttgtgaaacacccaattctgataactttttgctcaatgcatataacttgtgtgatttaaatttttgaagataaaactcatgtcatgttggtcagtgtattaggccgttcttacattgctataaagcagtacctgagactgagtaatttctaagaaaagaggtttaattggcttatggttctccaggctgtacaggaagcatagcactggcatctgcctctggggaggcctcaggaagcttccaatcatggtggaaagtgaagagggagtaggcacatcgcatggcaaggtgggggagtgaagagtggtgggggggacgtgccacacacttttaaacaaccagatctcaggagaactcactctcacgaagacagtaccaagccatgaggggtgtgtccccatgatccagccccacctccagcattgggcattacaatacaacatgagatttgggttgggacaaatatccaaactatcagtcggtctgtttgtctctttttctcctctgagctgttgacagtttgctctctctcctgcatctttctgtttttagaaataaatagccagccgggcgcagtgtggctcacgcctgtaatcccagcactttgggaggctgaggcaggcggatcacaaggtcaggagatcgagaccatcctggctaacatggtgaaaccctgtctctactaaaaattcaaaaacactagccgggcatggtggtgggcacctgtagtcccagttacttgggaggctgaggcaggagaatggcgtgaacccgggaggcggagcttgtagtgagccgagatcccgccattgcactccagcctgggcgacagagcgagactccgtctaaaaaaaaaaaaaaaaaaaaaaaagccggagaaagtgggttgctaatatgggctactgtatacattacattctagcttacatgtttttttttttttccttccccccaacttaagaatttggtgtagacatccttcatgtccttcaggtcattacatgcagattttaatttgttaatttgttacatcatctctagtaagaatttacctaatttagttatttctttgatagaacaaattaattgtttgtttgtttgttttgttgagacagagtctcgctctctcgcccaggctggagttcagttgcttgatcttggctcactgcaacctccgcctcccaggttcaagcaattcttctgcctcagccaagtagctggaattaaagttccatgccaccatgcctggctaattttttgtatttttagtagaaacgggttttcaccgtgttagctaggatggtcttgatctcctgaccttgtgatccgcccgccttggcctcccaaagtgctggggttataggtgtgagtcaccgtgcctggccagttttgttttttatttcttttcagttttgcttttatttttgccattacaaacgactgcagtaaacatccttacatcctttgtacatagattgtatttgttaatattcgtacgcttttttttttttttttttgagacggagtctcgctctgtcgccaaggcgggactgcggactgcagtggcgcaatctcggctcactgcaagctccgcttcccgggttcacgccattctcctgcctcagcctcccgagtagctgggactacaggcgcccgccaccgcgcctggctaattttttttgtattttcagtagagacggggtttcaccttgttagccaggatggtctccatctcctgacctcatgatccacccgcctcggcctcccaaagtgctgggattacaggcgtgagccaccgcacccggccgcttttttttttttttttgagacagagtctccctctgttgcccaggctggagtgcagtggcccgatcacagctcactgcagcctcaggtctcccagactactgagattataggtgtgtgcccccataccctatcttatgcttttatttttataatatatattatttacagtgattctctcaatctatattttagttctattagtggtgcctttattatacagaattttaaaacttttttgtagttgaatccgtcaacatgttttctattctaacctgcaattatacaaatagcccttctaaagtttcttctaatatttctaatagaaataggtttagtttatcaaatattttattgattccaaaatatgtagttttttaaaaaactttcatatatctgaagttatttcttataatagtgtatcataacttagctaatagtactttttctttcagtgatacataaaataatggtttctgttataattgatgttttgaattcagcgtaattggtatttcttgcacttagatctttaatccatttgtacttatttttgtgtatgtcatgaggttatggagtccatttttccccctacaaataaagccgatttctcagtgttgtttactaaatgaagaatcttttctcgcagaattgccatgtagtaacttctgatatatactttgactcctggcctgatccactaatttatttgttcctgtgctatactcttttgacaacagtggtttttagttctaaattccaaaagggtaagtttgccttcactgtacttttttattttaaacatttcttaatgtttacttgaaataccctaacttttgattctcaagtctctgtttttacctactctctttacttacaaaatgagttgatccaggcaggcattttatgtgatatttatatgcgcatgagtgctcatgtaatggcatttctcctattcccactttctaagtgaaaatttttttttttttttttttttttggagacagagtcttactctgtcacccaggctggagtgcaatggcatgatctcagttcactgcaacctccacctcccaggttcaagtgattctcctgcctcagcctcccaaatagctgggattacaggacaggctcctgccaccacagccagctaatttttgtatttttggtagagccggggttttaccatgttggtcaggctggtctcaaactcctgacctcaggtgatccacctgcctcagcctcccaaagtgctgggattacaggcgtgaggcaccgtgcccagccgtgtaatttgttttttaagaaggttcatgattttcctggatttgttcttagctcggtggcactggtggcttcagcatcaagtgcagaagttctcgttgaaccgacgctgatcagcgtccccttgctgtgttgttcgtggcacttctgtaatttatgtctagagactgtctgggttttgtgggatttctagcaattttagtgtctctgtcctctgatgccagtggcactccagtcattatgataaaagtttccacagagttttgcttcagagtaatctgaggggtggatctcgggtgtggaggagtatatggagaattgttgaagatggggagcgtgtgaatgtgtggttattctgggctctctttttaaatatacattgggaatgtttatgtttttcaaggccctgcatgtgtaaatgatgctttctatggggtgagcctgcccgtgtggagaccactatcttaaagccgtgaatggcacggcgcaaatgggtttctgggctcctgaataagaattctaagtgaatctccaccacccccatagaacgctgttttaatcaattattgggttctgtgttaatgttttactattttagggatcaatttatggacttttatggactggtcaagatagcaaccaaatgtataatttttcctaagggggaaaatatattctaatttctaaacaataatattttcagttgaattttaaaacagcagttttttttgttggcaccaaagggtaccttgggaagctttcctttccccacccctcaccatcctatcgccctgttaacgcccctcaaagcagtcaaagccagcgcacctgtgtacagctgagggcttgctgtcccccactcaaagccagtgcacctgtgtacagctgagggctcactgtgcccccctcaaagccagtgcacctgtgtacagctgagggctcactgtgcccccctcaaagccagcgcacctgtttacagctgagggcttgctgtcctccactaaaagccagtgcacctgtgtgcagctgagggctttctgtcccccattcaaagccagcacacctgtgtacagctgaggacttgctgtcccccactcaaagccagtgcacctgtgtacagctgagggctcactgtgcccccctcaaagccagcgcacctgtgtacagctgagggcttgctgtgcatgtgtgtttgcagtgaagtgcctcagccagttcctccttccttctccaagctgactggacccacatccctcctgtgtagacattttggagcctccgctgtgatgcttgcctgtaacccatcaatagagctaagtcaaatttgctttttaagaaggttcatgtttattttctggttctagggcttctgtggctatttagatgagttgtttagaacactagactaatgagatcaccagggtgatgaaacattgtgtggatcttggctttcttctagcacagtcagctctgttcctaaccctcgccatctactgggcatttttattcatatgcttgatcagaagttggcttgggtgaatgtgtgtgtggatccaaatacatccaccgttcatctcagagaagcagctcatcacctgggtcctgggagggtgccctgtattgctcactggatggagaggcagggcagctttatttcacaccagctattggcttctgatacgttagattcacctgaaaggagggtggagcatggtggggtttatgttaacatgccagggcagatgtatttgtttgtatatttcctttaacatctcatgagttgggcacatttttaaaggtgctgttagggtagaaaggaggcccaggaccactgtgctgccagctttagaatacattgtgaatggtgtctcctgggattgtgcagtgagcacagccttgagatagcccattaatttcttcagtaaatgcatgttgagttaatgcttggtaatgaagtgtaccctgctatgttagggaatgtttgttagaggtgattgattgtaacccactggtgccatggaagatatgttagcatggtgattttagcacataaatgcctctggtgacaaagctcaaacctcatttattaaatgacaattaaaattgccttataattttaacaatgtatgcctgttaaaatgttctccatcacatctgcagtggtgaatacgtgcctaataaaaatttgataataacgaatagtcccaaatatttggaagccaataattgtctttatgctttataattatctttaaaattctacccatttgaaatccacctgtttatatttctaatacttgaaatttttttgtgaatgaatgtgagtctgaaaagaatgttaagtatcttctttgaaatgtcaagtgaagagatgagattcatgtaatttaaatcacccacaattcactgggagaaatttttaaataattttagcaatataaaaactaatgagaaaaattacaccttgattgttttaagtatctgaattacctttgtagattttatagactttatgttcaaaaaataattttatgtgtttacaaacactttgatattctaaacttgagtagcagtctaaaaattaaccatatggtaatattttgtctgtgttattagggataatggccaacatttattgagttcttactgcatttctggacctgttcaactctcattaccacatttaaccctgcaaaaaaagtcttgtggcacactgctatgttcattgtccccagttcagaaagaggaaagctaaggcctatagaaatgagaagctgcagcccccctagaaagtgaatgtcagagcagacactggagttagaatcctgggttgctggccaggtgcggtggctcacgcctgtaatctcatcactttgggaggctgaggtgggtggatcacgaggtcaagagatcgagacaatcctggccaacatggtaaaaccctgtctttaccaaaaatacaaaaattagccaggcatggtggcgcgtgcctgtagtcccagctactcggaaggctgaggcaggagaatcacttgaacccaggaggtggaggttgcagtgagctgagatcgtgccactgcacttcagcctggtgacagagcgagactctgtctcaaaattaaaaaaaagaattctgggtggcctcatccaaagctttacacttcttcttactgccactacactgtgtgtgtgtgtgtgtgtgtgtgtgtgtgtttgagatggagtctcgctctgtagcacaggctggagtgcagtggcgtgaccttggctcactgcaatcttcgcctcctgggttcaagcaattcccctgcctcagcctcccgagtaactgggattacaggtgtccaccaccacgcctggctaatttttgtatttttagtagagacggggtttcaccatgttggccaggctggtctggaactcctgaccttgtgatctaccagcctcagcctcccaaagtgctgggattacaggtgtgagccaccgcgcccagctgaccacattgttaaaggcataaaatactattccaatacttttagcagtaatttgtacattaaataagtgacataattctaaatgcctacaaatatgtgtaagtcttgtaacgttttgggaccatgctagtgtcaagtgtagcccttgtacagtgatgtacatgagcattaaaagaccatgcagttttaaacgactggagacattttgtcagtgtcttcacagaggaatcaggaagttggacggttggccagtgggtgaaatggtgttttcggaaggcataactgggcgaagggaggaagctgatttgcctgcatgtgctgctacctcgtggtccccacggtgctgggaggggagacaggttcatggtagccctgggcagcctaggtcacatcgcgggtctcacagccactggagcagaggtgctactcagaagcaggtgttctgccacaaacacatcttctttccgtcctgtcacactgctgattgctgttaagagtttggcctttccctcactctgcttttggagtgggattggctgagggtgtggatgtttccttcggttttcacccttacgtttcttaggcacttctaagggcacctttttcctgtggatgcacccggtaggtagctttttaattcagtggtatttccatcatgagagatcgcttgcagtcatggaaccctcttagtttcctcgataagctggtcaggaaagaatttcagacctttgttttgggttcattgcacttgtcttttcagagcagtaccctccttgcttttcacatctgagtactgagcagtttgcgtggttctggcacgtgcctagaggccctctgaatttgtaagtgagctgtaggctcaactgttgctgttccattttgcaggtaggatgcatctggactcttctgtttttcactagctttcatgaccatgggcttttcagcttcttacaagatttctgttaagcgggcatctccatttcagccagttctttgtcccagcttcaaaagtcataaattttagctgccattgggcccagtgataagagtaggtgggccatggtgaagcgtaaggccttgggaaggcacttgtgcgccgtccgcggcagcagggtatgtcaaggctggagagtggacaccttcttgctcctttagataagggaaagaacatttgcttgaataaaaaattagggtcatatttttctgaactttgtcacctagacattaaatgataatttagaattgagaagagatggcatacatttccaatactctacctctctccagcaattcttggccttccaaccaatatgcccatcatcccaccccaaaatcttaccttttttaaaatttattttttagtaatcaagattctacttgtgagtcacagagtatttaaaaacatgcacaatctgttgttcatggtacctggatacactctctaattgaaaattcaacatttaagggcgaatacagaatgcttgtttttaaaaatacctttccagtttaaagaaccatagaggctaaaacgagattgtctcctttttagtattactcacatcaaaattattcaatctttgtgaaactgagatacaggcttgttttgtgaccctttctttccagttactggctcacttttgagcaaaatggtgaagctgttctttctgcttggggacagttttgtattattttctctctcctagtctgcacaattcaaaccaaaatcaagcctcagagtgtttatgtggtatctactgggcacactggctgcttaatgcattttaatatgatgttagtaaaagaaaatgtggagatagttactcattgggcattatgatgagattttagattccaaagtctagccaactctggcttacccaaaggaaaataaaagaggtgagaatacagcaaaaggtgggtgtgggcagggggaagagtatggggtgattctcccaagcctttataaccagaacatttattatggggtgtgggttaccaaataacaggaacacccttgaaacaggtgctaatatgttgaaatctttttggtacacagaggcttgagattaatgacatttcttatgtcaggattcacctgtttttaaggtgcaggtagtgttggcaggccccctcgtgagcagccttcctctgcagggttctgaccctctctcttcctctctctaagatttggctactgagtgggtcagcacctggagaaaggggatctgagtggtgttttaacccctcagggagcttgtggcgtgacagcactggctttctgtgttcggcagagtgtgtgagaccttgcgcgaggaggtgaccatcatgccagttgctctgcctgatcggatgtgtctctttaaatgactatacgatattaaagttaaaggagggctcttagatatttagattttgtccagttctctgttcacaaatcaacacaaataatcaaagaaggtatttttctgtctgcttgctcagataataaatgctatttatatgtagaaagaaagatggagggatgatttacagatgactcaaacttatttaaaaacaaatttgtggatttccactaataagcttatactttcatggcacacttgagtagtttttattaaacttcctttttctcgtatgctctatttgggatttcaacaatttttattatgtaatgagggaatatttttgttgtgaaatttttcttcctttttgatgtaactgttagaatttgatgaactggtttgtaacattaaaatgaagatgaaaaattacaaggtattcaccaaatgaatgtcactttctggggtgttgctggcgatgatatgggctctctggagcatatatatccggaggtgctcagagtctgcccctgttgctcctaagaaagacaaagcctcctatctgatcagctttgtccatgactctctaacttgttcttacactgacaccattaactgccctaaatgccaggcacctactccgccagcccagtggaaacaagcctgtattagtaaaccgcgattgggtttagaattgggactgttccacatgctctctacttgccagataagccttagcatcctcatctgtgaataacgagagttcatgcctgccacacatgggcactgtaaaaattaaacaccatcggccgggtgcgctggctcacgcctgtaatcccagcactttggaaggccaagacgggcggatcatgaggtcaggagatcgagaccatcctggctaacacggtgaaaccctgtctctactaaaaattcaaaaacactagccgggcgtagtggcaggcacctgtagtcccagttactcgggaggctgaggcaggagaatggcgtgaacccgggaggcggagcttgcagtgagccgagatcacgccactacactccagcctgggcgacagagagagactccgtctcaaaaaaaaaaaaataaaaaaattaaacaccatgggtccagctgggcgactcccatcctctcctcaagaatcataaacatctttctttgctttcaagattagctctcgcagtcgggccctgtcaggcccctccagacagtctcactgtagatgcccttgctttctagcccttggcctggtgggccatttgctcatcctaagtaggcctttcctgcttccaagtctttgctcctacttttggggggtcttaatctccacctattgaaatgttctattgatgaaggtagaagtggtgggaaatggtatcggggaaccacaggccaggcgctaggcatgctcattgctactgggttggccgttgcttccaggcctgttcagtggacgctgagtgcatgtgtgtagcagatacacaagtgcatatatatatatatatatatatatatatatgtatattaaaataaatatcaggacgacagggtttttacttcacctcttggatcttatacttctgtctcctttctctcacagcgagaatgcttgtactcctggaatggcagaattacttacttgctttgatatacacagcagttcagactactaatgccagcaccaataccaccatttttcttttgtcattagtttatgtcccactacggatataggattaatgtatttcactgtcagtcattcttctctgtgtggttatgctaccaccttataaatgcagggttcatttgtcacattttatttttgatttttaggagtttttatttaaaatttttgttttacaatcacagaaaatatttacatgactccaaagtagcatctagaaaacaagatactgtcaaaaaagtccatcttctatctctgccttctcccctccagtaagtaaccatttaagaatattatgttttatctttccatttttgcctttactatgtgtgtgtatacatagtgtatgtatgtaaatactatataattagtgcattttattatttcaccctaattaaatataatatatagataaaatataaatagatacaggtatctttacatgttaacatgcagtctaaccattttttttgtttctcgggaagggaggtggtggggagggtggtacatgaatgggtattactaaaattactttattaggtgggctgaagtttttatttgtttttgtttctttttatataaatctttataaacgcttattcactgtgctttttacttttagtcagcttctctttccatatttacacttgtccataattatacttcagcaatcttgggagagaacctctgtggctttctgaaaaattattcttttatataaacttgcccagatgagttataggaggaactgttctctccagtttcaaaatgagtttacatactgtgtggggggactttccaactgaggatagcatgtcgtggtgtgtggttagccaatacagagatctaagaggctgcacggcttttgctaacttgtgaaacatgcctttaattttaaaagcagtctttggaaattctacttccatttgtacatggctttagatgaataaagacatgtcttcttacggaatcaagaccacggcatatgtatacaggcagatgatgaatgtattgattcttttacttcaccttatatttactcaacaaggagacatctaaataatgaaatgcatcttactggaaccacccaaagtaagccacttagagggccacctagagatagctttgtagagcatgatggaatatctgagggtttttattaatacattttaactttcttaaacatcatttaaaaaattaatgttctaaatatacctccaatagtacatgaaactgttacaatagtgtccgaaccttatgtgtgtaaagttatttggtcagtttggaaaattttgtagtatttgtgaagaagggtacaagagctaacatacattgagtatctactctgtgtctggtgtgttccatcagtcatctctttcaggaattaaaactatcttatgaggcagatagcactatttaattttttgttatgaaagaggctgagacttggagagttggagtctcttgccttgtatcatgtacctagtaaatggccaaactaggaattgagcctcagttttgtctgaaaacaaattcttactgttcccagtgtaccttgttaccacaatttactttcttttcttgtcttaaaatgaagtctgaggttctaatttcaccagattaagactaggtaaccatctgtaaactagaaattttaattgataaaacaatcattcctgtgctttaaaaatgcaggctaaaatggttaggaaatgctatcttttggagacttgtagcaaatgctcagaaagtaatttcttggggttgggcggggattctcatcacagtttttaaaataatttgattgtcattattgcaaagctgtgtagttcctgtaattggagtatttgcctttacacttcacagctataattttcttcaagatcggaagactttctgagcagctgctttaatttacatctgttttggggaaaatataacacatgtccatagtatatggtgttcattataaagatttgcagtagacaaggtataaaattattataaatatttcccaatatgctgttcatgtgtgtgtgtgtgtctgtgtgtgtgtagggatattttgtggcatatatagccaaattttatttgctgttctttaaacattgagatgtcctgactgtcaatttgtggtttgtttaaaagaagagtgggatttttttctagtcaagttagaagataaagtttaccaaggatacaaataagagaagcagtatagaaatgtattataagccatggaaaattattataagaaaacaccattaattataaattaactaaaattttaggatatgacaaaaaaaacataaataggtacctgtgagtcttaaggggcaaaagactaatagaaatattctgaggccctgtggagatggtgtgggggagttctgagtccatagccctaggtaagggcagaattgattccatgtcttgactgaaaccaaagtggaggtgggatagggggatgctctgttgggggctgtgtactgcttaagctaggatatatttggagagaaaagaaaacattaattttcctttctcaatcatagcaaaccccttcccccacaaaacagaaattgacaagagaaccctagagataaatctgccaagctctgttatatggtggctttcagcccttttccagaataaataggatgaacatcttggtacataacgtatcttttacttaaggtcattatttttttcaataaagaatatgacaaataggataacagaaagggaacgtacatttgatccttctccatgtggaaatgtgagctacaacttgttagtatcagaaacgtaggttatctttcccttctccatttcaaatagtctgtcatatttgaaagctaatagctttcaggctcgcattgcccataactctcagcaacatataaaacatgcccactctgtgtttatttactttaatctgtcaattgtgatgccaactcaagatatttgggattattacatttgattcactcatttgcctgatgactctgcaaataattggattgataccaaggtttatgctgtggaaactatggtatgaaaaacagtatatagtctataggtatatttacaagaaaacatacactatatgtttgtttcagaaaatttggaagatccacatacagaagttatagtcactcataactgtaccatccagaaataactactattaacaatttgatatctttcatttatatgtatacatatggatatatatgcatatacctacatatgtatctagactatatatacatgcacatttacacacatatacatatgaatatataactacacatgaattttaaagcacagttggcatcatacagtatatcttttgggatgctccccttaatattatctattactagtatttttcggtgtcattaaaattccctataaacatcagtttcaaatgactgcataatattgtatcacatgacttcaccataatgaactttttttgctgttattagtttgtttccattttatttggttatcgtggaacctcttttttcacttttctgattaacatacatgatttcatgacatagcatattatttgatgttgtgcttcttgctcattaaaaaatctgagcatttgagaagaacctaattcagggttgtgatattcatttgtatgtttatcctgaaatacttctaaggaaaaaattatctacatgttaaatacccattttagaaagttacctttgttagcttcagtttgatctactttcattcagtttctcgtgagatgtagattgtcttctcgctaggtagtcagacttctgtgcagaacaagatgggcaagttcctgctcttgtagagtttactgcctagtgggaaagtataatactaagtaattaatacattattatagaattatacttgcaataaacattacgaacctaaagttatagtatgtttttagaatgtatacttgaggaatctaaacaggaaagaaaattcttcagttaaaatcatgattttcagtggctcacgcctgtaatcccatcactttgggaggccaaggcggacgaatcacgaggtcaggagatcgagaccatcctggccaacacggtgaaactccgtctctactaaaaatgcaaaaattagctgggcatggtggcacgtgcctgtaatcccagctactcgggaggctgaggcaggagaaccccttgaactaggaagtcagaggttgcagtgagctgagatccgccactgcactccagcctggcaacagagtgagactccgtctcaaaaaaaaaataaaaagtcattattttgttatctttttttgtttctatttaaaatagaaaaccacaatgcctcatctgaccagttggcacaaaccggaggatacaatatggacatggtatttatatgtttttctctcaccaatatccagtttacaggagaagaaatctttaatccttttggttggatatttgatttctgagctggaatttttttctaagctagcaaatttcaggatacaaattgagttatttctgccagcatcctggattggaatcatgagatttcatcactatgattaaaagagcctttccctgctcacaaagcaagttaaacaaaatcagcaagatgatggagataaacgtgcttggtccataaagcccaagacaagtgttctattaagctagtgctgttataaagtgagcacagggagatatggaaggctagtgtgcatcattttggggaactgtactatatgtaatattcgtgcaaaagatgagctgttatttgctccttttattttatatgcgcttgctcagcaccttaggtagcagaagtcatatattggattaaatggctctaggcacttgttctaggggccctagttttatccttgatctggtaaaaggctggaatagagaaactaaggttaaaaaaaaagattaatgaagaagcggaagtgaagagtctggagcagaaaataagtttaaatgtctttgggatttatttggaggtgaaataggatcaataaattactagtgtgttactgggcaatgtgaggtttgaagatgaaggaagtgtcttgaatgtacttactatgttgtatagagccttagactcgaggtagtatgatgttcttaaggaaaagtggaaagattaatattaataataataatctgtgtttccttcagtcgaattcatagcagttaatgtcttgccacatttgccttatctctgtatatgtacttttttgttcatttatttgttgtacatttgaaagtgtattaaagttatcaatttttgtaagttgaatttgaatatgccactttactgaattcttattcttatcgattcagttgattttggggggatttgtctaattagattatcatatcagctgcaaataaaatgattttgtttctttacaatttttatgcatcttttaaattttttgtaattttattacattgtccaggactctagtgaagtatcaaatactatcattggtaaaaacgcgactttaatggcaatgcttctggtagttcacagttaaatacaagttagcttctcagacattgtttacatagttttggaaattattttaatcataactttttgagtattttgcaaataatggtatggttttttgtttttgtttttttttttcaaacagaatcttgctttgttacccaggctggagtgcagtggcatgatcttggctcactgcagtttctgcctcctgagctcaagtgatcctcccatcttagcctcccaagtagctgggactacaggtgtgcagcaccacacctgactaattttttaaatcttttttggtagagatggtgtttcaccatgttgcctagtctgggtatggaatttttatcagtgttttggtttaacatgtctgtataatgaattgtaagcatagatttttctgatgacaaagctatccttatattctggagctctaacttggtgatgatattttagtctttttatatacttgagtacaactgtattttaaattaatgaatatagatgctattgtgactgatgaaataacaggtgcatttaaaagtattgcctgtatttttattattgatatgtttgctaaatcaacagatagtaaaaatataactactgtcacctggaggactatagcattgtttgttggaaagaagacctcatgcttgaaatggttggcagtcagtaatctagatacttagaaaaaatgcatattttcctccttaccccttttttggtagttttgcatgtgagtatatggtatatggtctagagatgatcttgatattaatctgcagattccgcaatctcagaaataagaggaacttgaagaggttacctccattgttctgttttctgtttatcaaagactctcagagatgatgactgtgttatagtctcatgaagtaactcattctaaagcttcaccatcagttggtatctcctaactttgatgttctggggtattctagttagtaggctcttctgatatgctcaggattggttaagaggcttctttcttgaatatttgatattataactctttctaaatagattagaatgatgaatataaaatttaataattatttggacaatgggaggggagtcagtagaatcctttctaatagtaatacagtaactgtaaaatgtgaagaatagtgtgcatcattttggggaagaacgtttagagtagcactcggcatgtagtttgcactcattaaagattacttcttattgtctaacaaatactcaaatattttattccccatagccttttgacttgcatgagtaattgaaaaaaagaaaaccaattgtggctttcttgctaaacagatgtttagagtacataagtccctgaggccagcatgttgagttgtcacatcgctttagtgtgagaaggaaggcatctaggtaatcagattgattctgattgtttcaaaccaaaatgctgctgtcatgtaagggggctttggtctgagagtgtttgtcagtgtcaatattgccagtgatttggaaaaaaaaaaagtgtaaaatttatatatactgcatttataaagtgcttagtggtaattctgcaaatgttagtgttttgaaaatagcattcatccagtcatgtgtttagagaaatagaaattgtcaaaaggaagttaaaggggttgatgatgtcatttacattttagttccactcccaagttggctggctcttttgaagttgactcttaaaatcctagagtcattgatcttatagctgaaaggaacctggagagcattgattcaaaatatgtttgttgttgttgttggaacaaatattgcgttagatattagagatataaaaatgaataaaatatggctgttgcccttaaagtctagcctaaaagatagacaacctgaacaaatactttactttggggtagtaagttctggaatggaagctttaggcagggggtagattttccatgtttcctaggtgtggctccagcagcttgggcaagcagcccaggcgcaaacagctccgtactggtgatggtattgctggaactagactcctggtctcttgatacaagtcacgtggggctgacctagtaagctttgcaaaagaaaattttaccaagcatgcatgtatgcatgtaaatatctatgtaagtatgtacatatgtattgatttagtaccttgctctgtgtagttaacagctgctttatgtgagacgcatagacatagacattcatgcttacttttttttttttcttttttggagacagagtgtcactctgtttgttgcccaggctggagtgcagtgacacaatcttggctcactgcaacctccacctcccaggttcaagcaattctcctgccttagcctcccaaatagctgaacattatattgttcaccagtagtatcttgttccaggctatttcaattggaattattattattagaccatcacatgtttataaccacttacagaatttgataccactgtacctagctaatttttgtatttttagaagagatggggttttgccatgttggccaggctggtctccaactcctgacctcaagtgatccacctgcctcggcctcccaaagtgctggaattacaggcgtgagccactgcgcccagccaacattcatactttcttatcctacattttttggggggcggggtacagaggttgggtggggattcccgctaaacatttagaaccaacagcaatgaataatttgagtaatttgtaatgtgattgtgttattgtgttatctagaacactatactctaaccctaaacctcaagataaaggcttagattcctttcacgttactgtgtccatgatcttgactgcttcttctgccacatccctccggtggtgctccctgcattgccacctacctggggttctcctcgcctactgtgctgtttctaaccatcatgcttttccctgaatctcttgagtctttttctgctgtggactgaaacttgatcctgagattcacctctagtccctctgggcagcctcctggaatactcagctgggatgggttggggctgcttgaggtacagctcccactgcctctgagtggccctccatgaaaatgcctcatgtctctgtgtccctaaactgtagggtacgtagcacattggtagatacttagtaaatgttttgctgaagaattcaagtttttaaattgcccttttcattggacaactaaaaaatgtgtatgcatatacatgtatacatatatatgtactttttaatgttctaattctcttgtattgtttttcatgtaaacataactgttttggatttcaattgatttcgaatacatgttttggagaatattaaacccaccacgtttatattgttcaccagtagtatcttgttccaagctatttcaattggaattctttttattagaccatcacatgtttataaccacttacagaatttgatactttggtgcatcccatggattaaaacatactttaaaatctgacatctatatattaaacagttattgtaagcatgattttgttaatggggatttacatctgctttccaatctctgtagccatatgaagtgtaactagccattatatttgcttctttaaatatatatctgggaaataaaacttcagacaattacagtataaactaaacctgataacaattgaataatgaatgataatctgttcagtttttccctcctgtagaattagatagttgatgatttggtttaaaagtaaaaatattttttaaaaccttgacttttctaaataaatgagaatctgcaaaagaaacaatgcatattaagtactgattgtttcttgactgtcataatggatggcctctctctctctgtcgtttttaagaaagccaaattacaggatagttaatatcttaaaggactcttatctcaaatactaggatgctgagacataaagggggcttgctgagatactgtgtcagtaaatgaaactcagcaaatcataatcatctttggattctcagtcatgttatgtaagtggtcacacagatggatttttaactctgattttcctaagttgctttcctggccattaaacggttgggaaggtactctcggatgcagaataagaagaatgcattactgtgactttaagaaggaaattaagtagggagggaaaatggggatgttgtgactgctgacatttgtggcctcctttcatttgcgtaagagatggactggcttctctgtggctgcggttgccatggagaggtagtgggggaggacttccaggaggcagcccatgagcgagagtctgccttagagctgctcctagatgtgacgtgaaggggcagggagctcaggtgtgccgcggcggcacagataatggggatggccgacctgtcatggctggtaacgtgactgtgcacatacccctgggtgtgacggatgtgtttgtgcaagtgcctgtggattctctatgtgaaatgaaaggattgtaatgttgtgtgtgttcccaccctttgatgcgatttcctacacttgatgtgatttgatgaaaagagtttaaacaattaaaccaaatgtacaccctggttataaaaagagactaacttcaattggcacgtttgcatataggtaaatgacatcaatagcaggtcaaataaattactgtgggactaatacactcagaaaaatctaatatggtaggttaaactgtaaccagaaatgactgtgttactaacctggtatcattgttatacagatattacagagtggtgtagctggctaatagaagaaaaacgaaacaatgaaagttagaagatttttttctgcataaaatgtagaagaaaatcacttgcatgttttgtagataaaatgcttatatctgaagagatgaattttgagaattttgatcattgttatagtatattttattggaaatacttttatatcaaatagaaaattgctaacaagtttatagtatgatcattttatggcttttgttgacataagtggtaaattgaatatgaaaattatatttgtcttttgttttcttgtggatatcattgtggatattgcctttgtttaaaaataaatgtgattggtaattttaacttaaacaccaagctacagtttaaaaaaaatttctaagtaaaaatctatttctcgtgaggaaatcctatgatgtattaaatttaccaaatataaagaaacttacttgacttcttagttttctgatgaaatttgaatgagagccaagtattaatattgttttatagtagagtcaaaaatagtttaggtgaaataatacattgtcagtttgttagtcattgactgcttaatgcatattacaacttatttaaagaataactagttgcctaagtcaaatctgtgaaatgaatgccaaatcttttctttttaaaagtatagtgttaggtaaaatctaggtgatggtgttacatagtgccactgaacaaatttgtagaatgttcagatttacttagaatttacttagaaattattacattaagttaaaatatttcagaaattacttaatacatgttagagattatatatataaaactattcctttaatgataaccttatttggcttcctaaaccttccatttcttttttatttggaatattgtatagtaagtctaaatttctttaccttttgagtacgatatttaaatgtataaacatttatgagttattagatacagatattgatgtaattaaacatttcattatttttcttaatttttaaattaattctaagttacatctattcagcaaggaagccaaaattggttttctttttttcaattgctcgtgcaagtcaaaaggctatggggaataaaatatttgagtatttgttagacaataagaagtaatctttaatgagtgccagctacatgccgagtgctactctaaatattcttattcttgttttttctgaatctcatgcaactttgtgaggtaggtaccattttctcacccattacagatgaggtaactgaggtttggcttataagtaacttgctcaatgtcataaagataagaaagggatagaccaggatttgaactgagagaagtttctaacacccacacgttactgtcattttgcgtattgaaagtatagtgtagtctggcatagtgggaaaagctttctgttcaggtgtcctgggatggaatcccagctttccttgtcttagctgagtgaccgaagttacgcctcttcatgccttagttttctcacaggtacttactagaagaatacatgtgagtactttcattcttgtgctaaatgtgaagactcccctgttagtagtagttattgctaacacgtatcattattcatgatttaaaaatataatatgctaatctaaattatgttttactctttttggaaatagttaatagaataaaaggaggaataaagaggatatgattaaagtaatattgaatgcttttcagttatcattaaaatatttattgatttctagcagagtttttcaacctcagctccatttatgatttggcctagataattctttgtcttgggcactgtcctgtgtgtcacgggatatttgacagactccctggcctgtacccactagatgccaattgcagtcttcctccctcagttgtaaaccaagatgtctccaggcatttccaaatgccttttggggggcaaaatcaccccaacctaaaaaccactagtggagttatatggcattaaacaagattgggatgaggacattggtggaaagtggggagggaggagctggctcatgttggcaggtgtggctgcacgtggaaggtgggttggaaggcagggaagggcaggagcagatgccatgcagaggactgcaaagaggcagaggcagatgtcttggggagagaaggggcttggatctgggtggctgaagtgggcagcttggagaggtttttggaggaagaatcagaggacttggggattgccagagtattacacatttgacagcacttaataaagaacagtgaaggttttgagaggtggtcactgggcagtctgcaagactgactctccaaccaagtgaaacctcttgtgtaccagcttcaccatgcatgagattcacatatgtttcttagtggtaaaaatcattgcatgtcctagaccttcctgagcactgcaaaccttgggtcttaagtttgggactgccaagtgactcccatatttaaaacttccatgatttgccttggtttgaagattaggtgtgatcttggaaaatgagagacctcagattttggcaaggaacatgccttggtataatatataatattccctcttcctggattcttgccaggttgcttgctcctacccaggtttctggccttgaccctagagctttcttctctaatgcatctacttgtaaactaaataattcattggacaccaaataaattttttttaatgtattgtgactcagtgtttttgagtcacaattttgaagtttacggatttctggaagcaatgcatccctatagtgggaacggcatatgtatcataaattttgtaaatggtaatgactaaagtattccagactctttctgtgttacaacagtcagggaaaccagatgaagtttctttctttctcagcaaataacctcagcaggctgttttgggagctatttcaataaggtcatcacaagcagaacttaatgatcgtttgttaacagcagtgggtgacatcaccacgaattgtaattgcaacttaaatgatagtattataaggtactttttagtgttcattatttcagtagtggtgataaaacctttttttattctgcaaaattatgctggtgaaattgtatgtatctgcatgtgtctgtctgtgatttctaccatagtaaaatgaaacttcagttttgagccagaactgagaactcttggttcttaggtctagcccaagagaagacaaaagggaagagaagggagaggctacctttcctgacagcttcatggagttttcattttttgtgtgtcccctccccacgccgtacacacacatattcccattacacttctgttgatcagttagatcagttagtggctgctctgtttttccctgcaaaaggaatttttcaatttgattttccatcccgatttcccagtgggccttcatgaagcagtcaagacattttcagtatgttctttccctccaacagatgtgaatccagccatattgagcatatgctgtgtttctagggctgtacacatactgtggggttggctcttctatcttcaggttgctaaaacatctcagatggaaaagagattcacacataatagataatttaaggcccaaaaaagacctaaatcatggtggacaaattggatgcaactaaatgccaaattgtatgaactaggtaaaggtctgtgcaatgtatagggaggcaagaaactgttactttcctggaatcattagtaggtgtttctgagagttggagttaaagcatgtcatgaaaaactggtgagttgtggataaatgttgggacctgggataggagaataactatgatagattctgatcatggcgtttgatattagagggtgatgcagacatgaaacaagcaaggtcacacacatacatttaacacaagaagaggtggggtgctgttggtgcacactggagtgctcccagttagtgtcaggagagagcttcaagagcatgtgacattgatgctcacacatgaaagatgagaagttgccaggtcaggcaggacgcccttttgatacacacatagaatacagggatgtggcatagagtatcactgtaccagcaacttcccgttctggaggcaaatctgcctgggttcaagctggttcttcccctgacgggctctgtgaattcgcttctgtgtgccactgtttgctcctctggaaaatggaggtgaagggtggtctcctcccaggtaggttttgtgtgtgtgtgtgtgtgtgtgcgtgtgtgtgtgtgtgtgtgtgcattgaatggttgttacaatataataactgaaaagagctctaagtccagttttattttagtgtgtttttgctgtgatttgcctaacttggtttctatgatgcagttagcttctgcaaatggcagagctgataaacgattagaaagctatttttggtttgactggttcagatgtagatgtgaagtcctcagaacagcactcagcacacaggaagctgttactgttggatatcccccagtagggcctgaagtgcgagggtgcggctgtgagtaaggagaatgagggcttcccaggcaggtgtaaaggaacattggggaggtgattctcatgagaaggaacaccatgagcttgaggcagcagtgggggaaggcaagctgtgtgctgtgggcatccctaaaaggcagtgttgttcattcaagaggagaattttcaaggggagcgattcttacgctggatgggaacagatagcttgtgcgctgtttccattggttttaagagctgtgtgcgtgtgtgttaattctgtgttttgctgtgtattttacatgtatcttagggagtttaagaaatagttaatcttgttaagtatccaaataattgcatgatgaccatccctcttgtgctaccacataataactgaaaagagctttaagtcttaagttcagttatatttctgtgtgttttcaccatgatttgtctaacttagtctctttgttgcagttagcttcttaggcaaatggcagcagctgataaatgatcagaaagctatttttggtttgactagttcagatccatacatatgaagttacaagcttaattactgttatttttggccagagtccttggaagtgttggacttagccaagtacttcctttgtgaaagaaatgacacttgttcattgtttgaattgtgatgatttctcaaagcatatgaattttttgactgcttagattatgaagatttagatggggaattttgtgcattataaattttatcataaataaatatttgttcggaaccactttaatgtatgatgggcccaatattatcattgtcttctctgagctatttcttcaaggtaacagtgaaaacgaataactagaaggcattatgtttatatataatgggatggtggatatatttcaaacaaagacactgtgtgtgtgtgtgtgtatatatatatacacacacatacactttattatatatacatacatacaaaatatatgtactgttatttagttaggctaatggctttgaacaacaataataatagtaatgtggattccagataatttattttcctgaaatataatttagtgtattttcatcagcagatttggtggtacattttctaagtattagtctttggaaaatccgtttagggaatatatctctgaatgtgttggctggttagagttagtgttagggatagggttagggtttaagtttaattaaaaaactaacttttaaataatgattaattattagtattatggatcttgcagttgactacctataaatttctttatgttttaaccattttctatttttattgaagtgtatcacttagtagttactatcatttacatttaaaattgtagcatggaaaattaataattggaatgttacatatttaatctatttctgtgaaactacaaaaaatttgtgaacttttctcatgaattctttaaaggaagttgactggccgtttagccatttattttacagaaataataataaggactatttaaacaatgtagttaattttaaagtttttgagcttggattttttttttaaggtatatttttcttgtggttataaaatgttaattcttccctgcttttgagtaggcgccaatggcgtagaatggtttggatttattgcatttatctgatgccaagctggagattattgggtgccctgcctgctgtgtgtccagctctgtgctgaggacagtggtgagcaactcctgcttgtgtccccaattcctgcctgtcctccccagaccatgcactccatggtctggtgaggggctgttatgatgaaaggaaacaactgctctggtagggaagggaaggtattaggttatgtggggtacaaatcaatggcccccaatgtagtcttgaggaattgtaagatgttagggtgtttgttggtttattttgatgataattcccaaataaagatcatatctgtagttgatgactaaagctgttagattttatccattgtattcattttatttttctcccctctaagacctacttatatttttcatacctttttaatttctgattcgtgctggtgagggggctgtgctttagaagagatgcagattttgagatgaaagagcagacttcttaactgacctcagaatactttttttgttttttgagatggagtttcgccctcgttgcccaggctggagtacagtggcacgatcttggctcagtgcaatctccgcctcctgggttcaagtgattctcttgcctcagcctcccaaatagctgggattacagatgcacaccaccatgcccgtctaattttgtatttttagtagaggcggggtttcaccgtgttggccagggtggtctcaaactcctgacctcaggtgatccgcccaccttggcttcccaaagtactaggattacaggcacgagccaccatgcccagcctgaccttagaatactttaactaacacttttaactaaattaaaggaatgtaaagggtaaagaatcatgttttgtaatacttataatagtattattgtcagttagatgatgttaaaatattcttaatttggaaggaggaaacaggcatcaaataaattggaagtatggaataatgtattgagtttaagggagaatacttaagaatctgacagtatgcgtatatattcatatatgtgcacacgtatttgtgaagatatatgtgtaaatcgtcacacatatatgtaatatgtgtattaagcatataagcaagcaggcacttatatactttcagggaattgagacacccaagtttgttttttatttggctgtccatatttacacatatgttcatatatattatacatacctgtgtatttaaatgagtaaataatatatctttaatatgagtaatacatgaacttaaatcaactaatacagaagcatatacaataaaaaattggtgttttctccctttacttgcctctgctctttatccttattatcagccttaccaatttcttgtcactttccccagaaatgcagctatgataatattattctttaaaacatgtgtgcacatacacaaaaattgacttatgtaatgtacaaagtcattaatcatttaacaatgggatacattctgagaaatgtgtcgttaggtgatttcctcattggtcattgtgcaaacaccatggggtgtacttacacaaacctagatggtacagccaactacacacgtagcctatatggtatagcctatcgctcctaggttacaaacctgcacagcatgttcatttactgaatactgtaggcaattacagcacagtggtatttgtgtatctaaacagaaaaggtatagtataaaagataaaaaattcatacaacctgtataggacacttaccatgaatagagcttgaaggactggaagtttctctgggttgagtcagtgagtgggtggtgagtggatggggaggcctaggacattactgcacgctactgtagactttataaatgctgtatacttaggatatactcaattttttaaaaaattgtgttagtacgcatattctcactcataggtgggaattgaacgatgagaacatatggacacaggaaggggaacatcacactctggggactgttctggggtggggggaggggggagggatagcattgggagatatacctaatgctagatgacgagttagtgggtgcagcgcaccagcatggcaaatgtatacatatgtaactaacctgcacattgtgcacatgtaccctaaaacttaaagtataataataataaataaataaataaaaagaaaaaaattgtgttagtaataaattaactgtagcttactgtaactttataaccttttaatttttaactttttgactcttctatgataacatctagcttaaagcaaacacatcgtatagctgtacaaaaatattttttatattcttattctataagtttttttctatttttagaattattattttttacttttttaactttgttattaagaactaagacacacacacacacattagcctagccctgcacagactcaggctcatcagtatcattgtcttccatctctacatcttgtcccacggaaggtcttcaggggcagtgacacatatggagctgtcatttcccatgagaacagtgcttcttctggaatccctcctgaaggatctgcctgaggctattttactattaactttttttaaaaatgagtagaaggagtacagtctaaaatgacaataaagtatagtaaatacataaaccagtcatatagtcatttactatcattatcaagcattatgtattgtacataattgcatgttctgtatttgtatatgactggcagtgcagtgggtttgtttacaccagcatcaccacaaatacgtgatgactgtgttgcattatgatgtagaaagcccaaatatcactaggcaatatggatttttcggccgggtgcggtggctcatgcctgtaatctcagcactttgggaggccgaggcgggtagatcacttggggttaggagttcgagaccagtgcgtggccaacatggtgcaaccctgcctctactaaaaagaatttttcaactcctttataatcttgtgagactaccatcgtacatttagtctgttgttaactgaaatgtcattatggaatgcttgactggatactaatatgaaagtctattatttaaaaaatttaggattctcatactctaaaaagtcactatccatatttctacagtttgaacttaaattgaaagttaaagctctaccagtaggaaaacaccagctagtgacctgaccatttataaaatttggctccactcaaccgcctccatgattttaggttaccgtttatttcccatccatctgatcagtatctttatcagtttcttgctgatttttaattttctcactcatagtaattttatttacatagtatgcatttgaaatagaatgagaacaaagcactcccaattttctctagtgaccaaacatgataaaacacaaaccaggatctattaaagtaaatgagaactcgagactctgaattacaaatcagaatcagtaggtcctgacttcatcagtctatagtgttctgttccagcattcttttgaagcatctctcttggaataagcccccaccccttagtctcatgttccaaattcattgttatgtgtacacattgacttctcatccctaatagaccatttctgtttcttcatttgttcatgtagtagttaacctgttgattccagacacttccctcggttatgtgtgtaaattgtgcaagccactggatgtgcagtgctgaaagtgggtcacctccttgatagtggggggctggcattgccatacctcctgccccccagccagagccctctgtgccttgtgagagactctgatcgctctcctgatatactaactcttcaccactctcctctcaccttgtgtatttactttctgactcacaccattgttccccaaatattgtcttccttttcctatttatacccttcttcatgttctttcctcaaagaagtgtttcctgtcaaccctcacagtttgccagtattcaacaggttgaaagagaacaaattattaattttttaagaagcactttaaacagaaggtgctttcagtttttcaaaagattttcatagctgataacatacttgctatttgctgtgtatgttagaaaatagattgggagcaaaccatctattttatttcagttttgtgttattaaaaaataatcatttcagcctagtgttttaaggcttttcagaaataatgtgaaataatttaatattactaagatttagggttgtatgagttcatatttatgggatggccttgggcttgagggcatttttagatgagttaattttttgtaatctgttttatttatacatatactgtaaatgctttaattcattgttatttttgctttaaacaattatcttttgaagaactaaagaaaaagatatagtcttacatttgcctctgtctttttcttcttataaattgggatttggcaacctttttttgtaaggcacaagatagtaaatattacagattttgtggacctcatagtctgcagtctttgtcacatattcttcttctttttttttttttattaaataaataatgcatgggcactacagaaacagcgataggctgaagttggcctgtggaccatggtgctctgtcccctgctatggtgcttatttccatctgttgtcattttccatcagcctgaatcagccccttttagcattgcttataatattggcaagaaattgtctcaacttttttctaaaaatatcatcactttgctttactttcaaagggtaatttggctagatatagaattctagttagacatttttaaatcctgttgcctcgctgcttctccctccccttcccctctcccacttcgtgcccctccctttcctcatctctattcctgttttaatctgctggtttgctgtgataggtctatgtgtagtatcctttagagtcatcttccctgggttcaccgagcctcctggatctgcaggctgatattttcagtcaagtttggggaatattcttctattccctttttccagctctctcttctggagctttcgttgcatctgtgttagattacatgatatgattccacagtttgttcatttttttcaggcttttctctgtatgcgttggttggataatttttgttgacttgtcttcaagttcgtgactcctttcctaacggcagtgccctgtctgctgttattctcatccagtgaatttttatttcagctattgtacttttctgttctagtatttccattctttttagagtttctatatctcttctgaaatcttctactcttcattcattctttacccatcttttttctgtaaattatttcctatatattatagttattttacatcccttgtctgctgattccaacatctttgtcttgtgtagttcttattctttttactgctttctctgtgtgtcacatttttgtgatttgcgtgcctaataatttttaatcacatagagaacaatgtggatatgttttagaggctctctattgtcatctgcatctgaagattatcatgtgttttctagcaggcagttaaattactatcagattatttcatagactggtggaggcttgctttgaggccttttagagtaggtctgttgagttgcccgtagtctgaagtttcagtggaaatagaagatgtttgcttggctactctatccctggcaggacttgagttcctagctccttgtcccccatattgagtcactgctgatactttgctcagttcttccagtcttcctttgggtggctttactttgggttccttgtcttctacacaagcagttcaaaagacagccaaggatttgagggtttgttattagattctagactccctcctctgagtctccctcttttctgggatttccgctcactgtacctacctcctcccaatttccagctgccccagaccccatctctgtgtcctccagctcagtaatactgcttcctgcctcactgttcctaggggactggccgttgccctgggggaaagaccatttaaatgtggcctcacctccttcgcatctcagcctttaagggtcaacacatctagtttctgccagctcttggtcactctccagcactttcattaaaaatatatattttctctacatttttattgttattagaaggagggttagtctcatataggctattctgccattaccagaagcctgagtcctaagtgagtagatattaaaatcttggggaacctttgccatccagattttcatcatgttaaaggattaagacactctgggaagcctcctgagctggcaggcggaaaaataagatggtgctgggatccttttggttggtgaatttgagtgcccccggttggctggcagggtttgtgggtgagctggtgagaggtccctgcaccacacactccccacctcactactgctgggaacaaaagtagattgattggagtgggtgtgcaccatgagagctgtacatcactgttctttcttccttgtgcatttgtagaaattgcattgtttactgtatgttataggtacttatgcatgaaaacattttatttgattaaaatattttcatctccactaaagcttaggttctaaaatgggggatactgccttactcaaaagttggcacatggccgattctaaagatgatgtgagtgtcctatgccaagcacaatgcctgatgcaccgataccagtgattttttctttcctgtctactctcttccactctatgatagttgttaaaaataattggattgggaaattaagaaaaggaaagattatatacctactttttaaacttatttttccgtatggcaaaataagaatagtgtgtactagtaagagctatattactatattatttggggagaaatttaacaactgaaaaaaatgaaaatgagcagaaaagttagtgttcaatagcaccataaaaatgtatctttgaatcctcattcacagtgcaagaataatgatagtgtagtgtaggtctgtagcaggggttcttgacatggatttaggggtctccatagatcgctgcagtccttaattgtatgaaaaagtgtgtgtgtgtgtgtgtgtgtgtgcgcgcgcgtgcatgtccttgtctctctttctgagagaggctgtacgctggtcatgagatttttttttttatagagatcttttgaagttttattctttttaaaaaattatcacttttttaatagaaaaagtgatggatcagtattggagtaggattatgaagatgtaatttataaagatagaaagaatgtatccatgttttcttatgtcttttcatgtttgatagtatgtatgtatacatacacaaacatgaaaaataacctggaaactaatgtggtaatatgttaacagtggcaaattgggatagttgaaatactttcttcttgtattagatatcgtttaaatttcaaaaaccaaagttaaatctcacaagttaattagttcaaacagaaaagacagtaaaaaaagtacagtgaaacctgtgtctttctcacaccgcccctttcctcagggctgactgcagcagtgacttgtgtatcctttcatgcacacgcacaggcacgtagacacgtgcatgacacagatggaagtgtaccatgtacattgctctgctccttgggtttggcgttttagattttgtatcttgaaggctttccaattttcagattcttaaaggggaggtctttgaccctatctcccaatcccctcgaaaggaatgaagaactttggatgtctagaaattgttttctattctgttatccttttcagctttggtgtgtgcaaacctgactcctagtggtagttcagaaattatttcctttcctttgggctcagatgatttttaggggcagtgaccttttgaatgcccactctgcgctggcctttagctgcttcacctcactcgtcttgcactgtcacatgtcatttcttgtttattattactaacactacaacaacacgtgttgagtttggtaatctttcagtttttaaaaaatttcagattgggccttttttttttttctaaacttcattatggaagttttaaaatgattacaaaatagaatagtgtaataagcctccatttacctatcgttcagcttcagtaactaacagctggtagccagtctggttgcatttactactctggctacttccaccctcccacattgctttaaagctaaccttggggatatcatctcattcctatgttttcattatataagctccaaacgataagggatatcttttcatgtcatcacaatacctttgtgaaacaaacaaaaataaagaagagtaatttccttaataatatggtcaaatatcctgtcagtatttgaatttccagttgtccccagtagtgtaattttttaaacatttcgttagaatgagggcaaataagctccacctgttttataagttgatgtatcttttgtattcttttgatctgtgggtaccctttccaattctcttcttgctttttttgcaggttatttttgaaaggaactgagttgtttgtcttatagcttttttaccattggtctttgttttttcaaacagtcaaatatagaaatatgcttcattaaagaatattaactgattgcttttaagtttttagatattctttcaatatcagattatatttgaatatacatttgttgcctaacatatctctgtttatggctttgacttgtatgggttactaattaagcacatgtttattgatttgaagtagggtatactttttgaaataaaaactcacaagaaaaaatagttcaaaatcagataaaattactttgaaaacatcttagagagagagatgctgttttagtctgtttgtgcttgctgtaacaaaacacctgagactggataatttataaaggaacagaaatttctttttcacagttctgggggctgggattccaagatcaaggtggcagcactggtgagggccctcttgctgtgtcttcacatggaggaaggcagaaggttaagagaaggacaaaccctgtgtcctcacatggctgaagagcggaagagagtaaacccactcctgcagtccttttttatatcagcataggtccatcatgagggtggagccttcatgacctaaacaccgcccagtagaccctgcctcccattgctgttgcattgtggattaagtttccaacacatgcattttggaggggacaaaaacatcgagaccacagcagacagccatatcagtgcaacaggtagtgagtgaatttgtctgccaaatttctgattggggctgaaggaaagagaattcttgtttcacttttaattagaatatagtcagctacttaacgttacatgagagaggccttttcagagtctctgtgatgtgagcatagattacctagagtaagttttccgtagaggtggatcttgctggagggatgatgtatatcaaataggaagccagggccctaaactacaacttacaaagccccaggaggagcccagaaacttctcttactgacagagttttcttcctaagtgaattatctgaagcattgtgaacccgagtcatatgcagtgaggcctcaattataactggattatgtaacaaaaattcagttttaaatctgtggtttggtgcccagaccacatttgcccttagtaataatgtgtcatatcagattaggttttcagcatagcctgcaaaaggtatttaatttgcgatgtacctgactattgtcactggcaatacagagctcatcctgctaacgtcatccctggtggcgatgccattgtgtccagagggacgctttgttcagggttacattcaagactccaggtgggtgctctagtgccatgggatcctggacaggagctctgaagtccttggcgtccttgtcataagtcatctgcacttgtcatctttcgtaggcatgtgatggggaagtgagagcttcctgaagtaaggagccttctcagggaatgtgtgaaacttacaaggggaagatggggctggagatccaccagctgaaggtgccaacacagtgatgataagtccggtgtctggggctggaaggtcttaagtcttagctgttggtttggtcgttgggtctatagtagaaaactgaagcatcagtatattatttatctcaaattgacatctaattctgttgagacttctagaagaaatgtaatggcattcttccctttctcatcttctgtgcctctcagtctccctcttcttactcaagagggggttggacagttattttcactgtttcttttctgctactcccacattttaaatcttcatcctttcctttttctcttagagagtatggatgtgtttgtatctgtagtaatttgagatcacagaatgcgatggagtaccatcttgaaaagaggctatatcttgcttgctgttgtatttcccccacagagaattaccaattctggaaaggattacaaaagaagaggacattgtttaggtaagaagatggtgaagaagaatgcatatggcaagttaatgggacagttgtgaatagtgactgtaggattaatatctgacaggcaggtctgttgatctcaatactcctagagaagggatgtgaaagatgccaagcaaagcattgactcagctataatagctaaaaaacatagtcactaattgacaacttagcatttaagaacgtctgaaagaatagtctcggtggtctgtgtttcgtttgacttggtccgcattgtcaggcttggtgctgccccgtctctgttgctcagatcctctgccccagtaccagtagaccaagcttttctcagaatgtgtcttgttccaacagaaccagaaatctgaaatatcagaaaggatttgctccaacacatagtacagttctcatggttcctggtctgcagtgagctaaatgcacaaggcccaggaaggggagcggctcggatttggagaggcagtcagagttcactacacttagtggcttagtttctgtgtttttgccccaggtaatagcagcaccttgtatctgagtcctccttaaaaaaaaaaaaaatacatacatatatatacacacacacacacacatacatatatatacatatatatacacacactatacacacatataaacatatatataaacacacacacacatatatatatacttttaacatttgttataggggaaaatggatgtaattatttgctgacaaggggtggggtagtggcctgcctgaaaagctggaggagcatgccagtgagtttgttttgttttttttaagtctttgagatcctgggtctctcccaaccatccgtaaatctgcatccttagccccaaattcagggtgtggatgcatgtgcccgtgtgtgtgcgtgcgtgtatgcgtgtgcatgtgtgaatccatactggattagtagcccaagttcagtggaccctggcgtgtagcctctcagggtgagaatactgtcttgttcttgctctcccaccatggttacgatgactacctccttccattcgctacatcagaaatcatccagtgggaagaggaaaccaatgttgtcatactctaataattatatccatcccacagtgggcaacatattttgttgtgattattagaaaactatattattagaaatatgtattggaaagcttatcaattttcaacatctttataacaatagtttatatatttaaatagtttttgtatcttcaagcattaaattttcagctgggaaattatgttctagtttagggctgacagtaataattattagatctatttttggtttaatacctattaaaaatataggctctggctttggattttagaggtataatttaattagacattcttagccatgaagtgcacattgaacttttccttccttatcttcctcagtatccactaacatcagcagcagctttgataaggcagacagatgctgctgctgcccctggtacttgataaaatattgcttcgaagagctggctgataagacttttctcccttaactacttgcattttatacaattttgaatcttgaccagataatatctgtaatttagagaacattgatttgcaaggttggccgcatgttggaatcacctgggaaactttttaaaaggctgatttaattggagtggggtgcagcctgagtatcaagatttttaaatgactaatattaggtgaatcaaatatgcagcaattatttaacaactctgtaatagaaattaatacaacaaatttgattcttgtccatggaaatgcaaattgtgcctggtgaagatgcaattgattattgccctgtggatgttgattattttcacataattaagcaaatttattttgacattcctgatggcatctatctatctatctatctatctatctatctatctatctatctatatctggtctttgaattctcctttgaatgagttatagtgtcttgctgttttattaataaatgagttaaatctttaaaaatatgcagcaaaagttgggttttactgttttaggggatgtagaaagggtcatcaaagcaggagctaaaagagtggcactaagagaatcatccttgggctaagttgatttgacacctgtctaaagaaggtgcttttggacttttagctcggcccctcacctgggctcctgtgggctctgaaatagtgtgaggttttcggaaggagactttgggagtttgcttttatttttacttcttagggaatgtgtgctcaaccataaaagacagtggtcttcctagcatcttctatgggtaaaaacatatttagtataagggggaacttctttcccccactattaaaagtgcagtttaagggtggtggtctcacaaggctgccaaatgaaaccaggtgattgatatatactgtatgtataaataattagatatgttaagagacaaaataatgtaaaatccttagaaggctcagtgtaacacatttgttgtgtgtctgtgtacattttgttattttcatggtctgttttgatatcaagatggttttcataaagaagaaacaacatttagttgatctatgatcttaaagtacagtggacctcatatctacttttctctttgaacttttaaaagtttttttctgtatcacaatggaaacatgctttctgaaaaggataagtgaagagttttgcaaagggcagaccataaaagtgtagcaagatgaggcatttcacattttaaattttattatagaatgttttgttcctaatcacctttgctattccacagctcattatcacactagggtagacattgttcatgtccatttaacttttatctctactctactttgtccataaccactctggatcttctaaaaacccttgaaccattacctataaattaattaaaacctgcagctccctctatctctgggcgctctgacttccagctcccccctcctattcagccatctgctcttggtacctgtgtcactcttcacactgcctttctagcctctatccatcctgtatatttggtccatcagatgaactcctctctagcaccttcatctcactgaattttctgtctttcctcctggaaatatccaaacgtggcatcccttctccacttcttcatccgagttgccaagctttgtaagagtagatgaaaccgctgtgcagattggagacaccaaaaatgcatggatttccacattcacagattgcctagttcctgttcagcagtgcttttgtcctcacacttggttggctcctgcgttcccatcagtcactttgccatgtttttactagtctctgtagccccttacacactcactaaactcctttttctttgtagacagcgatgtctcttacctcaatacagtggaggcagttggatatgaattgccttaaattcatcctttccactagcagacttttcctttcacctaacattccttctgtcctcttttccttccctctggcctcagagaacagcctcgagtcttccccagttttaaaccaatgctcggcctggactcttgatgccctgctctgctttctccaaaaccttgccgctccacacctcttattcttcttgtattttcactcttcttttattggctcctcccactgggcctatgaacatcttggaagaacaaaacaaatcaaatagtcaaaactgttttcctttgaccctgtgtttctctatcccctgctccttcgcagttcactctcattttaagctcaggagtttgtaagacagttccactttgctttcttctctcccctctctcctctgtcctgtcccataacttcctcagcccacttccctccaggcttccccataccctgcatgcttcgggaaacaccaccagtggcctcttaatcactgcattcataggaagctttttcagtccttaccttttgcatcctctactgattttgacattgaaatgctgttctcttgacttctgtggccaaaatactttctgttctccttttttaaccattccttttttacctcttttttttgtgtgtttcttttcctctacttgctccttaaaatttggaactacttcccattctgccttaaatggagagtaattaacccaacagaaccacttgtcaaagcttaaaagaatgtatacagtctggggtgtcattcctggagtatctgattcagtatgtccttctagaaacctacagtatcatggctctgtaatattctgtcatatgcaggtaccataaattatttaaccatttcttaaatattcattcattcaacagatattcattgagcaccttcaaatcccaggtgctactgattattcagtttttgtctgtcatgaaaagcactctgataggtagcatttgtttcacttctttcatagtctcaggatagaccggattactctattaaaagatagggttttctaagatcttgatacccgcggtcaaattttttcatagaaagccctatttttgcttctaccaactctaggctatggttttaactgccagttatgtaagaaagtggctcctgaactctttaccactagactctgctctctctagattcatgtatccaaactgctttgagttctcaatgaacttgcctctttgcctttccaaaccctaatgcccctctacctgaatgcccttgactctttggatatagtcactgcattactgcatgcctaggaattgcttatttatttccctaagttcctgcatgcagggttgttcatcttcgagtatccttagtgccggcacacaggagctaatgaatacatgctgagccaaatggactatgtgtgtaaatgtttccatgttttaggaattattctgtagttttctgtatgattggaacttcgcaatttggaatctatagccaacattttttaaaagataattgagcacattgttagcttttattggatttaaattacacagtttatattaagatatgtattcattataggtactttagtaattggagaaaatataaatggtaaaatgaaaactgcctgttaatgcactaccttcagatacccagttggccttcttcatagacatatgagtgtatatgtctgtcaagtgtgtgtgtgtgtttctgtacatttctacacattcatcttcatggcgcaaaatgtttagaattatgtctttttaatataatatatgttgagcattttccatcaataaatattttgtaaaaaatacatttaatggctaaacaacattctcttgtatagaaatatttaagtatttgtttaaccagctccatattgttttgtatatagaattcctgccaagttattattaacaaaaatgctggagtaatatcgcaatagcagttcatttattagacaactgtgtgtcaagggtctagtgaccctggcaactatgtgctctgtggagtaagatacagtttgatgtggaaagcaagcaaacagactctcagaatatgctgtgaggaccgctgctgctctagggttaggaaaagaatgccagggacacagaggagtttgagggagatgtcagggaaggctgcctaccagagctgcaggggaacagacaacatggttattgactgatttctttgctcaggatatttgttaggataacacttggttagtatgatgaagaatatccttttctatgtaatattgagggttttttgaaacattaaagatagatacgatttaatcaagtacatttgggacattatttaacttatctttactctccttccttgacctgttgctgtgaaaaattataatatgttgcttctgaatattgaaatagctttgcttcctattttctgtgaatgtgcttcttgatatagattgttaaagctgtgttcatgtgtggtgttggtttttctgcccctgtggctgggtttggtatctgaggcatgccagctgtatgaaatactgtagaatgccttctgtgttatcctgggctctggagcagtttaggacatgctttattctttaaaatttgaaagaagttgataataaggttccaggcccagtgagtttttttaaaaagcaaattcagtgtaatgctatggcaactctctcagctttgtcagtgctggttattctggtcaagctttcctcattctggatcagtttgggtagttgtgtgtttttctacgattttactagttcatcacaattttcaaattcattagcacagagttgagtctttgatttctttttcacttactgcaggcagtgtttttgtttgaaatattgctagtctagactatcattttcagcattataacagcgtgtcatcttcctcaaagacaggtaagtccagcggtatttgagatgtgaaactcggaggttaaaatgggttgattgtaaaggtgggtttactcagtttacttagtagtgaagactaggaataatcttcacttacaagagcatgtataaatggctgtgtgtgctggatacaattttaattttatgccattgtcatttatttagtgctattgaaataacacttacagttcacagtaagagtaaggtgcttgcactggcatataatgagaggaagtaggaattatgtttttattcagtagtaaaaatagtacagttacatatggtgatcttttttcaatcagatggtacctctgtcagtaaacagaggtgccttttacagttcattaggatttacttcataaaatgttaccaatgtgagttttgaaggctaaacgaagagggaggacgtacgggtgctagcgcagaggctatatggtacccagcagaacagcatgagagaaggatgagctgatagaagtaggtgagacatgacttaaatctcttatagatctaagggagcaatagttgactcgagtgctttcggggtactgatacagcttcccaaatgttgacataatttataatgttaaagatgataaaatgctagattcttaagtgaaaccacgcagtgccagttttcagtttgtgtgtaggtgcttttttctctttttctcttcagaatgcaggttctgtgtcacaggttattgtcttgtcagtgtttatatgatcagtaaaccactcagctccatctaattgccattattactaacgattatgagctatgcagctctagagaaacagggttctgtgcacaacgtttactggtggtacagagagagtgatgggctctggacaagggtgttagggaagtttgcccagagaagccccatcttgaaaggacgccccacagagaagggacagtgtgggaggcaccttcagggaagaggacaaagcaggggttaagtcctagggtctggttgagcctggacttcactgtgcctgatcttgaagagagaacagaagtggcaaagggcaaagaggtaactagattacaaagaacctcgttaaccacacaggggagtttgagccttatttatcatcaaattgatattaaaatgatttgtaaggatacactaaagtaggagcccctctgggagggcctaatacctttttccctgtaactgttcacattagacctgacacagagcaggcatgcaattgcagtaaaaacacagcattcattgaaccaaatcctaacaacttagtgggctgctcctccaacctgtgatgcattagagcccaaggctcttggggaatgagaggcaggcctctgagatggtgagggagaccctccccacacgcactttagcatagactgaagaatggtcagagagcaaggggctactgtaaatccttatttgaagattatgtaatttctataaatgatttgtttttaattcagtcttcttccagaaaccctaaaagaaagattattatttcttaacggctctaggactttttccttttgttcagtggtttcagattatgtttcactaataaagagacttcttttatgattatttgtgagtgttgaaaatgagatatttttgcatcattttcttacacaaaatttttaatttaaggtatcacacaagatagttcttatagcctttatcattaacagtttctgtgtatacatttttaatagtatacatttttaatagttgtaggacaaaaatttagtctatactattagttacttctcttctagcctattgctgttttagccactggcctttctggatcttaaagattacagatccattcacgtgtttgctgggatctttcttccaagtgatggctcctccaagtgtatttaatgtaaaaattgaatgaattaagattacatgttaatttaaatacagtaagaactcattatagtaagaatgcatattatgggcttcagatttactgacgtggtatgagtattctttttgtttgtataactatttttatttttaggtaacagcaacagagaaactattatttatttctgaatgtatagttctttgggaaattgttaacccagatcccagtggtggtgggagggcatgatgggggatgtcttagagtctaacatgccatttttttccctttgctccccctcccctaaatcaagacttacggtgagagatgtgattgctggggagtgttacccttggtaaaggtttggcaaaaaggatgtgttggaaactgcctcttatattgatgaacttaaagctgtagctttagagtctagcaggcagccctgaaattaatgtagttgagaaaggggcaggatttttcatttttaatagggaattacatgtatgcataatatgtatgcacgtgggatattagttgaaatgtaaaactatattttttctctgtcacggtgaaaaaatataaataacgctttacatatcagtaaactgtcttgtatgaatcagttaagagcgtgtagtaaatgactactttctttgtaattttggagagtgtctttaaaacacatcatatttaccaggagaattataaaaacacactaaatataaacaggaattgtaataaaacttgcccaaagcaaaagcttttataatggctgttacaagctaattggagattgtttacctattgacgtggagctataggtagaagcatttgaggaggtacttattatatttattgtagtagctgtcctaaatcagtagtctaaatttatatactgttattatcaagataaaaaggtaacttagttgaaaattttaaaagcagagactagtattttgtaagcagatataaacaagttatttttgtaagagttttgttatgttgaagtgcaaacagaaagtggccaaacttcaattacttaacaacagctattctgtaagtatttgttaatcatgagttcttgttgctttaagccacaactgattctattaagaaaagttgttttgattatataatgcaaaattatgtgcacataaactattaagcacagttgttactactgtgaatatataatacatatatattatttatgattcttaagtttgggtgaattactggcatagaaataatagtgctttggtaataaaagtccttttacatgtttttcaagtactatatgttatgtgatttgtttattatttatagtttgaaaatctgcaggtaattcatgtatttcgttttttaaaagtgggtcttagccttttgttacttacactgtgttaatacggatttcatgcaagcattccatatttttctgtctgaagcaaaactaccactgagcacaggatccagtttctgcatttaatgtgtgtttttttccaggactatttcaacttcactcatcgtttcatgagcagtaactaaagtttataaataagaaaaattgtcttattccaaagattgcctgtactactctcaaattatattctggatctgataattcgcaggaagcaaataagacattgctgtgggcgatacatttatcaggatgaaaatttagttatttttgactattgttgagatgtaatgtcctatatttcaaactagcttgcttcctttgttctgttctcccactttgccttggcaagttggatcaatatgcaattgaaagacgtttgatctgtaaatagaaggttctctgaatttcttggcctttctggcaagatagggagagaggcaggtagatcagagtttgaagggcccatggtgtgcggtgtctgccttttatttatttggagtaggataccatattggaggttacatcttccatggccagtgagcagcggtagggtcagcattggagacaacttctgagctgatgcgtttatttaaattgtacttacacatttgggatatgtagaatgttatataattatcaatattgtcttcagttcagtacaaaatagtaccctgggaatttgttccttttgccattttaataagtacctagaccagtgtgttaaatttggaatcgattactgcccatgtcatgaagtatgtatatccttataaagtttaaattaattattattgaaatagagcatgcacatatttacaaaatccagttgtgcccagagccccaggtcaaagaacagcaggagcaaggcactgctcccaattctcttagttattgctcctgggttacatctgtctgacaaaactgtgcacatgtgtagcagttctgcagtgagttgtgtatagtacctcttgaatgcagtactctgtcctcatacttcatagatgctgtcagctctatgctgccagcaagggatatagacactttctgccatgccatatttcagctcatcctcgtctctgtttttccatccttttctgtcttctgtcttaagtcttagctttgcttaatctggttgtttctaagctagtaagcatttgttatatctctaaaatccctattaggtactttgtatgtaaagatagtattatttttagatactttgattagatgactagacttttaaagctgtagttcagtatctaaagtgtactaattatttgcattatggaaacatttattaattggaaatagtccttgtgactaagaaatgattaaaattatgaatttaaaagggaatatatccttcaacagtttatacacatctgtatcataatttattcaacacattttttactaggtatctgacactgtttaaaagtagtatgtttgctttactgtactcttatttgtttaaggtaaattaatttataaatttttctctgtttttcttagacaaaattgaagaagcacaaaaagaacttaatggggcagaagtttcaaaaaaaggtaaattaaaatcagcttgaatgtaaactttattcttgcaatgatgcctatacatatacctcataaatgtagccttatgaaataaatcagtatagacatatcacaaaattagaaatccccttgaacttattgatacttaaaatgttgtggactttgcttcatgaaacattttagccacatagcacattctataactgtttcccacatattaatgtatgactggtagaagtgtgaaaggttattgcagctcttttgaaagtcctgtttgtgagactgtcctgtagcaataaaagtaccaatataaggaacacagttggccgtgtccatgcatgtgtgttcatgtgtgcattcatgtgatgcagttttctttttttttttgtagcgacaaaaacctaaggcaactaaaacagcctgaataccagtcagtggaagaacagttgaatcatttgtagtatactcatattttggggtatcacgcagctttgaaaaagtgttaattactttagttgatggtgataacttatcaaataagaaaaataacattgcaatgtagtatgtaaaatatcttatttttttgtgaaaactaacaaagtcaagtgtgtatacaagtatttatatgtatatatatatacgcatacacacacagaggcttctgtgagattggacaatgttggaaaggatttatacacagatatgtgttaatagtgggaagaggagcaagggaagatgacccactcatttatatgcctttgtattatttcaccagctgcaatgggtgtaattttgtattaaaattaaaaacttgaaaggaaaaaattggttttcaccatagaaaacatagattatctttccaagtaatataaaaaaatagatgtgatgcagaagagcatgtagggatggtcaggtagtgaggtaaatactgttgaaacactatctgttaatgagcaaaattgattatgtgcttttaatattgtgggcaaataaagttctctttatgacatttgtattccgtgatttattatttattttgccttgtatcttcaaattacagcagactattttgacagagtaatttagctaaataggattccagttgaaagccgttttacaaaaaatagcttttaaatctagttagactactgagcaggtatctgtaggggaaataatttcctgccatcccagttctccatcccttaaaccagcctgtgaagccttcaggatggtttggggttggtcttacatttatggggtactatgtagcacccctcatgtctgccttctcctcaccccacgctccttccatgggagctctggaagggccatgtatatctgaccctctaatgacattcttacagaaaaacaagcatagaagagtaaagatgtctccatggccaccttgtccctttgaagggttgactgacttaaacgcatgaggcatttgagacactcaggttataagaggccatacttttaaagttttctttctctatagccagccttttttttttttttttttttttttacatctagtcatggtttagagctgcttctagtagcaaagcaaatgtgagcctgtcttccttttccttgttacttctttggcaagagttttcagaacagtgaactaaatgcctgataggaaggaggaaatgaaacaaaggttctagaaagagaaattggataatgaggttcagaataatggattgggctacagttggcaggctacacttatttaagagctaggatgaataccaagtgagcattgttctgtgcagttcactgcatagaattactgcttggctttcatttttatacagaaattaaaaataaaatagttttccctttcaaatataagtaagaaataatatcagtttctctttaacaacatgaaaagtctgagtaacagtggtgttgagatttttcaaaccttttcttgctgatacctattttattttaaaggatattcatttcttccatcaaagaatatactttaaaaatatagacgttcattttagattatggtaagtcatctacaatagatctctttttcattgtttttctgacgtactttgggttttttcaccctgtaagtttagccacattgctttttaaaaaaattatttttaaacactgcttgtagttctaaggctttgtctccattaaaggttctgtggtctttaacttatttgaggctctttctccctttctctcttttttgtaattattaggacaagtaactaatttattttcagaagtatctagcatagtagtaggctcttaaaagcaacttcctcattaatagattaaaaaagacatttcctcttgtattttaataatttaaggaggattaaatctgtttagtgtaatatggaagtaaagaaactgactttgcctatcatacaccaatagaataaagaaatgcactaaattatgttaatgtacttattttattctttttctcttttgaatgaaaatcagatgactttaatttgatttattttgattttaatcaatttagggatagagataaggatgcaacattcacacaagtctccataaagtcattatgtttttccttacagtgctatctcctgattcttaacacacattgtgcttgacactatttttaaaattgttgagtgggatttaaatgaaatagtgactgtcacagatgtggtaatggaatatgaataaaattaactgggaagaaataaatagatcgattaggagagcttttatggctttctcaagctttaattttaatactcttaaatttttatcatacaatgtttgacacatataaattaatatatgtagcatattaaattacaaagcataagaatgacatggtaatctttgattctcacacccaatttaagaacgggaatgttgccagtaccattgtatccacccacatgctgatcggcaattcatcccattgtctcttctgtagaggttttactgtccttagttttgtgttcatcatttcagtccttttaaaaaacaattatgtcatataagtatgtacccccaaacaatatattttctagttgtgcctgagtttgaacttttaaatgaaaccatattgtacgtagtcttctgcagcttttttcacttaacgttgttcctaagattcacccatgccgttgcacatagctgttacttttcattgttgtaatattgcactgtatgaaattgttggcccattcttctgttgatatttaagttatttccacctttttgctatcataaacaatgcaggtatgaatatttttatatcctagtgcctatgtgtgagtttctagagcatatatagggaatgtgaatgttcagctctacaaaatgatgctatattgttttccagagttttttttggggaaactttttgcattcccactatcagtgtccaagaattcattttgtactatcaagtacatggtatgtttagtcttttttttcctaattggatagatgttaaatcctcttttattctgctttgatttttgtttccctggttactaatgttaaaagaaaaactttagacacaaaaagtttaactgattttatttaaacaaagaatgattcatgaatcaggcatcattcagaaccagaagaggttcagagagctctgccgagcagtgtgagcagcaagctcgtacaggctgaactcgcaagcaaagtgagaaatcacctgattggctgcaactagccacctgccttgttcaggtagggtgtgatgaagtatttgccttatttgggcatgatctgatcagttgacttcctgtgattggctgaaaagtagctattttttacaaaaaatactctaaattaggtttgtgtttgcgcactaaatgaggttgtagtttgttaggtcataactcgaggtaaggagacagcctcaggcaaatggcctcctgcttatttaatttaataatgtcaaacatgtcttcatttgtattcccccttactgaaatgcttgctattattatttgtccattttgtaaaaattgagttatctttttcttaatatattttgaataactattcattttatgtgctttatttttcagatttattttttacttcatttaaagtgccttctattcactaaagtgaatagaagctcttgattttaatactgtcaacctattaatttcttgattttgtgattcatttttttgtatttttatttgtcttaaattcttctctatcacaaggtcttaagtatatatatatattttctatattttcttctaaaagactttcacgtttcagattaaaaacccatctggagtttgtttttttaaaaaaatatacctagttttttaatgtagtgtaagttaggattcaagtttcttttttttctcaagtgggtaaccattgctaatattgttaaatgtccctgaaacatttagtatgttttccttttactgtttcgtattaatttttcatttttgtgtgggtttgcttcttagctctctattctgttctgtgaatttgtttacccatattttaatatcacagtatgttaattacttaccactttattgtcttgatatatacagtgtgcaataactagtatatactatatacagtagggcagattccttgtgttatttgccttcaggaatgttttcactatttctagtcctttgctcatctatttgaattttagaatcaggtctttaaaaaacttgttggaattttgtttgggtttgattgaatctggggcaaactgaccatcttcacagttttcaggccttctattcaaaaaagattgtatatttctgatacttgtgttttctttagtgtcttatcattttcctccatatgaatctttatttttttctgctctatttcttagaatttggtgttttcctcattttaatgattttttcttttgtaaaattgttttctagttcctggcaaataaaaatgcaatatatttttgaatatttatttttatatccagctacttggctggattctcattcattatgaaaattgtctgctggtgttttcagattttcttgtcatatcagctgggaataatgaaagtttgtttcttcattttgaaataattgtttcttttatttatttttcttatcttgctcagttggctccagtaaaattggtatcttagacttgctcctgattttaaagaaaatgcttctaatttttcaccattaaaatgtttgctatctttttttgtgggaagagagtctgtatattttttagttgcttaaaggtgttatcttctattttttatttgttgaaattatttttaaaaatcataaatggatttttatttttatcaccttttgtttctatgtaaagatgatcttactatgtcctttattctttcattctgatgtttaaaagtgacttacgtatctttaaaccaatttggtcatgatgtttaatcttaatcactgctagatttgatttgttaatattttattgaagaattttgaatccatgttcaaggcattggtttatatttttattatgttttataattttctgtgcctgattttgttttaaggttatgctagtttgataggatgatctgaggactatatgcttctgattcccatggagctgtttgtttgatattggaactgtacctttgtaggcaagtcttacaacatattttgacttttgggagggactgcagggtagacttttaactcccaagtgtacttaacaataagggattatccaaacattctattttctcttcagttttaggaagttgtatttttcttataatttatccatcttatctaaacagtcacatctgttggcaaaaaatcagtcgtagtattttcttactctctttcatttctgctgggtgtgtagttatgtctgttttttattgcttctatcattgatttgtgcctctcctcgctttcttgattagtgttgccagttttctgttttactttctttttattttgccaacatctgattttcatgatactttcttgcctcatcctttttagtttcattaaattttgttctttattatcttttcctgtctttttcttcaggtttgttctgttactcaaatttcttaacttggaatgctcattcatttttaagcctttattctgctctattggaatcacttaaagctgttaatttccttgtaagtattgcttagatgtatcatacacaattttatatttattagtttcattcttttctatgctggtttcttctctgaccctccccccaccccaaatcatgttggaatttttttttctccacatggatggggatcttatttatttttagtaatttctcacttaattgcattgtattgttaattgttttttaaaaccatttaggatatccaaaattatttcttctctgtttctgaataccatgtaatcaaaattttctgagaatgtagtataaaagtactcatagattttatgttagaaattgagcattttataagtaaattaatcattttgccatgatgaaaaagctgaagttgaataatgttaaataacttaacccaagggagtgcaaccaagaaagtacatgaggaaaatcaagcccatgtcttggactgtgctattctgatattattccctggtataactagataagatctgtgttatagtgatagttgaatttctggtacagttttatttctgttctaacttacctttttgaatgatgagattatgatagcagtcacctacagaaatgttacgatgatccaggataaaagagttaggattcagacaatggccatagagaaaggtagagactttaggtcagcttgcattatgatttttttttaacattattttctgtctcacaataagaacctacaattgccactatcattaccagtaatttcttttcagcagtagtggtatcactcttacattatatacttcagccccagaacatttttattttttaaataatttctgtgaatatcaccatctatataagagtaagagggcctaaatatacataggtagtttatatgagttaagaaatatagtaaggaaaactgttctagtaatactgaatgatattcatatttgctctgaaaagtcagttgataagtgggatttttgttaacataggcatgatttatgccctgaaatatgcttctcttgtctggggaagcttgagggaagttaggttcctgtggaaaatgagactaagtcagaagtgagagtggctccattggatcatgaactctaattggtgtgtcagtaaaaatgctagtttctcgcctacttttctacattaaaaaatgaatatttttattcattttacaatgatattattaaaaaaatataataatatttttgaagataatgtgaatgagtttccaaggggtgaaaaatggtgactctcatttaaaaaaaaatttaattaccacacataacattttttaaaacgaaggctaatttcgaataaatattttatgttaataaggccatgctttattgccaatgacactcttccttaaaaattctgctgagtataattaagaaaatacaaggacatattcttgtaattagggatgacaaagtccttcccatgtaatactgaaatttaggtagtatagtagaaaagatggacagattttattaaattaaaatgaagaatgtcaataccataagagagaaggtgaaaatgttttaaaactgggagaacatttgtacaataaaacaaaacttgataggcttaccttagaagggtattgacaatttacaaaatgaaagctcatgtggatatggctagaggaaaggctagtatagtatttttgtgagatgtctgaatggaattctgtattttaaatggaatgcagttttattattttaatattatattgatgttaactagtttattttttaaccagtgtggtccttgggtttcttattaggaaataatatattttagtgaatctgtttaatagaggtttattttaaaaaacagtatttgtacatcttagtctcttaatgttaaatgccctaaaaattatgttttttccttgtacctctcattaatttatttagtaaattgttgttgtgcaccagccatttttttttttttttgccctgagaaatagataggaaagaaaaagtctaaaccttaaaggagcccgcaagctttaacccagctcttacccaaatcatcataaatcctgaattggtagagcaaaaattcatgaggtagactggcagcagtgcctaacaaatttcccttgggaaaacagtaacagattttttattttttagaaaagaaagtcatctcctttttttactattaaaatttcaaatttaaatattcacatcttacgaagtattctcttagtgtaatagacagtgaatgctgtgagcttgaattactgggaaattagtattttaattatttgtgtcatttatataagttaaaggtatcatgtgttaaccatgtcaatattttgagaaatttgaaaatcccaaatcccaagagatcattgcctttcagatagactgccagctttatgaaagatgatttgcataatgatataaacaaagcattttgtagtacattaatgtaaaataaatgtcttcaaatatctgtcctcactgtgtttaagttcagaatcctaaaacattgctccttttgaaatatgaaagcaaaaattctcagtatttcctaacagtgttacttatcatggtctattgagccattcattagagacttaagtagctaacctgattttaattttataggatgattcatagaaagactcacattcttgtgcatacttatagcatatttcattgacttcaaaatgctattgattgcaagatgcacaatgattttatgcatcctttagcaaggagaaaagtcactgccaattaagttatgacacagtgctcttataattgattagaagatgcatcctgattttagagggattaaaatgttttttaaaatttgtcttacattatattaaatacatatttatgtccactggtacattttttgacaagaaagataaagtatttaaggtaatggcatatggatttgagctgctttgacagaatccctgaggactgtgaaaaacaaagaaatgaatcttatcctagaggctcatttggggattcacggaagagtggtatggggagaaaaacccaggttttgtttgtttcactttgcttcttaggtaattgacttcatgccatatatctgagtattttctatataaataatgccacagagtgacttataaggataatatgtgttgctgttcatctatttaggcttttccccaggtttgctactgtattctctgtatgagaccaaaaagaaagaaagagataagcttgtatatattttgcctacgtagagatttgctctttttctcatgtttcctcagagaagagagcagacatgttgcataaacctgaagaatataatttgagggcagaaatagtagaaaataaaagtgagaggaggcagataaattgaagacagataaagaactgggaggaagtctataaaatgaatttaaaaaattaaaaagcaaagcatggagataacaaagtatttaaccaacaatatggtgttcttttattgcttcactgtgcaaagggtattttgtggagctatgctatatgcaggaaatttatcaaactttgaaggatgtagcttagaatttttccctgaccaccaagcaatggggtataaaattattttatttaagaaaagcgttggaagtagcaaataagattctgtggatgagtgggaagggcaagaagaggacttaaaagcattgcaatgaaaacaaatgtatgtagtaacattcatgcatggcctgatctgcggtgggaggtggactgcaggagcccgaggagcagacgctttgggagtccagcccactgtgaaggagcaggagccagagggaaatgtcactgagttttttttttttttttgagacggagtctcgctctgtcgcccaggctggagtgcagtggcgggatctcggctcactgcgggttcacgccattctcctgcctcagcctcccaagtagctaggactacaggcgcccgccactacgcccggctattttttgtagttttagtagagacggggtttcaccgttttagccgggatggtctcgatctcctgacctcgtgatccgcccgcctcggcctcccaaagtgctgggattacaggcgtgagccaccgcgcccggcctcactgagtttttggcctggaggagtgtgtttatttcagcaggcccaccccacatcatgtagttagccatttagtaactgtttaacatgacccttatatgtgaagaaaaaacgtggtaacatagatgcaactcacttctccacaccctcaccctctcacctctgcctggggtctcctcacatcttcccctatacagttttgcccacagtcatagcacagcacttactacagttcttagtgcatgtagtaggcatttgacaaatgtttattgaatcgatgatggatggtagaggtgtcagaaaggatggattcctttacttaacaggcaggatttgtaaacagtgcgttattattgctttgatttcttaagtgtggttagatatgtaatctagattgcttttctgaagtaagttgtttcttttgtcatattaaattatctaatgcagtgatgtatacaaatagtttgtgtatgtcgtcacaaaaataaaaggttccttctttaacagctccaaatgaatcctttcttatgacttcattgaatcaggaagactcagactactctcagtgtagttattttgtgatatcataacatctttgtaaacctggtgggaggttgtgatagtgtgaagaactgaggattccagatttctggtgttaacactacaactcaaacgtcctggtggtagaaatgttaatcaaggggagttcacatttccctgttctggtaatagacagtattgccctggatttaaccttttcttgctgatgtagggtcagttggagtgctagtaaactatctgctagctggggcaggcttagaggggttggttggggagggagttaacaatttatagcatttttcaaagtggtaaaaatactccccaccatggatgatttcaacctaccgaatggttgcggcttgcagaattcctgaatatttgtttagtagtggagtggtccacagcacacattgcttggaaaaatcattatcatactatattcttgtggattcagctactgtatacagtaagagacagacataacactgactggacgctaatcctaagtttagagatcctagaactttcttagaaaaatcactgaagtctttggaatctttctcatgaaagtggagcaagaggatataaatttgaaagactcagggcagagaaatgtaactattattctgtaaacctagtgttttagttgaaggctgaatcaaccttctgctaagtgattttcttaaacctgtaaaaataacagcagaatacagggtgagtatccctaatctgaaaatctgaaatctaaagtgcttcaaaattggaaactttttgagcactaatatgatgctcaaaagaaatgctcattggagcatttcggatttcagattttcagaatagggatgctcagccggcaagtataatgcaaatattccaaaagctgaaaaaaacatcagaaatccaaaacatttctggtcccaagcattttggatgagagatagtatgtgtttggttttctcatcagtgtcagttatcttgttagcaacatttagatttttgtctttcagctttctgctacttttgtacaaaccatactgtacaacattagagcaagttataaaaatagaaaatgtatttatttcatgacacttcacatcagttgtcacttttctattaccttttgtgctaacccagctatatcatagccaaagaggacctgtgttgagttacaaaattgttcttaccactttctgtgaagtacttgtcaggagtcaggcaaagtgcttattgaaaaggcaaataagaaggttagtataacaaatactctaagtatatacttggttttcttctcttagtggagtgtttaaaagacatagttaagtaatgataacagtgtatttttgaactgtaacatttataaatacaatatgtatataacatgtataaatacaatatgtatataacaaaaggaggaaaaaggaaaatagagctatataggcataatgttgccacatctcactggaattaagttaatataaacctcactggaattaagttaatataaatctaaagagactctgaagatgtgaggtaagtcctagagctactacaaaggaaataatcaaaaatctctataaatgaaaaaattattaaagaaattaaatattacatttgaaaatattcacttaatgtaaaagaaaacattaaaggagaagtagaggaacaaaaaaagacacaagacatacagaaaacaaaaagttaaattgcaggcacaaattcagctgtgtcaataatatcaataatatgaatggattaaacagtctaatcaaaaggcatagattgtcagaccagattaaagaaacaagatctgactatacactgtctgcactggcactcactttagatccaagacacaaatatattgaaagtgaaaggataggaaaagatgtatcatgcaaataacaagcataagaaagctggagtggctatgttaatatcaaaagggacttcaaaataaaaaatgttactagaggtaaagagggacattttctaatgatgaaagtgtcaatccatcaggaaggtatagcagttataaacatgtatccacctgataatagagccttaaaatacatgaagcaaaaactgataaaaatgaagggagaaatagacaattcaacaataacagttggagacttcattaccccactgttaacaatggatggaatcttctagacagaaggtcagcaaggaaatagaaggcttgactaccaacactgtaagccaagtagacctaaatactccacccaagaacaacagaatacacattattctccagtatacatggaatattcttcaggatagaccatcacctaggccataaaacagttgatcattaaatcaaaaagaattgaaataatatagtttgctccaactgccatggaatgaaattagaactcagtaacagaaaaatgtactgatgtgaaaaaattcttccagtcccacattgtccctaagaggaggagaaatgtcagtcagcaaaccaaacttctgttgtacaaatgacaccaaggctttccagacaagtagactaggaacattgctgtcatactgataacaggtaattctgcatttgaattcctctacatgaggaaactagcaaagataagtgcctctggaaatgttttctttgaaacaaaaatacagcttgatgtacaactacaattcctccaagaaaaacctcaaagtaaaaaacatcttcgtaaatatcaagcaagaagcgcattatttgaagatacagaaataacatttgatctcattttcttaaggtagagtcagagcatgttaagagctgaaacttttagtacagaaatacacttgtgacccagtgttgttatgttgtcagttcttaagtacatacttataaaatgattttgtttttttatgtttgttttattttaatagtgttcagtctactttaaatattttgtattttaataattagaataatagctttttaaagaaagttattttaaaacatcaaataaaatatatgtttatgagtttttttatgagaagggtattaaacatttagtttcactgaagctaaaataccagtgttaatcccggccctgtagtatgatagaaatatacatgctgaaatagtggtgtagccattttgtcctagtattgcaattgcaaccagcgatggtgttgattatgtaataataataataataataataataataatatcaacagaagcaataataatgaactaaaattgaagttctgggcacaatgccaagctgtctacatgcattatctcaaataattctcacaaccccatgaggtgccattatctgtgttttgcagataatgaaggctcaataatagaacttacccaaggtcacatagctgaagcggcagagccagaacctagaccctggcttccctgtcttcagagctcaccagaggacatatgtgaacagtgatgatttgagaaaaagtgagcggaagtggtaactggatgcaagagtccaggatagtttctagtttagacaactgcatgaatggctgtgccacacatggagacttactattttttttttttatctatctggacttaactgtattaggcagctgttattatatttaatattctggaaaatttaatatacgttacttgaaagttttgagtgtttttgagggaaggagaagagtattgtgtaggtcttcaatagtgtattcttattttcttcctcagagacctgttaaagtttttgctttcttgggctaattttatttataatataagttaaattttatgtgttattcaggttgtctaagttaaaatagaatacaatattctcataattttaaagagtttcttttagttttccatttgtgcaagtttgttgtggcaaattctttcaagtgtcatatattagaaaaggtctatttcactttcattgttggaaaatattcttgctgggtttggaagcatagaaaatctagcctggcattttattttcctgagtacattgttggtgtagaggtgtcactctattgcttctttgaaggtaatctggcttttaaaaattactagtaattttaaaaattatttttaagattttgggccttgtctttgactttcatagtttcaaagtgatgtgtacaggtatgatttctctatatttgtcttgcttgtggtttagagtgctcttgaatctgtagattcatgcatttcattcatttttaacaatttttagactttatctccttacatattgcctctgcctcattgtgtatctttccaccttctttgttttgttactttctggatattgtatcctttggtctcctaatactttattctgtgttgttttcatctgacttattctctctctctctctttctctctctctcttcgtttctctctctctctctctccttttctttccttttttttttttttttttttttttctgagacagggtcttgctcagtcatccaggctgatataagctcactatagcctcaaccacctgggctcaagcaatcctcttgcctcagcctcccaggtagctggaactgaaggcatgcaccactgcacccagattatatttgttttttgtttttgtttttgttttagagacaaagtcttgctatattcttcagcctggtcttgaacttctggcctcaagcaatcttcctgcctcaacctcctgagtagctgggagtggcaacctctgtgagccactgcacctagcaactgtctttttcagttgttctaatctaaatttaaatctatcttagttctattatggtatttttttcaattctgtaatttatatttggcttttcaaatatgctgtgtctctttatacttccagttttctgaaattttcagtattcttgtccttaagtaagcacatttattttaaagtctttgtgtattcattccaatatattggacccctgtaaatctgtttataatgttggttctttcatgttgaattcttttctcagatgcctggttatctttgaatatatgatggacattttattttaaaaattatagaaatgttttaagcctaagttgacaatatcttccttcaaagaagatttcagttttcttcgccaggcttctaggagaactgacaatctaagattcatcttaattgagttttagagtgtgagatttttggggccattgaaagtgagttgcagtttatgtgaagcttgatctttatgcaattttcccttattcctagaatgaagccctttaggttctcagctgaaaacatgcaggttttaatgcggactccatgcatggcatgccctggattctgtcatttgtacctttatagctcctttagattgtcagaaccgcccagccttttagctgctcttttgaatagacaaaccctccctaatcaaaaggagccccagctactgatctcccctgtttggacttttatcctctccaggatcttggctcagtaacttttcactatctttttattgcttaattgccttcaagctgatcatgtttatattttgtctaggtaatctgttgtcctgagaggaggatcatctgaattacttaattacttaattcttaattactataagtcccttataaaagttctttatacattatcatattaacctttgccttacatgttgcagatactttctcagtttctcacttgctttttaaaatgaaaattacatacacacacgctctcacacagacacactccttagtttttatgtattcaaattgctttgcttgcttttttgcttagaaagtgtaatcccagcccaaggtgagctaaatatttattcctattttcttattctttttgtggttttctttcttacattgaattattgaacttattttggtacatgctgtttgcttaagatctgtttctactttatcatccagtgtatgagacttgaatctcttttcccaaaaattttgaaatatggcacctttttcatttactaagtacatatatacatatatatatacacatatatacatatatatacacacacatatatacatatatatacacacacacatatatacatatatatacacacacacatatatacatatacatgatagggcctttttatgtatttttggtttatccattgatctgatcttgagaaaatattgtcttaaccatttaatatcttttccatgaagctgtctttacataattttctttcagcattttattgttcaatttagagtgattattttctcaaatggagattggaggcatgttacatttcttaaaagagtaaaattttttattgtttgaaattttataaaacttggatatttgcaaattgacgtactcaaaatattattttttttccgggggatggtgtgtttctttattatgtaagccacttttaaacaaaaactcatactgaaaactttaaaattttctgtatgtttagaattttctgtgcgaaattatttcatggcattttaatatttttattaatattagtcgaagaatattttccattgtattttctaactaatcatttatggcataaggaaaaagactgatatttgtgtgtttctgtactgaactcttctgttaggtataatagattgtcagtgatttcttatgggttctctaggagaccattttattatcaggaaataatgctattttccttcttaccgtcatttatatttcattgatttttattctttcattgtgttagttgaatagtctacagaagtgattaaaaataagtggccattgcaggaatcctcttattatcccagacctcagaaggagatttttctaggatctggctttgagtattgcgtatcattggcatgagagatattctttatcgtattttcttagtttgctagttttattttgatttttctaatttctcttgtgactttctgtttgacccctgggctgttcagaattgtattgataactttctaaatatttggaggtttttcaggtatctttctgctatttctagtttaattttgttgtgttcagggaacatactttctatgtcctcttaacttttttgaactgcatactttgttttaaaatttaagtagccaataggcactgtacctagtgctccttgaatatgcataccctagagatgccatgggtttagttctagaccactgcagtaaagcaaatactgcaataaagcaggttacgtgaattttttttatttcccagtgcatatcaaagttatgtttacattatactgtaatccgtgtaagtgtgcagatgagcattggctttcatagcattatgtctaataaaacaatgagaataccttaatttaaaaaatattgccaaaaatgtgaatgatcatctgagtctttatccagtcataatctttttgctggtagagggtcttgcctcgatgcagattgctgctgactgatcagggtactggtggctaaaggttgggtggctgttgctgtgtccagaattggtgggttcttggtctcactgacttcaagaatgaagctgcggaccctcacggtgagtgttacagttcttaaaggcatgtgtccacagtttgttccttctgatgttcggatgtgttcggagtttctgccttctggtgggttcgtggtctcgctggctcaggagtgaagctgcagaccttcgtggtgagtgttacagctcataaaggcagtgtggacccaagagtgagcagcagcaggatttgttgcaaagagtgaaagaacaaagcttccacagcgtagaaggggacccgagcgggttgccactgctggctcgggcagcctgcttttattctcttatctggccccacccacatcctgctgattggtagagctgaggggtgtgttttgacagggcgctgattggtgcgtttacaatcgctgagctagacacaaaggttctccacgtccccaccagattagctagatacagagtgtggacacaaaggttctcgaaggccccaccagagtagctagatacagagtgtcaattggtgcattcacaaaccctgagctagacacagggtgctgattggtgtgtttacaaaccttgggctagataaagagtgcctattggtatatttacaatccctgagctagacataaagtttctccaaggccccaccagagtagctagatacagagtgtcaattggtgcattcacaaaccctgagctagacacagggtgctgattggtgtgtttacaaaccttgagctagatacagagtgccgattggtgtatttacaatccctgagctagacataaagattctccgcgtccccaccagactcaggagcccagctggcttcacccagtagatcctgcaccaggactgcaggtggagctgcctgccagtcccgtgcactgcgcccgcactcttcagcccttgggtggtcaatgggactgggcgccatggagcagggggcggcgctcatcggggaggcttgggctgcgcaggagcccacggagggggtgggaggctcaggcatggcgggctgcaggtcccgagccctgccccgcaggaaggcagctaatgcccggcgagaaatcgagcgcagcgctggtgggctggcactgctgggggacccagtacaccctctgcagccgctggcctgggtgctaagcccctcattgcccggggccagcagggccggccggctgctccgagtgcggggcccgccaagcccacgcccacccggagctccagctggcctgcaagcgccgcgcgcacccccggttcccgctcgcgcctctccctccacacctccctgcaagctgagggagccggctctggccttggccagcccagaaaggggctcccacagtgcagcggtgggctgaagggctcctcaggtgccgccaaagtgggagcccaggcagaggaggcgccgagagggagcgagggctctcaggactgccagcatgctgtcacctctcattgccatttctttttattttttatttttatttttacttttttttgagacagactctcgctctgtcgcccaggctggagtgcagcggcgcgatcttggcttactgcaagctccgcctcccaggttcacgccattctcctgcctcagcctcccgagtacctgggactacaggcgcctgccaccacgcccggctaattttttaaatttttttaaattttttgttagtagagacgggatttcaccatgttagccaggatggtctcaatctcctgacctcgtgttccgcccgcctcagcctcccaaagtgctgggattacaggcgtgagccacagggcccggccgccatttcttaaagcagtgaagtttgccaccttgacttttactttcatgaaagatttctctgtagcataggatggtgtttgatagcatttcacccagagtaaaacttctttcaaaattggagtcagtcctctcaaagtctgccactgctttatcaattgtgtttatgtagtactctaaatcctttgttgtcatttcagcagcgtttacagcatcttcaccagaaatagatttcatctcaagaaaccactttctttgctcgtccatagaagcatctccttatccattcaagccttatcgtgagattgcagcaattcagtcacatcttcaagctccactttagttctgcttctcttgctgtttccaccacatctgcggggacttcctccactgaagtcttgaatccctcaaagtcatccttgaggactggaatctgcttcttccaaactcctgttaatgttgccattttgacctcctctcatcaatcatgaatgcttttaatggcatttagaatagtgaatcctttcaagaaggctttcaatttgctttgcccagctccatcagaggaatcactgtctatgacagctatcaccttatgaaatgaatttcttaaatagtaagccttgaaagtaaaaattactccttgatccgtgggctgaaaaatggacattgtattaccaggcatgaaaacaacattcatcttcttatacatctccatcagagctcttgaatgacaaggtttattcaatgagcagtgatattttaaaagaaatctattttttctgagtagtcactctcaatattgggcttaaaatattcagtaaaccatgctataaacagatgtgctgtcatccaggctttgttgttccatctgtacagcacaggcagagtagatttagcatgattcttaagggtcttatggattttcagaatagtagatgagcgtttgcttcaacttaaagccaccagctgtattagcccttagcaagagagtcagcctgtcctttgaagctttgaagccaggcattgacttctctctagtatgaaagccctggatggcatcttcttccaatagaaggctggtttatctacatagaaaatctgttgttttctgtagccaccttcctcagttatcttagcaaaatcttctggataacttgctgcagcttctacattaacacctgctgcttcaccttgcccttttatgtcatggagatggcctctttccttaaatctcttgagccaacctctgctagctgtcagcctttcttctgcagcttcctcacttgtttcagccttcatagcattgaagagagttagggcctttctctgggttaggctttggcttaagggatgttgtggctggtttcatcttctgtccaaaccactaaaattttcttcatatcagcaataagactgttgtgcttttttgtcgttcaggtgtttcctggagtagcacttttaatttccttcaataactttgcctttgcattcacaacttggcttactggctggtacaagcatcctagccttcagcctatctcagctttcaacacgccttcttcagtaagcttaatcatttctagcttttggcttaaagctagagacatgcaactcttcctttcacttgaacacttagaggcccttgtaggcttattaactggcataattttaacattgttgtgtcttgggtaataggcaggtccaaggagaggcagagagacgggaatggccagttgatggagcagtgagaacacacacacaacatttattaagtttactgtgttacatgggcacaattaatgcagccccaaaataattacaacagtaaaaacaaagatcactgatcaaagatcaccatgacagatataataataatgcaaaagtttgaagtattgcaagaattagaaaaaatatgtcacacaccagaagtgagtgcatatgtttggagaaatggtgccaagacagacttgctccatgcagagttgccacaaacccttaatgcaaaaagcacagtatctgcgaagctcaacaaagcaaggtatacctgtattcattttcttttgctgcgtaacaaattcctacaaacttagcagttgacacagtacttactgtcttgtggttctgtaggtcagaagcctgacacaggacctggctataatgatgatgtcagcaggtctgtcttctggaggctccaggggaaattctgttttcctgcttattcaggttactggcagaatttagtcctgtagctgtagtcatcatgttcttgtgagctgtcagctgaagtccattcccagcttttagaggctaccatgttctttggacgggagctctctttctccgtcttgaaagccagcaatggcaggtcaggtctcatttcctgtctctctcctgcctcttcagttgttcaatacctctgacttcagccctaagagattctccattgttatgggattgtgtaattaaatttgaaagagtcctgcagtaaccgaggataatctccccatctcaaaatacgtaaccatatcacatttgcagcgtcccctttgccacattcagaaacatttacaggttccagaggttggggtgtggccattttatagggccattatttcacccaccatgctgccatattggacagtacaactttacactgtattatcttttaaacggtgaaattttgaagtgataaaattcttaaagttctttttataattttattattgtcattttcagagctcttcatttatatgtatagatccacatttaagttttaacatttcagtataggcctgaagacaacgaattctctcagcttttgtttttctgaaaaaaatcttgctatggccttcatttttgaaagctaaattatttctcaatatgaaattctgggttggacaatttttttttctttcagtagtgtaaaaatatcacaccatggtttccgttgagaagtctgctttaatttttatcttttattctctgtgtgtaatgtttttctaccctctggctgctttcaggattttctctttatctttggttttcagcagtttgaatatattgtctaaattctttttctcccttttcttctttttctcagtattttttttattctttatgcttattctttcgtatcatattcttaatcatcctagttatgggttatttaggctttttggatgtatggtttgttgttttcattatttggggaaaattcttggccattatttttttcatgtatttctactaccctgtttattcttccttttcctgccggttccttgtgcttatggcggggactgggactctgggggcttttctcagtgctagtgcccctgctcagcttgcagcctcctgcgccataggctgggggagtccctgcccacctcctcaccgcccccctagcagtgggctgctgctgcttcccccacagggctgggcttctggatggggtggggaggggagggttgctccatctcctggtccagcctcagtcttggcggtccctgtgtttccagcccctcccccatggcaagggactgaaattttattggtgtgggattttggtctcaggacagtttcctgcctcccctggggtagagggtgtcctcctctgttcttctcccggctgcagggtgtttctgtctgtccctgtggtgacatctgctgccctttccctatcagcttaaagcccaaggctttgctcagggggaggaagctctcagggagagttggcttcatgcctgtccactctgcttacacgcttggggcacttctctggcctcgtcctgcccctcatgtgagcacctggtgcgggcccatgttaaagagcctgtaagtgagtgtggactccctcagcccatcctaattcaaaggcagaagatacacatgtaaacaggcaaacagggcattctagattatgactgtaaagaagggtggggtgggcaggacagggacaccgaccttaggtagagtggaggaacagcccagaggtaacactggtgcggtgagttgaaggttgaaaatgaccctgtcatcttgagagttgggtgtagggagggcttttcatgctgaggagatggcaagtacaaatcccaggggcagcaacgagatggggcagttcgaggaggagaaagtttaccgcaggctgaagcggagtgagtcaggggaaatggtgtagagggaggttggagagttgtgagtcagatgtccctgcagtcttttggccatgttaagatgcttgaattacattgcatgaggaatgggaagaacttggtgatgatctgaatgtagcttccttttgcttgctaagtgaattccagtctcttctgctttgtgttcaaggcctagagtaacctggttgtagaataccttttccatcctatctcccactctactaatagatgaacagcaaggttggcttcctgctcttaggtgagtcttatgcattttcctgctcaccttgtcatgctgttccctaactggaaaggacttgtccctctctgcctgtctctgtaggctttagtcagatgtgctgctgccacgaaacttctcccaggcatttccttacctccatcttcaccagttgttcccacatctatgtggtagcttcttgagtatacctgtttatcacacattatttgtttaatttgtttaattaatttttaaatttgttttatttaattaatttttctgtcttgtatctttattctggttctctctgccaactttcactacctgtttataaacacactcaaccctcccatatcctaaagaagacttcccttgccctcctttcccctgactctgacgtcttgtctttctcttttactttacagccatatccccaggagagcgcctgtatttgcgggccctgcgcgtcctcatgccctccttcactccttactggtatatgatagggtttttacctccagaaccccgctgacactgctttcagagataatgatgtcttcctagtcccagtgaccaccaagcccagggacctcttgttaattttcatctgtgtatctgaatgtgatattcaacactattggccacatcttcctttttaaaagtttctaaacccccacttcctggctgttccactatcacatgttttgtctcatctttctgatttccccttgtttctttttgtttctagctcacccctaagtgtagggattacccatccttctcatgtcagacctcccctctccacagcatattctctttggcttatcatttatgtccttttacaaaaacagctctcaccgcatattcccagatctgtgcctctagcccagacctctctctagagggaaaaaaaaagaatgtgcacgtacacttaatgtatcataattttcatattgctgtgtaatctttgtaattattttaaatggatgtataatgttatgttaagtggctgtgccataattagcctaaccatttcctattgaaaatttcttgtcctgaatttccagctacagtttacaattctgtgcatgtatattgagtttgagattgatgcctgagttcagggtagcattttaactcttgcacaaactactgaaaaaagccttctgaatggcctcctggtctgatctcttgaccttctggccgagcatgatctcaattgttagaaaacaggtactacttatgttcctaaggcccaaaagagatctgaagtttttcagctgacatgtctctgagtaaatctgaaaagagatttatttggaggttcaccttcaatcaagacaggattttaagcacactctgagctgtggtttatcatccctactacttaccataagaatatgctttaccacactttattggcaactaagatgcactcttgagccttttaatctgtttgcttttaatctgttactctctagaagtaatcctgaaaaacagctgacagtgatatttcaaactcgttggtgctcttcttcaaagaaacatagaagccctaataaatagatttgtgccttggaaaataaagtgtcagtgacttcacatagaacacaggaatcttaacttatacttccccaactattctttttttttttttttttttttttttttaacaaagtggcccctgtggtctttctaagctgttcttgactccctaactgatgaagagtgctggctttcctttcgaagcccaggtcagtggtctgacaggggcagtgctgctgattttggtccctctcctgagtgtgctttgtatctgttatatgaagtcgtgtttggatttttgatgtgttgatacctcagagtttctgcttgattttcagtcattaccggtagcacactgacaagtgggagaatacagttttcagtggctgcctgactcctattttgaatctttctcttcccttcccaatctgactgtaagttctccctgtgtaaggagagagggttgtgtttcaatgctggtgtacaccaagtatgtctaaacttagtaatggtaaaaacaaacatgcaaaatgacaacatttctggaatcagggtggtgaatagaagccagtgtacttcctctgaggcagaggctcgcggggggtgctggttggtggggttggtggggagtgatcacattgcataagctccatgtgaatccttgggctgccttctactgcttggtctttctctttgtgtcctctaatgtattttatatttaattcaccttaacaacaaattgcctttaaaatgatggaaaagcacaagtgctaatggtgaacagctgtctcctccttctcttcataccaattttatttctgctttgaagcactatggtctatgcatcctcttgactatgttgtagatatagccacaaggtttgatgattgtgctcttttctatagataagaggacaagagaaaataactccagtcactctttaatagatagatttaaaattaatcaagatgagggtaagtttaaaaaactattccaggtatttcattatctgaaaacccaagggtctgctgccttccactctagggccttggttctcgagagaaggtatttgtctataattcctagcctgatggtttagctgcccactctgagctgttcagccccagatcttgagaatcaaggggtggagagtgaaaaatgtatggagaggcaggcaccttgctttcacttccacctctaaaatgatagtgcagtattcttctcacatatgcctgccatcgtccttctgtttgcatctctcacatcccctccactagcctctcccctccttacaataaaaaaaaaagtccttgaatttagactgatccaaggtccagggtcatctcactacctcctcccctcccaagcaccagtggtagagtgggctttatcccttgaacaaggacagtgaacctgttaaagaaagaagatccaacaaaatccagaagaatgaacacaactcaaaaaagactgtcaggagtatgttctcagctgagtgctgagtgagatcaccattccccatgatctcaggcagtagaagagccttgagaatgtggaagacaggcccaaattctgccttaaaggaaatattactccagaaacacaagtgtttttaagtgcagaactaaagatcataaatgtatttaagcaagagttcaaacttaatatgagacaataaaatgagatgaaatgggaaatatggaactaagggaataaaatgagaacaaaatactatcagtccaaaactaatgaataaatatgaaacagtaaagaatttaatggtgtgacaattcagttgtcaacataagagaaaagctttagaaaattgtagagaaaacaaaaggtaaaaaccttttccctaaataaaagaactttattccaaaaaaagttgaccagaaaacgtatatgaagatatcatagaagaaaagttttctgaggtgtaaaccaaattgccagaaaacaagggagtatgcaaagttttgaagggaatagcaccagtcaagtgttaaaattaaatagataactaagtataaacaacgatacagataaaatgtaagtgttataagctttgacaaatgagagaggaggtcatctatatgtaaaatcaaaacgtgtagttcaaaagttccatttaacatatgtgtttttccaattcttaactcccagtagatttatagaaaatagtttctcttataaagaaatatggatcttaagtttagcaattcctttatcttaacttcaatgtcattttcttttaagtacaaggttacagtttttgttgttgttgtttaaatcacatacagtatttctgggttgaaattttgcatttttctttggagtataagacattatttaattttgaataacataactttatctaaaaataaaagtttatcttaaaatgtttgtgaagcagagcaaaacaggcatacctaccctgtccaagactctggttgaataggtcctggatggggcctgacatgggtagattatttttaagtccatggtgtttcagctctgctagcttctcatccaagtggtttctcatctctgtttttgtatttattttaatagcctcctggctttcacctttatgatacccacatctagcttttggaagtggatagagagactactcagcccaggttgatgagcatcatttttcactttgcctacttgcctgatagagttaatgagagtcaaaaagtgcatcactgactttcttacattcatcttaataagggaaaaccagtgggaaaacatcatttcatgagtgagtggattggagaataaaaaaatgtttgttcaacattttgtaaaagtgaataatactgatacttttttctattgttctttagctcaaatattttagttatgagacccccttttgtttttttttttattatggtgggtaaatatatctttaatggaatagtatgcatttttttcattaaactatgatatgagagcatataaactgatgtcacaatattactagaatatttctaatgtaaattttattctcaataagtagttattacagtgtagacattttggtctaatatgaatttcaaatatgtacgttgcaacagctatttgaaaatagtggagaattaagtagttggctttctacaaatagagtaatatacgattgaatattttttgttcatatgcccaacaatccaacaaatggaaaccaaagtaaatcatggcaagtaattattgctcaaaaatacagtagttgatagattgtgggcactgtcacttaaatactgatttatttccaacacaactagaaattaaggtgatttcatttctcttgcaataagttttaccttctttctgcctatctccctacctgcctacctgccctacctattgctaatgacaaagaaacatagccattgaatattttgttgagttaaagtggtgattttttttaaaccaaggcccattacaaccttatgactttttaattttgttggtaagaaaccacaaataagtggattattttagtttcataattttctgttcattgatataattgctacatcagcaatacttcatggctgtcctgactatggtctgctctagaaattatattagcagccccttttctcctgaaaatatcagttttgcatacttagaaatttgctgaaaagtttgttttaaaagaaccttaatgagataagacagtcaaatactcagcattaaagggttgaattttcttctttttggccagccttctcagactgttgtgtagacagagtcctcaggtattgctaccaagccaatctaggtccatttgtctgcacacaatgaaaagccaaacactgaatcactggatttttatagagagaaagattaatggcaaggcagccatgcaggagatgggctcaattctgtcttcccttaccagcttaaagcagtatataaaaggaggagatgctggaggaggagttttggggttggttaatgattgttggaaagggaggggaggtttggaaagtcccttgagcaggcacagttgtctcttcgtgcttcctcatgggttgcctttgcaaattcggagggagttggtgtgaaacctgtggtgaaaatactggctttgatatcagaaagtccctcatctggcaagaagtctattctgtgcagatcccaatcagccataccagttccaaccagcttcaaccagtcaaccagttttgttacaagcagagggagttctaacaagctgtttctttatctgcagtgctgtaagacaagctcaaaacttcttgttagttaccagtttctttaaccccatggagcactgtttaagtatgatagtgaaaaggggaaagataattcagttttgaaagatctagttccaggatgttgattattcaagaaaggaacataagcattctagaaatgcacacttaggtctttgaatgagtgtttcaatagattttgattggcatcattgttcaatttccggaatgcagaagtgcaattttatttaaaaaatagactttccttaaatactttcttcacttgtcataatgtccttatgatagtaatcttaattttcaaaaaattatagttggtgtatgtacaatgttaccaattgtttgttgttgttgttgttttttccagaaatcttacaggctggtgttaaaggaacttcggaatcccttaaaggtgtgaaacgcaaaaagatcgtagctgagaatcacctgaaaaaaataccaaaatccccactgagaaatcctcttcaggcaaaacataaacaaaatacagaagagtcatctttcgccgttcttcatagtgcttcggagtctcacaagaaacagaattatattcctgtaaaaaatgggaagcagtttaccaaacaaaatggagaaacacctggaataattgctgaagcctcaaaatctgaagaatctgtctccccaaagaagcccttgtttctgcagcaaccatctgaactgcgtagatggagatccgaaggcgctgatcctgccaaattcagtgacctcgatgaacaatgtgactcaagttccttgtcaagtaaaaccaggactgacaatagcgaatgcatctcttctcattgtggcactacgtccccctcctatacaaacactgcattcgatgtcttactgaaagcaatggagccagaactgagcaccttgtcacaaaagggctcaccttgtgcaattaagacagaaaaactgaggccaaataaaactgcacgttcccctcccaaattaaaaaacagttcaatggatgccccaaatcagacttcacaggaattggttgctgaatcacagtcttcttgtacctcatacacagtccatatgtctgctgctcagaagaatgagcaaggggcaatgcagtcagcttctcatttgtatcatcaacatgaacactttgttcccaaatccaaccaacataatcaacagcttccggggtgttcaggtttcacaggatcactgacaaatctgcaaaatcaagagaatgccaaacttgaacaggtttataatatagcagtgacatcatctgtaggcctaacttcaccttccagtagatctcaggttactcctcaaaaccagcaaatggattctgcttcacctttgtcaataagtccggctaattctacacagtcgccccccatgccaatctataattcaactcatgttgcctctgttgttaatcaaagcgtagagcaaatgtgcaatcttcttctgaaagatcagaagccaaaaaaacaaggaaaatatatttgtgagtattgcaatagagcatgtgcaaagcctagtgtgcttttaaagcatatccgctcccacactggagagcgaccctatccctgtgtgacttgtggattttcatttaagactaaaagtaatctgtataagcacaagaaatcccacgcacatactatcaaactgggtcttgtcttgcaaccagatgctggtggcttgttcttgtcccacgagtcccccaaagcacttagtattcattcagacgtagaagacagtggggagagcgaggaggaaggcgccactgatgagagacagcatgacctgggcgccatggagctgcagcctgtgcacataataaagaggatgtcaaatgctgaaactttactaaaatcaagcttcactccaagcagtccagaaaatgtgataggtgactttttgctacaggacagatctgcagaatcacaagctgtgacagagttaccgaaagttgtggtccaccatgtcactgtgtcccccttaagaactgacagtccaaaggccatggatcccaagcctgaactttctagtgcacaaaagcagaaggaccttcaggtgacaaacgtacagccactttcagccaacatgtcccagggtggagtctccaggttggagactaatgagaattcccaccagaaaggcgacatgaatccactggaaggaaagcaagactctcacgtaggaacggtacacgcccagctacaaaggcagcaggctaccgattactcccaagagcagcaaggaaagctcctgagtcctcgaagtttaggaagtacggattctggttacttttcacgttctgaaagtgccgatcaaacagtgagtccaccaactccctttgccagaaggttacccagcacagaacaagactctggaaggagtaacggaccctctgcagctcttgtcaccacgtcaacaccctctgctttgcccacaggggaaaaggcattgcttttaccaggtcagatgcgcccacctttggccacaaaaacacttgaggagcggatatcgaagcttatctcagacaatgaagctttggtagatgacaagcaactggatagtgtgaagccgcggagaacctcactgtcaagacgaggaagcattgattcccccaaatcatacatatttaaagattctttccagtttgatttaaaaccagtgggacggagaacaagttcaagctctgatataccgaagtcacctttcacccctactgaaaaatcaaagcaagtgtttcttctgtctgtaccttcacttgactgtttacctatcacaagaagtaattccatgccgaccacaggttattcagcagtacctgcaaatataatacctcctcctcatccactaagaggaagtcagtcatttgatgacaaaattggcactttctatgatgatgtctttgtatcgggacctaacgctcctgtgccccagagtgggcatccccgtacacttgtgagacaagcagccatagaagactcttcagcaaatgaaagtcatgttcttggtactggacagtccctggatgagagccaccaaggatgccatgctgctggtgaagccatgtcagtgaggagcaaggcactggcacaaggcccacatatagaaaaaaagaagtctcatcaagggcgagggacaatgtttgagtgtgaaacttgtagaaacaggtataggaaactggaaaattttgaaaatcataagaaattttactgttctgagttacatggaccaaaaacaaaggtagccatgagagaacctgagcacagccctgtgcccggcggtctgcagcctcagattctacactacagagtcgctgggtcctccggcatctgggaacagacgccccagataagaaaaaggaggaaaatgaaaagtgttggggatgatgaagaacttcagcaaaatgaaagtggaacatctccaaaaagttctgaaggccttcagtttcagaatgctctgggctgtaatcccagtttgcctaaacataatgttaccataagaagtgaccagcagcataaaaatatacagttgcaaaactcccatattcaccttgttgccaggggccctgagcagaccatggatcccaagctgtcgaccatcatggaacaacagataagttcagcagcccaggacaagatagaactgcagagacacggaactggaatctctgtcatccagcacaccaactccctgagcaggcccaactcatttgacaagcctgagccttttgaaagagcctccccagtttctttccaggagctgaatagaacggggaagtccgggtctctaaaagtgataggaatctcccaagaggaaagtcacccttctcgggacgggtctcatcctcaccagcttgcactatcagacgctctcagaggagaacttcaggaaagctccagaaagagtccaagtgaacgacatgtgttaggacagccctcaagacttgtccggcagcacaacatccaagttccagagattttggtcacagaagaaccagatcgagacctggaagctcaatgccatgatcaagaaaagtcagagaagttcagttggccccagcgtagtgaaaccttgtcaaaattgccaacagagaaactgccacccaaaaagaaaaggctccgtctggctgagatagaacattcctcaacagaatcgagctttgattccactctctccaggagtctaagtagggagagcagtttatctcacacttcaagtttctcagcctctttagacatagaggacgtttctaaaacggaggcttcccccaaaatcgattttctaaataaagccgagtttcttatgattccagctggcttgaatactctgaatgttcctggatgtcaccgggaaatgaggcgtactgcatcagaacagattaattgcacgcaaacgtcaatggaggtctctgatctcagaagcaaatcattcgattgtggaagcatcaccccaccccagacaacaccacttactgaattgcagcctccatcttcaccttctcgagtgggagtgactgggcatgtgcctctcttagaaagaaggagaggcccactggtacggcaaatatctttaaacatagccccagatagtcatctgtctcctgtacacccaacatctttccaaaatactgctcttcccagtgtgaatgcagtgccatatcaggggcctcagctcactagtacatctttagctgagttttctgcaaatactttgcactctcagactcaggttaaggatctgcaggcagaaacatcaaactccagctctaccaacgtttttcctgttcaacagctctgtgatatcaatttgttaaatcaaatccatgcaccgcctagccaccagagcacacagctatctctgcaagtgtctacgcagggtagcaagccagataaaaattctgttttatctgggtcttctaaaagtgaggattgctttgctcccaaataccaattgcattgtcaggttttcacttcaggcccatcttgctcttctaatcctgtgcattctttgccaaatcaagttatttcagatccagttggaacagatcattgtgtgacatcagcaacattaccaaccaaattaattgacagcatgtctaattcgcatcctctgctaccaccagagctcaggccccttggaagtcaggtgcagaaggtgccatcatcattcatgctgcccatacgcctgcagagtagtgttcctgcttactgttttgctacactcacatccctgccacaaatactagtgacccaagatctgcccaatcagccaatttgccagactaatcatagtgtagtgccaatcagtgaagaacaaaattctgtgccaacattacaaaaaggtcatcagaatgctttgccaaacccagagaaggaatttctatgtgaaaatgttttttcagagatgagccaaaattcttctctatcagaatccttgcccataactcagaaaatatctgttggtcgactttcccctcaacaagaatcttcagcttcgagtaaaaggatgctttccccagcaaatagtttagacattgccatggaaaagcaccagaagcgggccaaagatgaaaatggagctgtttgtgcaacagacgtgagacctttagaggctttgagttcgagagttaatgaagctagtaaacagaagaagcctattttagtgagacaggtttgtactacagagcccctggacggtgtgatgttggaaaaggatgttttttctcaacctgaaattagtaatgaggctgttaatttgacaaatgttttaccagctgataattcatcaacaggatgctctaaatttgtcgttatagaacctataagtgaattgcaggaatttgaaaacatcaagtcatccacatcattaactcttacagttcgaagttcacctgctccttcagaaaatactcatatttctcctttgaaatgtacagacaataaccaagaaaggaagtctccaggggttaaaaatcaaggtgacaaagtgaacatccaagagcaaagtcaacagccagtcacttctctttcattgtttaacatcaaggacacccagcagctggctttccctagcctgaaaactacaaccaactttacatggtgttatctcttaaggcagaagtcgttgcatttgcctcagaaggaccagaaaacttcagcctatactgattggacagtaagcgccagtaatccaaatccactcggtttgcccacaaaagttgcacttgctctccttaattcaaaacagaacactggaaaatcactatactgtcaagcaataactacccattccaagtcagacttattggtctattcaagcaagtggaaaagcagcttaagcaaggtacttgaaatataatttatcttcagatatggtttgcgcaaatttgtttccatgtgtcttgatacctttaaatattttaactggaaatattttaattttgagtgacaaattgtgctgtaaatgtcttatttgaaagacagggtgatatatttaccccaggagttacattgataagagttaccaagagtcttgcagtgattctatcttgaaagattttagaaatgatttaccctgagcacttttctttttctcagctaactatataagtctttacttagtagtacagatgatcatggttttactttgatgttttacttatattgaggttttgtttttcttgttaagtgaaaggaaatcatggttatgctttgttcctcctcatgcagggaaacaggtgtagataatcaaagatagttgtatttcatcctgaaatataagcagaaagccatttagacttgtcttgagcttactagctacacgcccctgtcatgctatgtagctgtcttccagtgtagctgtgagaaccattagcactagagagaagtttcacaaaataattcatatacttggtaagttgatttggtcaagatttataaagtaatttaaggtcatgaaactgtaacttggggtaatttgtggaatcagtctcattagaattatcagctttataaaatgggaaaaagtcatttacttgattagaataataggtaagcatatcacgttcgactctgcatattcagaagtatttggcctctgcagattcataagcatgcaacacaggttaataaacatttacaaatctgtcagtaggaaaatactgcagtatcagtattaccatagaattatgaacaattctaaagaaggaagtttctaacattactggtaggtggaagagagaagaattcagcaaacatactccaaaggtggtgatactttagctaactgttcaaattttttttaaaaaaatagggatttttcaggcaaagaagaagcagctttttttttcgagacagaatctcactctgtcacccaggctggagtgcaatggtgcgctcttggctcattgcatcctcccctcccgggttcaagcaaccctcctgtctcagcctcctgagtagctgggattacaggtgcccaccaccacgcctggctttttgtatttttggtagagacagagtttcgccatgtctggtttggccaagctggtcttgaactcctgacctcagatgattcacccatcttggcctcccaaagtgctgggattacaggtgtgagccaccgcgcccagcaagaataaaaaaaaaaattaataatacacgaaatgacatggaaatgagaataaacttggttcatttaaagaactctgaagagtctggcctggttaaaaagagttataatttggaaacataggtaaaaatcaaatcatgtgtatggtggtggagaaccaatgatactttctcagtgaaggaaagtgcatccaaaccacctgtggaatttgttaagttctcaggctctaaatctactaaatcttggaagttaagacctaatagttagaatttaaacaaaactccgtgtatgttcctgaagtgtttgtggagaagagaagtggctctccttgagtaccaaatgccttggaagaaatgtctggaaatgcatatctagatttggagcttaggagagagctctggatggaagtgtgtagagtagagattcttttgtgtagagtagagattctttagtgcataggtgtgattaatgagattgctcagggtataaagaagaggagagagcctagactggatactggggatcactactatttaaaaagttgaatggttgaagaaagtccacactcctgtatggaaactgaaagagtttgatcatagaggaaggataagaatgagcagaaagtggcatcacacaaaacacagaagaagatattcaaggagagttgttaggtcaaataaagttgaaggcaaatgggtatatctggactgcgcagatcactggagagttgagtctatgagcaagtggctatggagcatggattactgggcttttatccacaactcaaatgttaatgcatttatgattcacaatgggaaagaacagatagatgctataaagtaaaaggatttctaggcaaaacatggcattttcaacatacaatacatagagtgctcaagcatgtaaagactaagattttggcatttagctcattgataactttggcaagtagaagccagatttaatagtacgaaagtgagcaaaagataaaggggaatttgatattgaaaataaagaggattactgttaaagggataaagtcaaaggaaggtgtgtgcatatattctaaattatgcggaagccaatctgtttgccaggaaaagagaaggaaaggttgcatcagtagctcttccctctgcctttttgaggaacatgggccagcagcttttctttcctcctgcctgtgtaaggatgggcctcccaaggtactattctgaggccacacatacccctctccataatgaacagactcttatctcttagtattattaagtcatttcagcaccacagctgtctgcttgacaatgtaatttcttaaaggaggtttgtataaaagaagcccttggtaggaaaagttgtgcgttgcgttggattcagccagaggattagagtttgagcctttacttaacacttgacctgggacaaggaacttcaccctgagagcgtccttcctcactgggatatatagtccacctgtgctgcctgcctcacagggacctgagagaatggaatggcactataagtgagacaacatactatcaaatgggtagtagcataaaatcttacataaaatcataaggtggtattatattattatattgttcctataggaaaaccacacatcgtttatcattttgattttgacgttcgttaccttttttccagagacttaattgttaccaagccaaaacctaactttttggctagacctggatgccacatttatcagtattcagtaaacttttgagaagatagaaagaattatggttttagctgggcatggtggctcatgcctgtaatcccagcactttgggtggctgaggtgggaggatcacttgaggtcaggagtataagactggtcggtgcaacagagcaagacccccatttctataaaattttaaaggtagccaggtgtggtggctcaggcctgtggtcctagctactcaggaggctgaggtgggaggacctcttgagcccaggagtttgaggctgcagtgagctatgattgtactactgcactccagcctgggcaatagtaagaccccatgtcaaaaaagatttatgatttaaaataatggaggaagaaaaagtaaaatattgggaaatggggcttctgctttaccttataatgcactgaagctgaaggagacttaatgatgtttctaatgggtatgaggcattattttaccaaaaggagtagctagctcttttccatctccaaaagtaaactctttaagaaatgtacttaaatggtagtatgagtggctggttaaatggaagaaaaaatatttagtctactaaaaaaagtttctgttaaacttaagaaataccatggtataggaggttgtaaagcctttatttgggggtgtcagtgaactgtggtggaattttaaattaacataagatttatcagtttgctgtgattgagacagattcataagggaggagataaagtaaatgccctttgaacctattactactttgaaatgcatttcgttgaccatatgctctgtactctgccatgttttaatttccagtgaaagattagcatgcttgtgttttcagttttattaaattagtttctctcttttttcctttcagagagcattaggtaatcaaaagtccacagtagttgaattcagcaataaagatgcctctgaaattaacagtgagcaagataaagaaaattccttaatcaaaagtgaaccaagaagaattaaaatatttgatggagggcaagtacaaattttacttcttaaatgtacatttaaactgactttttaaatgtacatttgctttcatgtgaatgaagacttagtgccaatttagtatcgatgttgcaaggtttctcagcatattaacagaatctccatagcaaaatatgttaacattatgttaaatcattttattttgatggagaaatgatgactatttgggaaatactgtacaaccttgaaggcagctaaaaactaaattattagagtgaaccttggttttcacattgatttacagtaaggaatgacctagagaatctgctctcagatgaattcattgcccattagatatctttgtgtattttgttgtgaacaaaaacatcataaaagccaattatagttatagtaaagctccaaaatatttcagtacttaaaattattgtggttgaatttagcaaagaagaacaaattttaaccaatgacttggaaacagggaagtattttaaaattacatgcagtagtgcagcgcagtggtgcgcgcctgtagtcccagctgttcgggaggctgaggcgggaggatcatgtgagcccgggaggttgaggcttcattgagctacaatcacaccactgggctccagcctgggcaatggagcaagactgtctctaaaaaaaaaacaaaacaaaatataatattgcaaaagtttgtttgattagaattagctatattaagtgttgatgtaaaaagctggaatattctgttacacatgcataaaattgttattggttgagtataaaagttgtgccttgttttatctttgggttgaattttaatcatcaatattttctcagaggcatagtgtccaatctccctattcattttttttctttaaattagatataagtcaaatgaagagtatgtatatgtccgaggcaggggaagaggaaaatacatttgtgaagaatgtggaatacgttgtaagaaacctagcatgttaaagaaacacatacgaacccatacagatgtccgcccctaccactgcacttactgtaacttctcctttaagactaaaggtatgagatgcacattgcttcaaggtccttttaatatgtatttaggtgggaaagctaaaacccaactgtgcgttttctttgaccgatgaaatagcagcttaaatagactaatgtcaattacatcttgtcaatgttgtagtcttattactttatatgattttagacccattgggaaaagtttttaattgtacacttttagaataaatatataataaatataatatttttaaaagagcaactgccctttttaaaaaacttaactccttaaattgcagttgtacaacatgatgactaatataccttttcaagaatatttaatttggggctgaagaataaaaagaaattttcatgatcacaagtaaattcgctgggtgctaaaagattgaagaaagatttaaaataataactacagtaaacttctataataattacacttctgttttattgtctgattttaggaatacatagccattttttttcacaatgcttttttttacataaatactgttaaattttagcttcaaaaattttctatagtttctattaatgtttataaagaagtctcagaactaatcattaaaattatatttaggaccctttctggttttttaaatatgtttttatttataagcctcactcatagttaattttgccctgtacaagtttcttgatacatataataggtatactactttaaatgtttgcttcctccgtcaggctccttattcatgaacaatttattacttgagattttaattttatatgccactctctaaaaaccaaagatctctctttaacaaagcaaggtaatcgtgaaaacatgtctgagaaaacagtaaaaaaaaaaaaaaaaaaaaaaaaaattaattgatttttaaaaatagaaacaacttttatcctttgagttaacatttacttttttcttatgctggttgtctttgcagtttttgttttaaagattgatcaacttcttagcaaaatttattacattttttggctagtatttatgggcatttaaagagagttataacttgtaacaactacatgcttcaaattagtactctttaagtgccagtggtgtctgaaacaagaatgatggaaaaacaaaatattcttcatatggctttgaatatttcaaaaaagtttcaagaaatgagagaggttgggagggatactcaggatgcagttttttaattgtgatgtagaacctccctctgtcattggagggtgagtttaaggatgattttccttcctggtcctgagggaggactctgatagggtaaagtactttggtcttttaactgaatttattgctttttcactcattttgatcctatgattaagaaacatctattagcttcctttatgagacaagaagcatatttagaaagctaatattactaataaaagattatcatgtacaaaaggatgttatcaaatacaagaagatcaagatacaatgggaaatgggtatttctcaatagaaagaagaaaaagaatgaggctatttaaaaaatatttatcaagtaagggcaaaaaaggaaggacaacctagatgtggtaaaccaaatgaaactacagagatttcttggcaaggaaaaatatgatgagtcacaaatattaatcttagtgaaattaactcgaagattttagataaatgttaactaaatggtggacagtccataatgacccctgaagagtgagcattgcctgttagcacttttcatgtcttacacatctctaatatgctgtatatctgaatttgcattaaatttgttgttttgtaagatgtcatgtggaattatatggtaaatatttatttgaaggaggctatccttgctaaggagactggtgaagaaaatgttagaaattcaggatttcccttttcttggcatgacacttctcttttttttacggtcagcttcctttttgaagtctactttttgtgaatctatgtaaaacagattccacagcaccttttaaaggtagttaaataatagtagacctttttttgaattatgccccagattttcaccttctctgatttacttgctatactagccagtaggactccacttattattgaaagtgtcgggttactaacagaaggaaatagtgatgtgatggcatgctgtataaatatggtatgcaaagacagcaaaacgctctcagaaaaatgatctgtagagctaaaaattgatgcttctgatggtaatgcttacaaatccataattcattatttgccctctgagtttattttgtgagtacattttcaaaataattttaattgatttgttttcatgattctacgttaaaggtcagtcagcagaaaacatatagagagcttgtatctctgcaagatttagtctcatttatatcacagaaaattagactgcatgtagctctaggagtcaagaaacaaaacctctcatgctttccagaggattcagataaatgtttattaaatctatcagaaaaattatttattaaattaacaccaggtttataaaattgctaggagatatttgcatttcaatatgggcacactttcaatattttgtatattgaaatgcagatttttgtttattttacattaggaagttgattcataataagtaatagctaaagttatgagaaaatatgcttactaaaaacttatatttctgaatttgtctagttacaattatacattagtttcttaaaaagtaaataacctgcaatggctgtctatctagggagcaaaaacattttaaaagagggccaggtgcggtggctcacacctgtaatcctagcactttgggaggccaaggcaggcagattgcctgaggtcaggagattgagcctgggcaacatggtgaaaccccgtcttaactaaaatacaaaaaattagcctggcgcagtggcaggcgcctgtaatcccagctacctgggaggctgaggcaaaagaatggcttgaacccgggagatggaggttgcagtgagctgagatctcgccactgcactccagcctgggcaacagtaagactccgtctcaaccaaaaaaaaaaaaaagaggactatagtggaccttataatttggtttgtaatattgttagtattaacacactgaaaacattttgacttacaagtggaaatttcaaccacagtaagatatctaaaccatttttataatttcttaatgtgaaaactttaaagctgtcacataaaagtagagatctgtataatgaacaccattgtgtgcataatcttttaataattgctaagattttgccatatttgcttcatatttttttcagtatatttaatgtaaatatcagagatagccaagtgttaatccaggtgttatctccagaatcacagaagtcagggtttgatggaccttagccatcatctggtctcggcatcctcttaagcctgacctccttaagtactaagctctggggtcctgcgtggttggctgagacaagaatgtactatgtagtgcaagaatcagcttgtacagggatgaccagtttcacaggcttagtgcatttatcaggaaattgaatagatatagctattttccatgtgcttcggctactgcaagcccgaaatttggaccaatgattcagacattttgagctcttctaaagacttattctcaaatactactttgcctctgcccactaaattcaacatttagagttgtttttgtttctcaaaaaagatgacttgcccttgttggcaatgcttttgtgtatggcattatccactggagatgcttgttatcctcagaagaatatgagctgtttcccctggattcagtgatcacttgaggcaggtgtgctagtggttctcagctagcatggtcatacttaaagaggtcgatacaacagctgccagaggaaacactcctttactggtactattttgagacttatactctgtatgtgaaatgaaattaatacaggaaatgctttctcttattccagaaatactgtttataaaattacaatgacccaaaatagtttttcatagtcaagcttgaaactttaaaaggtgaattccaaggtaccagaaaaaagaagctcaaagctaacatggtgaacagatactaacaaaaaaattaaaaggccttatgggaatcgaggccagatatatgcctacaggcttacctgtcctgagatagcatctgaggttcctgaaataagcctagtcctcctgtccagtgactttgggccatgtgggaaaaaccctaaccgcttaaaagtaaaaccctatatctataccatgcaaaaacaaacaaaaaaactggcccagagtcagttgtctgaagccaatgaaactgttaaggtcccaggcagaagcaattggaaaactgctttatagagatgtttctgcaacccagggtacttaggattccatggaaaacaatcttgctgaggataaacttacaattaaaagtaaaaagcatgcaaagaaacaaatgagaaagagccagcagtcataacaagtggagaattcacactccaagaactacagatcatagtgtagtctgaacgggactttaaattaagtatgtataaaatgtcccaagaaataaataaggattagagaatagaaaacataaggtaaaggagatgttatcaaagtagaggaggcagattttaaaaagaaaatataaactgataaataacaaggtattagaacatatagataccaaattttcttttgttcacattttagtcattggagttgtacgaccacaatctgtacttttgcttgaataggaatgaaatttgccagtgtttacaaatgcaatagcaaaatcatactacttaagcttagtaaacattcttttcccttaaggaaatctgacaaaacacatgaagtccaaggcacatagcaagaaatgtgtggatttaggcgtctcagtaggtttaatagatgaacaggatacagaagaatcaggtaaggctttataccatatttttcataaatgctatttataatgtacaatttttttgcttccataccctttccattcccactgattctgcctaattctgttttcattacctcttatttatatgcagtagactcctaattagtttttccatgtctagattgtcctccttcctccttcctattcatctatcccccacgatgttcatctttctgaagcatgtgtctgatcatacctctcctctgctcagaggttctcatcggttcccatctgtctagaaaataaaatgtgaacacttgaccttgatcaaaatcctttgtaatctgctgattacctacttctctacccttctcatttctctcttttacctaccctcatgcttgaatttcctgcctacttaacattgatcgctcttcacctttacacccctcacttaaaaccccagccctcactccccacacaaacgtggctcccagtgccctggtcaaaatctcactttccttcaagatccagccaagtccactgctgtcatgaagccttctctgattttccttttccacacctcttgcaggaaacaattcttcccttctctggactcctctagtattttacaatttcctccctgaaagcatttaatccccctcttgttctgagattattcacgcactcacctgagctcccaccacagtgattcagcatgtcatgagcagagccagtgagtgcttaacgtgtgctcaccagaagcacttagcgcagtgccttgcactgctcagcagctccatatttgtggaataaagcgtttgtttacttctccaaagtgtttattattccgaaaaggttaaatggctgtttttttttaaaaggtgttaacaaatttaagtatttatctctgaccaattttgaggaagaataaacctgttcatgtgttctaactcatcagagaatagaaatatgtttttgtgaaacttgtttttaacccaaggatttattgacaaaagaaaaaaaaaattgaaaaagtattctgctttttaaaatgccctgaattaaacatttacgtgcttgctatatttttcttaacatgtatgagtttggtctagagaaaatttccaaagagaaagtgatgaggacatcattgaatatataggtaaaaattcaaaggcatttaatccctgtaacacacgaaatgaatcagcctgaatttacttataaatatacaagagaaatgactcacgtcttcagtgatacagagcaattcagttgtaaaaagctaggaaaagtggaaaagtgtgtaagagtttcagcaagtacgttcattacccactgactagaaaagggacaaggtaaagctattattatagtatatactcatgtatatcttcttcaagaagatgagtcttataaaaattaatatgtctgtagaattctctaaattgttaagggaaggtagtacttatatcttaaatttgcataggagaattatagtttctgttaattatcatggattgtttacatttgctgactgattgacctacctatgtatttattcattgttgtattttcatctaattccaaaagcatttgaacctggtcttagattattactcaaagttgatatcctaattccctatttagattagaacttctgataaacagcgtagttttacctttttcctttcagtttacttttttttaaaactactgtatttgtgggtagtgtgctcaaagtttttttttttacagtgtttgtcaaataatagtgaagtagaacacagaggtggagttttgccaagtgctgtgtcatgctgtgctagagacctaacattctgtgttgctacaccagcagaatttattcctctccttttgctttattataggcttgcagtgtaagtttaaatatagtaaacagttgttgttttaaacaaatgatcttgttttattgtgcttttctgtgcttttaaaacatatttggagatttttttacatacaaaaaagtacaaagtattttgttgtgtgtactcatgtattaacagcagagttgattataaatattttctcatatttgcttcacgttcttttcacaaattcaatatattttttaaaaaccagctcagcaaggttattgctgctgaggggcagcttccgttactccccactccttgccactctcctgtccctctcagaggagctctcactgcactgggggttttcctttcagttcattcaacgtacatgtatatatctatgaatagtatgtgattttatgtttgtattttaaatttgcataaacagtaccactttgtatgtagatacctagatatttgctttataattttacattgttctccagaagagactttccatttcctcacctctttaattatacctaatattgttagaatttaaatttttggccaatttgatggatttgtttgttgtctttctggtttattgattactaagattgggtctcattattctttaaaacaaacttttactccattaaactgatgatagctggagatgggattttgcttagcaattctgcacatgtccctgtttgaggggacaagtcagaagcctgcagcatgatgctgtgtctggagggtgcactgtttctagccttccactagcccagagtggtaccagctgttccttttcagtcttctgtgctggctcctcctcacctccccagcctctcacataggccccagggctgtggcctttgatctcttctcttcctgtctgtgctcactttgtaggtagtctcatccggtctcctgacttcagataccatttctgtgctgatgatgccccagttcattccacatgtgggtatcattctgacttaccccaccagtctctgctggggtgtctaattagcatctcaggtctgatgtgtcccagatccctggttcaccccttacctctaagcacacttcccccatagtcttccgccatccttccatctgcttggccaaaaatcttgaagtcatccttgatgcccatctttctcacgtgttgcctctaatctaccagtaaaaccttttggctcttcacttcaaaatgtcttcagaatccatccacttttaatcacctccaacaccccaccccagccacatcctctctactaaattgcttctggaatagctcctgattggtctctgtggttctaccctgttcctttacagactatcttccacatagcagccaaagtggccttgtaacaattgtgtcattcctttgcttaaaagccccaggggtttcctgactcatttggagcactggtcaggcacccaccaggagctctgtcttcctccttaccatctccctgaggctcagctccccaaccttcctccctcgcgtgctcagctgcagccacacgggtctcctgcctctttcttgaacacccgcagcaggcccctgtctcagggactttgcactcctttcctctgttaagaatgccctctaggaggattccattccaagatggccaaataggaacagctccagtctgcagttcccagcgtgattgacgcagaagacggatgatttctgcatttccaactgaggtacctggttcatctcattgggactggttggacagtgggtgcagcccacagagggtgagccaaagcagggcaaggcatcgcctcacccaggaagcacaaggggtcaggggatttccctttcctagccaagggacgctgtgacagacagtacctggaaaaacgggacactcctgcccaaatactgcacttttccaacagtcttagcaaatggcacaccagaagattatatcccgcatctggcttggtggatcccatgcccacagagccttgctcactgctagcacagcagtctgagatctacctgtgaggcagcagcctggcagagggagtggcatctgccattgctgaggcttgagtaggtaaacaaagaggctggggaagctcaaactgggcagagcccaccgcagctcagcaaggcagactgcctctgtagtctccacctctgggggcagggcatagctgagcaaaagacagcagaaacttctgcaggcttaaacattcctgtctgacagctctgaagagagcagtggttctcccagcatggtgtttgagctcagagaaaggacagactgcctcctcaagtgggtccctgacccccgtgtagcctaactaggagacacctccccgtaggggccgactgacacctcatacaggcgggtacccctctggggcgaagcttccagaggaaggatcaggcaccaatatttgccgttctgcaatatttgctgttcttcagcctctgctggtgatacccaggcatacagggcctggagtggacctccagcaaactccaacagatgtgcagctgagggacctgactgttaggaggaaaactaacaaacaaaaggattagcatcaacatcaacaaaaagaacatccacaccaaaaccccatttgatgttggtgggtcaccaacatcaaagaccaaaggtagataaaatcacaatgatggggagaaaccagaccagaacatctgaaaattctgaaaaccagagaccctcttctcttccaaaagatcgcagctcctcgccagcaatggaacaaagctggatggagaatgactttgatgagctgacagaagtaggcttcagaaggtcagtaataacaaacttttccaagctaaaggaggatgtttgaacccattgcaaggaagctaaaaaccttgaaaaaagcttagacaaatggctaactagaataaacagtgtagagaagaccttaaatgacctgatggagcaaaactgtggcacgagaactacgtgacgcatacacaagcttcaatagctgatttgatcaagtggaagaaagggtatcagtgattgaagatcaaattaatgaaataaagcgagaagagaaggttagagaaaaaagagtagaaagaaacgaacaaagcctccaagaaatatgggactatgtgaaaaaaccaaatctacatttgattggtgtacctgaaagtgacggggagaatggaaccaagttggaaaacactcttagggatattatccaggagaacttccccaacctagcaaggcaggccaatattcaaatttaggaaatacagagaacaccacaaagatactccttgagaagagcaaccgcaagacacataattgtcagattcaccaaggttgaaatgaagggaaaaatgttaaggacagccagagagaaaggtcgggtcacccacaaagggaaacccatcagacttaacagcagatctctcggcagaaactctacaagccagaagagagtgggggctggtattcagcattcttaaagaaaagaattttcaacccagaatttcatatctagccaaactaagcctcataagtgaaggagaaaaaaaaatcctttatagacaagcaaatgctgagagattttgtcaccaccagacctgccttacgagagttcctgaaggaagcactaaacatggaaaggaacaaccagtaccagctactgcaaaaacatgccaaattgtaaagaccatcaatgcttggaagaaactgcatcaactaacgggcaaaataaccagctaacatagtgacgggatcaaattcacacataacaatattaacctttaatgtaaatgggctaaatgcctcaattaaaagacacaggcaaattggataaagagacaagacccatcagtgtgctgtattcaggagacccatctcacatgcagtgacacacatagactcaaaataaagggatggaagaagatctaccaagcaaatggaaagcaaaaaaaaaaaaaaaaaaaaaaaaaaaaagcaggggttgcaatcctagtctctgataaaacagactaaaccagtaaagatcagaagagacaaagaaggccattacataatggcaaagggatcaattcaacaagaagagctaactatcctaaatatatatgcacccaatacaggagcacccagattcataaagcaagtccttagagacctacaaagagacttagactcccatacaataataatgggagactttaacaccccactgtcagtattagacagatcaacaagacagaaggttaacaaggatatctaggacttgaactccgctctgcaccaagcagacctaagagacatctacagaactctccaccacaaatcaagagaatatacattcttctcagcaccacatcgcccttattctaaaattgaccacatagttggaagtaaagcactcctcagcaaatgtaaaagaacagaaatcacaacaaactgtctctcagaccacagtgcaatccaattagaactcaggattaagaaactcactcaaaaccgcacaactacatggaaactgaacaacatgctcctgaatggctgatgggtaagtaatgaaatgaaggcagaaataaagatgttctttgaaaccagtgagaaccaagacacaacatatcagaatctctgggacatatttaaagcagtgtgtagagggacatttatagcactaaatgcccacaagagaaagcaggaaagatgtaaaatcaacacctagcatcaaaattaaaggaactagagaagcaagagcaaacaaattcaaaagccagcagaaggcaagaaataactaagatcagagcagaactgaaggagatagagacacaaaaaaacccttgaaaaaatcaatgaatccaggagctggttttttgaaaagatcaacaaaattgatagactgctagcaagactaataaagaagaaaagagagaagaatcaaacagacacaataaaaaatgataaaggggctatcaccactgatcccacagaatacaaactatcatcagagaatactataaacacctctatgcaaataaactagaaaatctagaagaaatggataaattcctggacacatacaccctcccaagactaaaccaggaagaagttcaatctctgaatagactaataacaggctctgaaattgaggcaataattaataggctaccaaccaaaaaaagtccaggaccagatggatttacagctgaattctaccagaggtacaaagaggagctggtaccattccttctgaaactattccaatcaatagaaaaagagggaatcctccctaactcatttcatgaggccagcatcatcctgataccaaagcctggcagagacataacaaaaaaaagagaattttagaccaatatccctgatgaacatcgatgtgaaaatcctcaataaaatactggcaaaccaaacccagcagcacatctaaaagtttatccaccatgatcaagtcggcttcatccctgggatgcaaggctggttcaacatatgcaaatcaataaacataatccatcacataaacagaaccaatgacaaaaaccacatgattatctcaatagatgcagaaaaggctttcaacaaaattcaatagcccttcatgctaaaaaatctcaataagctaggtattgatggaacgtatctcaaaataataagagctatttatgacaaacccacaaccaatatcatactgaatgagcaaaagctggaagcagtccctttgaaaaatggcacaagacaaggatgccctctctcaccactcctattcaaaatagtgttggaagttctggccaaggcaatcaggcaagagaaagaaataaagggtgttcaattaggaaaagaagaagtcaaattgtccctgtttgcagatgacatgattgtatatttagaaaaccccattgtctcagcccaaaatctccttaagctgataaacaacttcagcaaagtctcaggatgcaaaatcaatgtgcaaaaatcacaagcattcctatacaccaataacagacaaacggagagccaaatcatgagtgaactcccattcccaattgctaaaaagagaataaaatatctaagaatccaacttacaagggatgtgaaggacctcttcaaggagaactacaaaccactgctcaacaaaataaaagaggacacaaacaaatggaagaacattccatgctcatggataggaagaatcaacaacgtgaaaatggccatactgcccaaggtaatttatagaccatctccatcaagctaccaatgactttcttcacggaactggaaaaaaactactttaaagttcatatggaaccaaaaaacagcccacgttgccaagacaatcctaagcaaaaggaacaaagctggaggcatcatgctatctgacttcaaactatacgacaaggctacagtaaccaaacagcatggtactggtaccaaaacagatatatagaccaatggaacagaacagaggcctcagaaataacaccacacatctacaaccagctgatctttgacaaatctaacaaaaacaagaaaaggggaaaggattccctatttaataaacagtgctgggaaaactggctagccatatgtagaaagctgaaactggatcccttccttacaccttatacaaaaattgattcaagatgggttaaagacttaaatgttagacctaaaaccataaaaaccctagaagaaaacctaggcaataccattcagaacatagacatgggcaaggacttcatgtctaaaacaccaaaagcaatggcaacagaagacaaaatagacaaatgggatctaattaaactaaagagcttctgcacgaaactaccatcagagtgaacaggcaacctatggaatgggagaaaatttttgcaatctactcatctgacaaagggctaatatccagaatctacaaataactcaaacaagtttacaagaaaaaaaacaaccccatccaaaagtgggcaaaggatatgaacagacacttctcaaaagaagacatttatgcagccaacagacacatgaaaaaatgctcatcatcactggtcatcagagaaatgcaaatcaaaaccacagtgagataccatctcacaccagttagaatggcgatcattaaaaagttggaagcaacagatgatggagaggatgtggggaaatcggaacgcttttacactattggtgggagtgtaaactagttcaaccattgtggaagacagtgtggcaattcctcaaggatctagaactagaaataccatttgatccagccatcccattactgggtatatacccaaaggattataaatcatgctactataaagacacatgcacacgtatgtttattgcggcactattaacaatagcaaagacttggaaccaacccagatgtccatcaattatagactggattaagaaaatgtggcacatatttaccatggaatactctgcagccataaaaaaggatgagttcatgtcctttgcagacttggatgcagctggaaatcatcattctgagtaaactgtcacaaggacagaaaaccaaacaccgcatgttctcactcacagatgggaattgaacaatgagaacacttgaacacagggaggggaacatcacaccctggggcctgtcatggggtgggggcctgggggagggatagcattaggagatatacctaatgtaaatgactagtttatgggtgcagcaaaccaacatggcacatgtataccctatgtaacaaacctgcacgttgtgcatatgtaccctagaacttaaagtataaaaaaaaaaaaaaaaaagaacgccctctaccagatactgtgagacttacgccaccctgccttcagctctctagcagatgtcgtttgatcagtggggccttcctgaatataaatatatgtaatataaatatatataaaaacaaaaggcacctcaccctcttactgctagcatcacttacgccctttattctgttttctttttcctcatagcacttaaccaccaccagacacttgtgtgcgtgtttattatctatttcttccaactagaaaataaattatataagggcaaagatgatgttttgcttgctgctgtatcttcagctccttaggattgtgcctggcaaatagtaggtaataaacagttgtttattgaattactagaaaaaaatctctaaaatctgtagtcctgcagcatgtgaagaaggaatattagactctgcctgcctttctgaaagtgacatatacttaagtgatgctaataggatatgtaagaacatgcttcatatgtttgagccttgatgatctctgacaggagaaatggggtaaacctttttttaaaaaggacagtataatctgttcttggcagcagctttctataatctaggaaataattcaatattattaattttcgaattagatatagtcggccgggtgcagtggctcacacctgtaatcccagcactttgggaggccaaagcaggcggatcatctgaggtcgggagttcaagaccagcctgactaacatggagaaatcctgtctcaactaaaaatataaaaattagccaggcatgatggcgcatgcctgtaatcccagctgtttgggaggctgaggcaagagaattgcttgaacctaggaggcggagattgcggtgagccgagatggtgccattgcactccagcccgggcaacaagagctaaactccatctcaaaaaaataataataatagtaattagatataatcgtttttcattaaattccttcactaaaatcaaatggtaactgtgctacttgatacctttacttataaatagtgtttatgttatatggccaaggtcagtataggtattgttaatgtgataatggcatttgtttattaatttgttatttattggttattggagcagattactagaaggtaattcaagttttttgactattctgtgttctcatcctcagtaatgatcattccaggttgataaagatctgttctgttttttaatagctccagaggagaaaagtttattctctttttgaatgattttttttttttatgtatcacttcggcacctattcaatgtgtgcacaattactatcgcccaggagctcctggctgattactatgatgtggcatgagcccaaatttggcaaggttcacttcccaaggctggaatcagggaaagaccggtgatggccaaagtggtcccagaaggaagggaaggaatttatttatccctacactgctgcatttggaaggctgttggtgaggagggaaaggaagggcaaacattctagaccaaggagttgcttgaccgaagacacacaggttggggaagaggaatagggtataagagtgtgaatgggacagaaaaacaagagagttccacagggcccaaggctgggaagcaggctgggggacaggtaatagatgctgtgcaggggagtttcagcatgagaactgccatttcaggtttaaactctattcactgggcttggatacaatgaacacccctgtcatgtcagtttatacccatttcttcatgttctgacacttgaaaactattattttttagataggattcttgagtattttaatttttctaaatagtgacacatacagtgtttctttgattacaaaagtctgaaccgaagttgtttaaagctattgcccctttaggaccacatatatctgacttttatcctgggttatgttctcaaatgttctggagacaaaagattatagggcttttaatctgtgacccttgaattttcattgttgaggtttgttgtttgtttgtttgttttttgctgttgctgctgttttattttgtagtgggaatttagacagtaatgacagaaagaagcatgtttcattaagtggatgatcccattcagcaacaataatactaatactcccacagagccaaagccttttttctgggtggatgagtgttttataaaagaagtacctcaggacttcagcctctctcattctccaccagatggagtttaacagtttggatggaaagtctgaaatgattttcccttgtgatatcccgttttttatgtctatgtataaatgtataatgactaatttggaaatagcgctatcaatttattaaactaggaagcattatttcccctggaattagtttctgctctggcccaggatcactgtggtgtagaactttcaccacagaatagcctctggtaaaagatgaggcctgtacttgtcctactttaacgcttctgtatatgttttaaaaccttgccccaatcaactctataagaatgttataaagagagcagtgtgttatgaagtgtttcattttactaacaattttattttccaaagaaaaatgcaaatgattactatattagacatacagtaggagtagaagaagtggctgacttaaaacatgatgaaggagaataaaatgtttctggtgctacagtttcaagttttgaagtggacagcccagcagaacaaagctagggagacctgggggctggtcactgtcgagtgagctcatgtgcctggttcccccctgcatcctcttcacaccccgatgcgtctccacctccctcatcataggggatacctgcccctcttggggagcaggctcttggcagcagctcttttgagaagtgagccactatgtaaagcctctgccattcttgagagtcctgcctgacagtgtattctccattttcttagcccagtcagtgaggataagtgaaaacattgtatcgtgtaaagtgggatattttaacacacaaacttgctgtcttttccttttaatggtgaacaaccttttgtggtatcatggggtcttgatatcatctctcatcttcttaatctaacataattcgaatattagtcatgttacacaaacagactgctagaaaccacaccgggatttcatttgctgtgtgtcaacagtagaaattcaggacaatcctctggttttgccagcagtaagtttccacaacagttatcaaagtcagcctcttttattccaaacagtgattttggtggcttttcagacacctttcattatgtcttcacacctgcagttatcgaaggatgtctggtctagctatatgaaaactgaaaatccaaaataacccaggaaactcttttatttcctgggttctcccaaacacagtcgaagtatgtcgtttcatcatgctaacagattatagatgactattagataatatagtgctgaaagaaaaatgtcccacatcaggagccacgtgtcttttcaggaaccagtactatgaaacatcaagtcttgatcagtatgaaaattgtcttctctgttttggtaggtacacttcctgtttcctaacaacagggtggtagtgacatcagtagtggggtcctgccgcatgtgaagagggaatattagactcagcatgcttttctgaaagtgatgtatacttgatactaataggatatttaagaacatgccttatatgtttgagtcttgatgatctctgacatggaaaatggggtaaacctttttttaaaaaggacaaaatttgggagacctgattgtaaatctaaaaagtcacaacccctgccagagtttgcagaacagtagccagaaacctaaggattgtgtttttaggtttataggacacatttgggggcttagtcatttaactgatcttttctgtagcataaacataatcatcaccaggaaacgtctctgagctttcattcattaaacaaaatgtactaaacacttaagaggcagtcagtgttactacaaagcaccccagtatagtacttattttttaaacatcattaccacttggtaatatctccgtcagctcatagcgttctggaaaaagcccaggtcttatgctgtgtttgtgctgagttgctcccttacatgtgcattgttttgtttttcactaaaggttttctccatatttctttctaattaatgtcagtgttttccaagcattatcttcagtcttttccttttaaggatcctagacctgttctctactctgccaaccacaccatacccaggttatcattcaccatcatattgtgcctggtccctggttgataaagagtgttcattaaagggtgatgtgaaaatgatgtgatgaaaggccacagaccccttctgaattctttaccacccttagcaacagcaggctgcgcggtacctgtcttatcttttagcagatggaattcatgttctaattctcaatggaataaattaggggatgttgggaaacgtttgcgtttaatgaagcaggaggaattatacatttttataagccagccattaaaatgtggacattcggcatttaaaagaagtttctatttagtttaaaactagcaacttgagctgcaatgataagaaatgctcatgggaagcctaatccctctgctccactgcacattcccttgttttcttgccataaaacatgatatagcctcgggaattttgttctcctgttcttggggtattagtgactacattttagttttcaccttttgtgtcaaaattcaagccgccagcaatttgcttttcatcctttgatccgaagaatgttttcgtcaacaaatgctggacttcagtgcacggaatgttaatgtgtaccctcagccgccagctaggagaaccgtttaatatgacgaagtgcagtgagaagcattattcttgttggagtttaagtacttacagtaaagatgatgtttgatcacaggttttaaaacctatatcacatttactcttaaaaataatttaggtgcatttttaaaaattactagcaaagctttttttccaaatgaaacctgtagaatatattatcatcgggatttttatagaacacattattactctttttaagaaacacttccatgtgtagaatatgaaaccataataggctttaggatttatacttaaagcagtgctaatattattttgaatgacacgcacgtgacacagtattttggtttacttcctaaagttaaacattaaactctgccccattatgtttttaatgatgattttatctttaaaatatatatatataattgtattcacattctttaaaaaaattttttccctaggttgccattgtttatctggctttcagagcaatatttctaaacatatgtgaaaaacaaaaacaggcaaacttcaacaacaaaagaaggttgctactgagtgtacgtgggccaggttgctaccctcgggagccccttctctcagggagcccctcctgctgcttttgcgactccgactcttccagcaggtgtcactgtctggcagcagtgggcgagcaggttgcggttcacctgactcatcttcaaataataacttttaaaatttatctttagggaagttgtttgacgtaaatgtatcaaaactttgacaaaaatgttgctacatcatatgcctgatttttccctcatgaattgaaattcacagaaaataaaggaattaatcttgtgctgatataaaattttattgagtattagaaacatttgtttataatgagaggggaatgtggctgggaggacataattaaatgaaacttttaggaccatttatttatgaatttgctaagcaaatatagattccttaggtctgttctagagtctctgatggctgcaaaggggtaagccacagtgcttaccctcctgaagtattagtgtgtattatacacaccaagaaaggaacaattgtaatagaaaaggagaaagtcagtgtatcttattggcataatgacagggctcctaagttcatagaaacctgtttttgaatcctggctttgatgcattctaatcatatacagtacaagcgtcttaacttccttgtggacgatgggtgtggtatcaactctgtcatgggtggtaattaggtttaaacctggagggtgatgtggcatagatgttggcaaactttttaatgtcaagggctggatagtaaatattttaggctttgcaagccacctattctctgtcatgaatactaaactgtgactgtagcacaaaagcagccacagacagtatataaagaaatgagcctggctgtgttccaataaaactttatccacaagaaccagtggagagccacatgcagctggtgaccatagtttgccaatccctgatataaccattactcacctgtaatcccaacactttgggaggccgaggcgggtggatcacctgaggtcaggagttcgagaccagcctggacaacatggtgaaaccccatctctactaaaaattcaaaaattagccaggcatggtggcgggcacctgtaatcccagctactcgggaggctgaagcaggagaatcgcttgaacctgggaggcagaggttgcagtgagccaggattatgccactgcactccagcctgggtgacggagcaagactccaagacttcatctcaaaaaaacaaaaaaagacaacaacaaaaaaaccagttactcaacatagtatcatagttgttacattaagtaacatgcagtagcaaagtaagcagtatcacagagtcatatatgacaagtgttttgagtccataacaagtcctcgttcttgtcctcgcagacttgttgatcccaggcaaggcacttttcctttctgggtcttttatcagtacgacttttgattcagcagcagtagtcttgtttagggggcaggggcagaggttaagggggacagggaagtatataaaggacttttattcttatgaatccaaacagagggcagagttgtctgtgctttgttttggtgccatggatgtttaaaaggataccattgtcttctgttcatttaagctacccattttatcttttctctgttacccagaatatcagtcctgtttaacaaatatgtaatgattcaaaattcatttgcaggtttttaaactttgacagtggtctcctctagcagagatttcagatactatgtattcagagacagaaacatcattctgtgcttatctcagtgaaagaaacccaggaaaggaatcccagcccctcctacatcctctccaagctacaggcatgtggctcatccaggaggggagaagggagcagagaagccaccctgggtgtcttctcacccatactgctaatcctgacctgacctgaaatttaatataatcaaggcaaaatcagattaaaatggagccaaatagttttacacttcaaatagtttttacgtacataaaaaatatatggtgttcgttttaaattattcatattatttgcatatgctaaaaaagaaatcagcatgcttcttgaaatgtcttaacaatttaaaatatttataatataactgattcttaaacttttatataatgcagtatatttgaaattttaaaagttcaattatttacattctccttgggaactacattttatatattctgttacttgtaatcaaataattatatgacattcttaatgtctgtacctacaaacattgaattcatgcatatttataaggtagcttattgactataattcattgttgacctttctgatgattctgtagttagatttttaaaatatgattgaatgtggaatatctaggcatagactaacatgggtttgaatcttagctgtgacatttatgagctgtgggctcaacactttaaaagtaattaactgcatttttcatcttttaaatcattctctgagaaaaagtcaactccttaattagtccttgtttgaattatgatcaaatagtattggtttgtacagaatgatgctaacttaggatccaggctatagatggctgcaaccggaatagagccatttagtcatcatatgtacaatagagtaagaaatgcaaaaaaaaaaaaaaaaaaaaaatagatacaagataagagcacttttaggttctaagaatttaaaatgtgtatctaggttagagtgaattggggtgaaatttcctgtgcttccaagttaaccagtagaagtgttgaaattgatttcaagaattgatagtgtcctattaaacaatcagaagacagaaggtactagtgagaagtcttgatttgactatggggctaatagggaggtgcttgttgtgcaagcttatgtgagagaatagctgtatcagtagagtaaaagaccctagagcgggctgggtgcagtggctcacgcctgtaatcccagcactttgggaggccaaggcaggtagatcacttgaggtcaggtgttcaagacccgcctgaccaacatggtgaaaccccgtctctactaaaagtgcaaaaattagccaggcatggtggcggatgcctgtgatcccagctactcaggaggctgaggcaagagaatcagttgaagctgggaggcggaggttgcagtgtacatgtgtattccatatatacaagtgaagatatgaatccatactgataacttccagtccagcaccactgaatttattctagtcgtctccatttccttctcttcttcacccacagtgagaaacctggttcgcacctacagtatgtttacatatttgctcagttctagtatataaataaactagtttcagaaatccttacctttactcctgtaagaaacagatttaaaattacgtgcagcgtgtgccattcttgtctctagccttcacagtctccagtcaaaaccctctttgccaaggttatctaggacaggaccttactttccatgcccttagcgtggctgtgccatccatgcagctgcagtcagagccgtctgtctcagcttgcattcctcttaggttcacctcacatcctagttgattccgtttttatttacttacaatagaatttactttatggtgtatagtacgtggtttctgacaaatgcatagaattgtatgttcatcacatggacacaaggaggggaacatcacacaccagggtctgttgggggtgggggacaaggggagggagagcattaggacaaatacctaatgcatacggggcttgaaacctagaagacgggttgatgggtgcagcaaacctccctggcacatgtatacctccatggcacatgtatgtaacaaacctgcacatttgccacatgtatccctgaacttaaagtataataaattttttaaaaattgtgtgtttatcccacctttcttttctaatgttggtaatttgtatcttctctctctctttcttggctagtgttaccagagaatttttctaagaacccagcttttggtttccttgcctttctctatttttcttttttcaatgtcatcatttctgttcttattttgattattttttccctctccttgctttgagtttagtttgatcttctttttctgatttcttaaactgaaaatttagatttatccgagaaccttcttttctaatgaaagttttgaatacgataaatttcccactgaccactgcattagttacatcccacaaaattcgaatgttgtgttttaattttcatccagttgaaaatatttgacatgttttgagacttcctcattaacccaatgaatatttagagatgtgttcttttttttcttcaacttctaagttcaggggtacatgtgcagggtgtgcaggtttgtcgcacaggtaaacgtgtgccatggtggcttgctgcacaaaccatctcatcatctcagtattaagcccagcatttcttcctgatgttcttcccccacacccctatcaccccccaacagacaggccccagtgagtattgttccccccaatgtgtcctcgtgttttcgtcattcagctcccacttataagtgaaaacatgcggtatttggttttctcttcctgcattagtttgctgaggattatggcttccaaatccatctatgtccctgcaaaggacatgatctcattctttttgatgactgcagagtattctatggtgtacatgcaccacgttttccttatccagtctatcattgatgggcattcaggttgattccatgtctttgctattacgaatgaacatatgcatgcatgttatctttatagtaaaatgatttctgttcctttgggtatatacccagtaatgtgattgctgggtcagatggtatttctgcagaggtctaggtctttgaggaatcaccacactgtcttccacaatggttgagctaatttacactcccactagcagtgtcaaagcattcctttttctctgcaacctctccagcatctgttattttttaactttttaataatagccgttctgactggcctgagatggtatctcattgtggttttgatttgcatttctctaatgatcagtggtgttgagcttttcttcatgttgttggctgcatgtatgtgttcttttgagaagtgcctattcatgtcctttgcctgctttttaatcgggttactttttttcttataaatttgtttaagttccttgtagactctggacattagacctttgtcagatggatagattgtgaaaattttctcccattctgtaggttgtgtgttcactctgatgatagttccttttgttgtgcagaagctctgcagtttaattagaccccatttgtcaatttttccttttggtgttttcgtcataaaatctttgcccgtgactgtatcctgaatgatattgcctagattttcttctagggttttcatagtttttcattttacatttaagtctttaatccatcttgagttaatttttatatatattgtaaagaaggggtccagtttcagttttctgcatatggctagccagttttcccagcatcgtttattaaatagggactctttccccccatcacttctttttgtttgttgaagatcagatggttgctggtgtgcagtcttatttctgagttctctattttgttccgttgatctatgtgtctgttcttgtaccagtatcatgcatgtgttctttaattctgcaataatttgatggtttttcagatatcctccaattaattgatttctggtttaattctgttttcatgtaaaaacacactctgtatggtttctactgattttaaatagttgaggtttattttgtagctcagaatatggtatgtactggtgaatgttccacatacccttatataaaaagtatgttctgctgttgagtggaacatttctataaatgtctattaggtcttgatagtgttttgcgggtcttttatgttcttcctgattttctatttatgtgtcccattaattaccgagagtggattattgaagtcttcagctctgattatggatttatttttttcagtttccgctcctttatttcgaagctctattgcgtacacacttaggattgttatgttcatgggatgacctatatcattatgtaatgctcctgtttatccttcataatattctttgctctgaagtccacttcgtctgatattagtatagtttctgcagctgtattttagttattgatttatggtatatctttccccaaacttttattttcagcctacttatgtctttatatcaatatttaaaatgcgtttcttatatacagtatatacatgggacttgcattttattcagtcctagtcatttctgtcttttaatttatgtgttagaccaccccttttaatgttattatttgtgtaattggattaaaatgtaccatattggcaaccgttttctgtttgtttcatttttgggtttcagttttcttttgatgccttctctagtattaactgagtgttttttatgattctgttctatttcctctactgacttattatttatacttttaaaaaattgtatttatctaccttcagataatattacattgctttacatggagcctatagactttactgcagtttatacacagctccttctttccgtgctttatgctattgtggccatacctttttacatttacatctactgtgaacgcacagtacattgttttacacattcaggtatcttttagagcaattaaaaaataagaaaaaaaattgtgtccccatttattctattttcactgctctttgtttgtttgtgtagatccgggcctccatctgatgttgtgttccttctgcctgaggaacttccgtttaacatttattgtccactaggtcaagcagctggcaatgaatcccctcagtttttgtttttctaagaaagtctgtatttctctttcatctttgaaaattattttcaatgggcatagaattctggatttaacagttttcttgatattgttaccatattttttatttgcaccattttcattggattctttttaatagttgtcagcactcagctgaaagtcccatctgttattgtctacctttccctttagagccttcaaaatatgaaccatagttattttaaattctcagtcatttctaacataggtgtcatatctgactgtggttctgattattgctttgtctctctgaagtatgtttttttcttgccttcttgtatgccttgtaattttgtgttgaaagctgtacatcttgtgtaagacagtagagacccatggaaattgtttgtatcctagaaatgtgcatgcctctccttcctagaggcctttagtgtgggagttagagtttatctagttaggagtttgctaggtttgagagatttgttggcagctatcctcactgcaggaaaggcttcatgttcctgtagagataccttgtgttttggctgggggttggatcacaagaacatcacctgttcagttctagttttaggtcttccttttgcactatgcctcagaaagggtctctctgcacattcttgttctcctgtttctctccaagcactgttttgttacctgtaatgctaagctccttagcttgacattgtggggcaaggaggaggatggggtgctgtctctgttccgattgagttacagtctcgtacctgcaccattttcttaggtttctgggctgtgaccttctcagttctcctccctctcccccaagtgttgtgggagtttctgtgtaatcctgtccctccccaaggagacaggttgtatgtgtatgtttttcctgttccctttccacactgcagtgagttttcagcagtgtcctaaggacaacagtgcgtgccgcccttctcctcacaggataggtcttttgttttcctggtggagacaggggagatggatccaggtgtagttccttgccactcctctagagttactgcttctctcccccatatctggaacacagcggacacttcttaccccaccctcctgtgagcacctgggtgatggtcatggcatagatcctgtgtgagaatgtaaccctcagaggtttcacacaatcttggcagcccactcttgactctaaccagatacttgagcgggactcccctgactggggttctgttgtgtctgccctcggtgacacaagcttgtgtctccttagattttgggctgttgattatctgggacctcggcttattgatgggtttggaaaaagttaataagtttaaagttaggctgtacgtgtgtgtgtgtgtgtgcgcgcgcgcgtgcacgtgcacgcttgtgtgtgtgtttaacgtaaacaggtcccatccttgttagactttacagcaagagcagccttgaatgaaatcatcctttctctccagtaacttattctcccagtcattcagttctctttagtctttttacaaattttacttctttaaagaagatgcgtctccaaaaaaaaaaaatacctaatttgctactgatgtggcaaattcaagtcaaattgaggatgactcgaattttacaatgccaaacaatcctgatggccaactgtcttattcttccccagggccttctcctcagccagggcggaggctcgttgtgggcagggtccttgtcttttataatcctcgcagagttgccaaacctataaaaaatttttaaaataggcaaggtagagaagtagctgaggtgcaggagtctgggtatttacccagaaatcacacattctgtctccagcataggcccctagagccagtcaatactttggtattattttatttcattacttattttacagcataatagtagaaccctaaaagcaaaagccttatgaaatcacatgctaacagaacctaaatgcatgtttcatcttagagttttttaattataaaagtagcacacgtttgtgataaataatgtaaaatgtcaagttcttttcatcccctagaaataatcaccctccaatcttttctatgggtcttctaaggcttttctctaaactcatttttgtcatatacaaagaaaaagtaaaaaattaatatctaggccatttgggaaaggcagcctattgcttgttgctctgtttacatgtttgtctcttttcaaaaaaatacctgtaagtgcagaatgtatcacagctaaactgtacattgtctaatgtcatctttattatatctcagtgacattcctcccccataactaaattttattaagctttcagtgggaaagagcctctaatttgcaagattttgaaaatgtgaagagtttaaaagttccacatgagcttatgagatttttgaaactatttcctggatcatcttgaagattccttgttaaactcagtttcacatgatgttaagaggctgatactaacgacttttagataatatccccctttctatgaggaatgggttgaatcatatcacagaagaaattgacaggaaattgtagcatctctctgagtaaataagaaggcttacacattaggtgaatatgacgacacggaggaccattgaaacatgcctgtgtcaaccaaaagaagaagctaaagcacaaagtgtggttgaaagagttgacttgagccagaataaggacagctgcccagatgactcacccaaactgcttgcttggcctttgttacaggcagatttttaaaggcaaaaagaaaaaaacaaaaacaaaaaaacaggaggcaggggaggggggccggtgttaccgagtagactgttagacagttctgtcaggaattctcatggatatacagaagtaacagtgattagtgactgcctgtccacggttaagctatagaatgtgggatatagtgtccagtgccacattactaggttaattcacagctacctgtggcaatgggaagcagcttcagtaaagtgtggagtaggatgtgattgctgtctcatcttaatgcctctttggggcctagtaatttgaaagggcccacattcctcagataaaagtccttttctttcctcatctataatactattcaaatctaaagaaaatgtatgttgctcacagataccaacagccatcagttttttgtgtttgatttaatttgttcagtaaaaggaagatacaaaatagggaaaaagctcaggaaaagagttgcgttgaactctttattaattttatatgtagttcagttgtgttttaaagattttcaagtgcaatcttagaggccttcatttccttgtttcttgattaccctccacctgcctcattccccttctgagagtcatttcccattcctcgtccctgaccccggcccctcccgcagagctgccctcctctgaatcctgatggccaactgtcttattcttccccagggccttctcagccagggcggaggctcgttgtgggcagggtccttgtcttttataatccttgcagagttgccaaacgtataaaaaatttttaaaatagcacttgtgcacttggaaagcattccatcacatacctcttggttgtttttattagatgaaaaacagagattcagttatgagcgatctggatatgatcttgaagaatctgatggcccagatgaggatgacaatgaaaatgaagacgatgatgaggacagccaggctgaatcagtcctgtcagccacaccctcagtcacagctagcccgcagcaccttccatctagaagtagccttcaggaccctgtgagtactgacgaggatgtcaggatcaccgattgcttttctggggtacacacggacccaatggacgttctgcccagggcgctgctcaccagaatgactgtcctgagcacagcacagtctgactacaataggaagacactctctccggggaaggccaggcagcgtgctgcgagagatgaaaacgacacaattccgtctgtagacacttccaggtccccgtgtcatcagatgtctgtggactaccctgagtcagaagaaattctgagaagttctatggcaggaaaagctgttgctataacacaggtaaatgattggcagttgttcttttatttcttttttcgttttaacctattaaatatggagaacttaatggcttaagaaaataatgcacttaagtgatttttttaggccaaatcagtttgtatagctttatttttttcttgtatttaagggtagagggtatttttgccctttggagtcttgttgagtatcttaagcagttcagatattttattgtaaatctatgaaagaaccaaatggttcttgaaaaatacacccatttatttttatttgctttttgaaaaatttttgaaattaaaaaaaaaaaaaaacgtgacagtggcgaacacaagtcccgcaactgatttatctgctggccccttctgagcagtttctccactggtgctgatgtgatgatggattttcactgacttacccaaacattttgcactttgcccccattggcaagacagctaccagtttctatggcaaagttaatgtgacccgaaaacacatcaagaagttcactttgcttgaattatcacattgctacagcagcttgggagagctttctgcccaagaactatctcaaggcaggcacaggcctctgaaaagtcacgctccatgtgctgtgagtgagtccctgctctacctctggctgttttgtgacaaatgattaattctgggaggaatacattcttccctcattgacagttctcttacctctagtatgtattgaatattgcaataggatttatgcctaattgtggcagattgtgctgtaagcgtctctatcccaaaacctctcagacacttaccagtgcctggaaatctggttttcagtagacatttcataaacttgcaagtgatagacaaacaaccagagaactttttcatagtaacatctcttcacaaataattctttagttcatttttccccattgagttgacatagccaacttgaatctcaatttctcagtaactcttaatctctaaaataaggtggagctggtagtgccagaaacagaaataataacaaaaatagcagcttaagaatatagctgtgtccacttctcagagttattctctgtgtacaatatgacaaaatccaggaaatttgcttcagacatgcaaaagactatacaagatgtattgccattatttctaccagaaacgaaattaaagatgtaataattgtttaattggaagcttatttttaaaaatcgaaaaataatttcattgcagcaaacatcatttttatcaatgcaaatatacttacttttatctcattgtgaagaaatagatttagcactagctttatatctcagtgattacaaaagacctgtcataaaaggattgctctctcttgtcatttagagcccatcatctgtaagacttcctcctgctgcagctgagcacagcccccagacagcagcggggatgccttctgtggcctcaccacatcctgaccctcaagaacagaagcagcaaataactctacagccgactccaggcttgccttctccccacactcatttgtttagccaccttcctttgcattcccagcagcaatcgaggacaccttataatatggttccagttggggggatccatgtggtacctgctggcctcacatactccacgtttgtgccccttcaggctggaccagtgcagctcacgatccctgctgtcagtgtcgttcacagaactttgggtactcataggaatacggtcacagaagtgtctggcactacaaaccctgctggagtggctgaattaagcagtgttgtgccatgtattcctatcggccaaatccgcgtgccaggccttcagaacctaagtaccccaggcttgcagtcactcccctcgttaagcatggaaaccgtcaatattgtaggcctagccaatacaaatatggccccacaagtccatccaccaggactggctctgaatgctgtcggactgcaggttctgactgcaaacccttcatcacaaagcagccccgcccctcaggcacacattccaggtctccagatcttgaacatagcattgcccaccttaatcccctcagtcagtcaagtagccgttgatgcacagggagctccagaaatgccagcttcccaaagcaaagcatgcgagacacaacccaagcagacttctgtagccagcgcaaaccaggtcagcaggaccgagtctcctcaggggttacctacagtccagcgggaaaatgcaaaaaaagttctgaatccacctgcccctgcaggtgaccatgcaaggcttgatggcctgagtaaaatggacacagagaaggctgcctcggcaaatcacgtgaagcccaagcctgaactcacttccatacagggccaaccagcgtccacgtcacaacctctgctgaaggcacattctgaagtttttacaaagccctcaggccagcagactctctctccagacagacaggttcccaggcccacagcactaccgcggaggcagcccactgtgcacttcagcgacgtgagcagcgatgatgacgaggacaggcttgtgatagcaacctgatggattttattttttatttgctttttttttatataacacttaaaggtttctttgaaaaccctcctttccttaaagcacatttttctgacataaactcatgactaatctttgtgcaatcatgaacttttgaccaataattgttgttttgtgtcagctccagccatttttgtacatgttgtatagacaattgtgccttttaggagctttatgtttagaaactgtacagattgttgaatatctatatacataaaaatatattatatatgtatatgaaaaccaggtagttatttgtgtttagtaaggaaaacctgtcaaataaatcaaatgattaaattatatgttccactgttgaatataaattttatggctatggggcagagtttctgtgtataaattagtatgtaaactccatatttattgtattcatattagtctttgaaaatgggtctgtcctccttgtgtaagacagtaactttacacttcagacagattttctgtgttatgaaatgtttcagtaaaatattgtttactgacttta

SEQ ID NO: 1742 - DNA, 193735 bp, Homo sapiens
tcaagcatgtaattgtatatttatttctctttttaaagaacactccttaatgtaattcaatatacaaacttggtttcacagaattataatccactatatagcacaaagataacccagattgtatgtgtgcgtgcacacatgtgcgtgcctgtgcacatgttgctgcacccctccctctctttcactcttctggacctacaaatgctcttcccaccttcaacactaaccaaaagccattgtgagtattacatacaacagacatcctcccacgagttctttgcccttgaaagattcttttccccattccccctgagatagccaggagtgtgacactcttcccctatgaaaaagggtaaggtgacctcccctaacacagatgttaaccctgttcccatgtaaaccggctgacaggaagagctggggagcaggtctccatctccttttcccccttccacacccaaccctcagagtccaagtgcgaccctctgtgtagccttagttccagtcaccatcctgtgtagcaagaactaaggagattgctaagcccaggtcttctccatgagcagcgcacagcactgcctgccaagccaccgggccggccgataaccaagctctacacagtcccatgtgctttgtcaccttaattttttaaagacacctagcataggtctgtggcaacctagtgtccaactgagttacataaaattgtaccagtgatgcacttgtacatatttacatggggtggaatgttttcccatatttttagatgagtatatagatcaacatgttcacataagaccaaatacttttaatattatttataactgatttataaagctttgaaaaaactcacaatagcacattgtttactttaatgctttacggtactatcattttaaaatcacaatcagcacttaagttatagtcaatccagcaaacaagagacaaaaaaatatacaagagttaagaactgactgatacatcctttatctttttttaactaatgcataagtgcagaataagatactctagtttaaatatcttgtttacaatgtacatttttgttctagttacgcaacagtaaatcccatgcttcacatagaaaagcaatccacaacattaagaaaaaatgtacaatttatgaaacaaagtaaataaatattagtattacagaatcagagctgtacataaaagctgttcagttttaatcatataaaaatatgttttagtgcaacctcacatatatattgatgctgttttgctttacatcatttagatccaagtgtccaaaaaaggaaagaaattacatttattacaaagcagatacacaaattctaaaatatgtacaaattactgctaaaaaatgcttataagaatataagcaaagtaaagaaaaggcacaaacatctgtacaattttaaaagtaccagacccaataggttaatttcaaattttgttttggtcaggctcatgatgacttgttaatttacctaattcttttgatataacaaaagtatatataatagcaaactactgtaacttaggacaggcatgctataaactggattacctccatttctagaaaaacaaaaacaaaaaaatgggaaaatgtggaaatgaaagtctccatgcatcatagatcaatgtagctgactcttttctgatgaaggatctttgctttcctctgtgcttgaagataattccttgctgctgtgaaagtccaactgcttgtcatccacacaactcttgctgtaaaacgtggagtgagctaatggagtctgtgatgtaccaaaattgtccttttcaccatcatgcaagtcagggtgggtggctgaggtacagggctgacctggctcaggtctactaaagtgtctaatgctaacatgtgcacttcccagggggttctggtggggctcctgcacccgcgctggctgatctggcccgagcagagctgcctcttccgtggcaatccggagagaggcaatggcttttgtacaagtctgtatattttcctcctgttcccgctctgttgcgtttaggctgtcttccgaagtgctctgtttcatcaacagccgaggagaggagggagtgctaggtggaccagatgactgcaaagcgtgaggacctcgcttctcatgctgcttagaaagcacataggggtccttggagaaggactcccctgacgcgcctttcttctcctcaaagccctccattggcaggggcaatgtgggtgaaggatgtaaactggaaagggctggcggcatggagtgaaccatctggatcccaccaacgggcaccatggggataggggctcgcacttgttgctgagagtggagtggaagatgactgaagacatagtcattaggaccctcagggaaaaggctggagcctggatgttcataagcaccttcttggtctccatagagactgaagtaaggaacctgaggtaatcctcttcttaaattctgcgcagagaaacaaagagagcacaaaattcagagcctgctacgcttcattcttaggtcaagctgttggattcattcactcacccattcacacattcactacctagagaggcttcaatacctaattctttgatcaagttttcctatttcaagacaaaagagatttctctgttctcttttataatccttgaataaaggtgtcggcctgtgaaaagttgcttttgtttttaaacagcaaggtgataaagcagtcagggtgttttccattgggtacagagacacatttcagctctgtttttttcacaagagataatgaaaagaaattaatggataattggcaaaaaaaaaaagtttactgagcaaaaaacactaataaacattaataatattttttttaattcaaaaggaaataaaaagattaccatctgttgctatactggacagatttttaatatttttcttaagtgttgatgagtatataattggaatgacaagtctgaaaattggcttttttaaaaagttttccacagaacagatgacaaaacagtggtgaggatccacaaactggttcctccaatgtgtaagacattggtctaaaggaatgcattcctgctaagagatactcaatgcagaaggccagcttctccatccaataacaaaccaagtccatttaagtcttacatcaataataattttttaaaggaaactatccatcatagaagtagttaacattatttcagacagttaacaacttatattcgactctatactgtgaaccaaagatgactgcatcttaattcttttgttcatattatcatttccacctcaatatcttcttggcaatcaatgaattaaggatgcttaaaatgttcagccagaatttcagatttcatagtcctagtcctgaaaatggagaatttattttctatactgtttctgtagtgaaatacaacttagattgtcagattatcaggttttaatattatcatattttaattaatgtgattcattctttaatggattgtcatctaaaaaggacttcatttatttttctattttttgagaaccaaagatagatagatagatataaacccatacagtatggtagtagtccaggatagagccaaagaaactgttctatttcaagagtttcagttctaaaactcaaggtatgctctgcagcattaaagattcatccagttctatctagattatgatttctgctactctctaagatgcttagcccttacccttctctgtgatatatcatatgcaagctggaaacatggattctcctgaaagtgtgagtgaaacggtgcaatcattaacactatcgttaccacgacctcataagctgggaaaggtgggaattttacggtatgagaatcatttaaattctgcacatagacaaaatcccccttgtatttaatcaggtttggaaaaggcacgtctccttcatcaaacaccagtttgggaggaagacctgtaatgcctacagtaacgatctttgaagataatcaagtacgttttcttttaatcacagcaatcacagattcaaagtttaaaataaaaccgagcttggttatttttctgttttacttctggctgctattccatgacctccattgcatacaaccagtcagaatgtggatctgtggggaaaccaaggaagtggaacagaagtcagagagagagagagatgtcctattacgtaaactgacttgagatccccaaatccaggctgacaaatggagtcatgaattgtcctctaaaactacaataatactcagcatgttctaaatccaataaaatcttattagtgctactaatgaaagtttcaaattcagcccttcactgattttaaccacagagctacgtgtacaagtagaatttctaccatgtggccacttccactgctccaagccccaccaggcatttctacacatcctctctcctctcattcaccccttcttcatcctccaaagaaactcccaataagttttctctactttggtttttactccatttgcaatcctattgttttgtaatttgggccttataaatgtggtggacaaacttccatcttacttaaatctcagtaagaaaattttgtcgtggaaaaacaaatagtgaattcaaatgtagattatgttaagtgcatatgtatgtatagacacatatacacatatgtacaaatgtacatacacagatatctatatacacatctatacgccatgtaccagatctattaccctacgcatctcttcaacagtatggcagtagggacctctagatgcaaatgatgagagggaggtagaagagcaagagcctccttgggggcagcagggagcagagaaggagaagtgacccatttgtgctcagtcactggctggggctgcagggagagcatggctttggcttcaaaacagtcctgtcctgaaggtgctgacatgccagcaggaggcttgtctgcccactacattccttacagctgaatggcacgttctttcaggaacaaaaatctgcatgggccacctccctggctgccagaaacaaattaaaaaactgtggtcaagaggttaagtgactcgcccaagatcacacagataacaagggataggaatgaatgttgactgtttccctagacacaatcttcatctacactacatactgagggcctggacacacctttgtttctcttcctgctacctatctacaaaagctttaaaatggaaaaggaaatttatttatcaaaaaaaaaaagataaggccacagccataatattatttcatcctcaacctcgaaccatgcgtagtagaccctcaaaaattcagtagatactgaataaatggataaaagataccttatctatctatctatctatctatctatctatctatctatctatccgtccatccatctgtcttaaaattaaaactaacaggggcactggagcacttctacctccttctcatcatttgtgtctagagctccttactgccacactgttgaagagatgagtggggtaatagaactggtatatagatgtatatatagatgtctgtgtaggtacatttgtacatatgtgtatatgtgtgcatacatatatatgcacatacacttaacacaatctgcatttgaattcattcatttcttcccaacctgtgttggctatgatcaccattactccaaacgcaggcagaatatgactgggctgtaaggtcccttcacaccacagtcagtgtcctgtggtgtgagaaagcataaagtgggcagtgcttgggacgaactgtccctacatcagggaggattcccagatctgttccctcataccatgtgaacaatgcagcaggctatacatcctctaaagagaattaaactgggtaacaggccaaaagcatcataaatgataaagtttaataacactatgaaatataaccatgatcagccaggtgcgatggctcacacctgtaatcccagcactttgggaggccgaggcaggcggatcatgaggtcaagaaatcgagaccatcctggccaacatggtgaaaccatgtttctactaaaaatacaaaaattagctgggtgtggtggcacgtgcctataggcccagctgcttgggaggctgaagcagagaattgcttgaacccaggaggtggaggttgcagtaagccaaggtcgtgccactgcactccagcctggcgacagagcgagactccatctcaaaataataataatacccatgatcagatatttaaaaaaaaatgaaacaaaacaaaaacacatcaaaaaaacttgtacaaactcagtgactactaaaactcatctctctctaactttctgggcatgtatctaaaaatcagatgaactcccttagtccactcttccaattcctttgcctaacttgactgtgggttgctataaatttttacaaccacagcatgtttgcgataaaggcttactttttctgactgaagaatcgcatgtttgcagttgactgaacatgcaccactgtttcacaaatgccacactctcaatccacctggccaatgctagaacacaagctgcagggatggcagggagaggctcatctaacacactctgccagcatcactgcgtgtataccagagaaagcatgtgtcatcccagacttggtatcccatgatccaggagatttacagttctctattcatgctgcaatggcataaactgcagaagatccctctttcctacttttgctaaggcaccaaaacctgtggaaatgtatctctttttcttattagcttgctaatttgttagcttggtaaacaacatcccaattgctatatatgtttctgcaggaattgcttcatcaagatgaagttggtaccagacttgtgaaaagatggtgctggggatggggacaggaatgcagcagctttcctaaagtgaaaaaatgacaggctgagctcaggattcagggtggtggaaggtgatgagagggagaaaattggctgccagggcagtgataaaacagagctgggagctggcagtgtctcctctggctgtgaaggatggtgctgatgcacttgacacagagatccggagcaagggagtacaacaaagagtagaaaccaggaaatcaaaacacattcaaggcagacagattccaaaggtatcatgcctctgtctatgctaagtgcatgctttattcattttttaaaatcctacacaaactgaaagagacatcacagtctactgagccgtggaattaggcaggacaggtgcttttatatgaatttgtattaaacctactgcttaaatgtaatccatggtggttactgttatcttcacttataatgaaggcatatcatagaaatctctgcacattctcacttagctctcctgatttcccgttctccttgggcccacgcttccactgagcaagtgcacttgatagtagtaatggcaagaaaagcagacaggctcatgtctttgatttataaacatgccgagtgtgtcattctctcctctccctggccctgaccagtttcacatgtcccctcatgatgggcaaggtagagtttattaaaaaaaggagtttttgaggccaggcgcagtggctcatgtctgtaatcctagcactttgggaggccgaggcaggcagatcacttgagttcaggagttcgagaccagcctggccaacatggtgaaaccctgcctctaccaataaatacaaaaattagccaggtgtggtgatacacgcctgtagtcccagcttctcgggaggctgagatgggagaatcgcttcaacctgggaggcggaggttgtagtgagccaaagtcgtgccactgcactccagcctgggtgaaagagtgagaccctgtctcaaaaaaaataaataaaataaaaattttaaaaataaaagttttggaaagtcaaggttaacagctgaatcagaatccttacctggtgatgagttatataagtgatgcctaaatgtccctgtgagtgtatgtccatgcagtcatggcattctaaaggttcatcttttttacttacaaaaaggcttcagcttacgtctatcattagttaagtttagaaagccttcagaaaggcctcacctgttcccactgggaatgcactgctgctctgatgcaatactacactttaggtaatgccacagccatgttactgacaatagcatatgacaaaaatgtctccccgctattttcattagccagattcactccacccatgacagatacccatgttctactaaacttcacaccagtgcattatcaggaggaccaatgtgcttccacttatgtattagaaagaaaagtggattatacttacaggaggccccaatacaattggctctgcttgcaaatactgtcccatggacaatggtgggttatggtataaagcccttctgggagatggcgctcttattgtggtcatgtatcttctctctcttctaggagagaggtctcttcttgctgtgatatctttcccaggagacactggcctccttggagacaaatgccttcttggtgaaacatctctttgggacatctctcttctcaatgcagcttcctttcttggtgaaagatgtctcatgggtgacagatctctcctaggtgataaatgtctcctgggagataaatctcctttgggtatcagatacctctttggtgaattatctcgacagggtgaagaatcatatcctggagaggaatggtggcttgagggtgagaagtccctgggagaggagcttggctctgaaggtagcatgcactcctcatccatacaactaggtatgtccaatctgtctttgtctggttctgagtccgtacttttgctctggaatagcctctggtattctgtcatctgggtatcttcacatgaatcactgggtgtcataagctgagtaactcgaatacttggcaaagtaaccaaatagctgatcaacgaagaatgtcccagggaactatctgaaggaaccccgtggggtacggcgccaacattcacaggcaaggaggagaatctaggaggctgaggactggtgcttcttgatcttgtttttggtgttaaatctccctggtcgtcaaagtcatcttcatcttcatcatcatcatcattatcatctccatcctcaccatctgattcctcagcatcggagaactgatgatcagttgaaatgctggacatgctatgcttctctgctgctttgtgcaaatcttccaaattttctgaaacaattaaacaaagataatggagatcaagatccaaatatcaaggttaggatcttatttaagcctcatttctttctaaacgcttttcccaatccctagtgcccacagatagttatgtctgagaactcctataaaatgaggcacttacctgtgtgaccctgcgttcattctatcttcttgtatatctatttgttttcatccccaacttacaagaaagattccatagtaggactttatatctcagacatcatcccactcacagaaaaccctcaacaaatgagcatggataatgttaattatgatgctagaggagaaagaaaggcaacaacctgtctctgcaagctcaggtacaaacgtatgtctaagtgatgtaactcaggaggtctggccaaccttaatgatgtttgtttgctagtttatttgttttcctactgggtttcttcttaacttgaataataatacattaaaatgcttttcaaattccccaaaaagcctcataaaatctaatttgctatcacaaagcaagtgcaattctattcccttcatagaaggctctaaatataagtattttcaaagtaaggccttttttgccctcggagtcaaaactgaaatgcatttcttctcagtagatttcaagcaattcaatgtgtcagttttattttctatatttagtatttaataaaatgaaaagtgatcactttttaaaaatatctaaacttattttactacctcagccacagagctccactgtgcataatgaagaggtctgtcaactcatttatgacatacacacctgcttcctcagtttctgtatcatccaccgatgtcattgagactcccaattccaggcattttttcatgtgtgctttagatttcatatgcttcgttaggtttccttgaaaatgtagcaaaaaaaagagagaaattaattggttatcaaattaataactgctgatagctgctccaaattcaatgtgaaatgaactaattttattaaattcatcatgtaacacagatttgtttctacccactaccccttgtttcaaccttaagaagaataatctggtctttgaagatatcaatccctgagagctttggcccaatctcagatattctttattctagaagatatgtggaagtccaggctcacatcttttcaagagtaggctcaaagcaagactagaaatcccaggcttttctgcctgagaagggacctcatatctacccaaatacaccagcctcctgggactccacagaaacaggaaacgcaatctggccacacacctcagagatacttcagaatgaaatattctcaacacacccactgggcccctgaccttctgtgactgatcaggtacagagtaacctccaaggatcttcaccattcagaagaaaaatacatacaaactaatgtgagggccaaccttgtcagtgctctgaaagatccatacaaataattagctaactactcatagggagcattattcccagtatttagcatctatctgtctggcatatgttagcaaaagttatgacagcaattcctaaaattctggagcagcaacattccctctttacttatcttcaggctcctatcacactaacaaaaaagaaaggtttcatgctgaatatgttataatgataatggcatatacaattatatgtgtatatacatgtgtggatataaattatatatataatttgtataactgctttatgaaatgtgagaaattttgaaaacattgttccaatcctcgttgacccaggatctacagaagaatgcacacacacacacacacacacacacacacacacacacacacatacatataaattatatgccatataacttatcaaaagagattcaggaactaattcagttgtaaggcgcctttacatcacttcagtgaaaatagccataatgttatctgtgcccttgacaacgctttagcaatgtaccaacaaatactttaagagaaggctctgtgaaatctccgtggaaactcagcctgctagcacagtttattcctctggtaggggtgttcagcttgctgttcatgtaatatatgagccacagttaaaactgggacactgttgtttattattttactcatattgctttattatttacttattgcttatatacttataaattttacatgctgttttgaataattccaaacagaaatatttccaggcccccactcctcctatttatcaaaacttatatctaccattttttaaagagcccaaaaatgttatagacatatcaagaatgcttaaatctagaaaattaatgaaatgtatctacaaattaataaaaatcatcacttgtgccagagtgcaagtacgctatggatgtgtataggtatagatgctaagcatatcgggatagtttatttagattttagtatgtgtttctttctcctacatttttctctccattccaaggatagtcaggctttagactcccatcttcagaataggtctgtagctagaaatctggatctgaaacaattctaccatggctttagtttgttaaagtcatgagctgcagaagtaatgtataaggacaaggagagggaaggagagtggcgggggaggcccctgaagaagtggcacagacaaggagaagggattggtcatgcaagggcgttccatctgtgctcagacgacaatgtgggtttggacaacaggcatttcagtcggaggtgaaaactggcagggtttcccaggatgttttgctcattttaagattctgagacatttgcacattcccaaagggtgacaaggaaactccaataatgaccaagaataaattatttccttcaggagatgatgattcagaggcagacttaatttgatttttaaaaatatctagagatgtgtcatttcttcatccagtttttcacacaactatacctgcagcaaactcatatgcccagtgaagatatgtatcattcgtaatgactattgaattgcaatattccctgaaaccaaagtttttattttcttatctcctagggaatctcttagtaaagttctgtataaaaggcttgattgtgcagaggtgagtggtatttaaaaggccatatgattattttttgagacacaaatgaacacatacttttttcagcttcaaatgaggcaattctattacatagatctttttaataaaagagaaacagatatgttgagaggctacccatttacacttctagcaatttaggattttcagctataaaagaatataggtatacatttctctaccaaagataattttacttggtatttctttttcttgaatgagcagattaatcaatatgaaaatttaaagtgttgagggggtgcctatagtatccactaaacctaaggtaaaacacacttctgcaaaagtcgaacaacctctaattcactactgtttgtattctgagactaccagacttatgaacattttcataatattataaaaaataaaaatataaccgaagcaacttccttgagtaaaatatttttacataaatctacctgttaaaaacagattttaaaaaaaaattttaaggcaagtcctagttttataagactaacagttatgtactgagaatcagaaattgtctctgtgctgataaaaacagggaacacaagctatcaaatttctatgcataattaatgcaactgtggatgaaggcacccacctgggagtgtgtgggtctctacattatttataatcttgaaactgaccaagagcacatgttttcttcccagctgctgccttgcttctctaataccactgcatgtgcaggatttcaatactggtgtaaatattatctagaccacataacatttccaacatgaagtaatagctatccagacaatttgtagccacttcctttggagacaactggcctggacctatgtctactgctcttaattaagtcataaaaggagcctcacagtctcacatacatcctttgatcacttacttgagggagaaaatatatttcgtggaatcatattttcacaaacaaactatctttattgttgatgaaggttagttataaaatagcactcagaaatctaagtagccatagagaagtatttttcctctcaaaaaaatcagacttgtacctttcgttttgaaggcaaagttacataacttgcatacataaggccgaacatcagtatgggtacggatgtgttttttgagcatgcttggcttcttacagcgaatcccacattcttcacaaatgtactttccccggccacgtcctctgacatatacataatcttcattcgatttgtacctgttttaaaaagagggaatccagtgtgttttcaaatattcttagcatgctatatattaaagcaaaagctaattatttgcacggcaaagttttatgagggtcttttgcagacaattattcaactttacttctacgaagcctgtgaaatttatgcagtaaatggctgaaagaactagataatagatttggcactgtaaacaaaatgtaatgctccatggaattcaaaatggaattggcttcactattacatgtgaatttatagagttgggaagtagatgttcaaaatgacttatgtaaacctcaaagagctgcagacctttggactggattctagtatggcctccaatcaagggacatacaaaaagcataccaacatgttcatcatgtatcttttgttaacattacatcatctaagatgtacatgtacaaacatacaaccctctaaatttgctaaattaagtataactgataatagaattcttcattgcaagttcctactctatttttacaatcctggcacgagagtgcctcagaaatttctagtttacacagggtgagctcagctcaccaactgttgtctacagatttgatctgctcttcccaaagaccatgaatctgtaataatgtggagtctaaatttcaactagcttcttcaaggtagttacataatgaaaactagagattctatttttaatcaaatttgcatttgtttccagaagggtttcatagagatgtttgaaaggatatctgaggtcatcttgcttaatcaaatcggctagaaaaacagtcttaggtattttctttgataatcaagggaagaaatctacccaatgctcaaccattccattttagaatacaataaaacataatttgtcataagatatagtagtagtatacggactaattcaatgactgtcattatctcttaagtcaaagctaggctagaattttgggtctaatgttatttttggaaagacgctccatttggggagttcttttcataacttccaaaggtaaactgacatgcaaaatgccctaatccactgtggatttagttaaaggcactaaatttacagtttttttacattctaagagcattgcaaacttcctcattttatcctagctaatccacaaacaggaataaaggcaagtttaacttcagtcatccaatctattgaaataattttaagaaaggaaatccatccacatatttaaacagcaactctgttacggattcacatctaatcttaacgttatctactttttggtcagtaccaatccagatgagagttaagtagaaactattcaaaactatgaataatcaattttgcatgtcttccgttcctttaaatttccccccttttaccaggaattttgacttccacttgttcttcaaaattattttgaattttatctttgtcttttgcaataaagtagaaaaaaccctaaagatgcaaatgtctttcacctttaaatttcactattctctgcccctaactagatgaaattgcttaagacatatagactaaaacaaatacttttgtacaaagctaattttcttcaaggaaggatacttcaagcttactatagcctgccatcatagtgatgggaaatgcattttatcatcaagcagtataattttattttcaatgtcttagctgattaacttgcttccagaatgaaaatacagtaaaattctgtataaaatataatgatgtattagagaaactggtataaataatatatcatacaacagttctacaggcccatgaatctacttgataaggtaattgatggattttgaaaaacattcaaagctgtgtttaactaaattattgaatttattattaaacctatcagttagacaatatacacttacaattttggtcagtaatactttttatttttttagctatcactttgcaattgccaaaataagaggaggtaacacaaggtttggaaaaaacacttggtcaccactgggcagaaattgggccacagattaagaagtaatgggacacagcccataaaacggggcaattaaaggaggaggaaatgaaatatgggcacaatccttttggatcaccaaaacacagcaataaaatgttcacatacgctttttcacttgtgtccttcgttagtggagatgggctccccaaagcatacagtaattgtggagttctcgctaatctattggtgcaagtacactgctatgaaggctgctgaatgtgagagggttgattcagtcacagggacctctcagtctctgaggagagataaaatctatatttctctcgtttgtgttaaaagatgggggatgtcaaaaaaatatcaagacaagcttcatgactacatacaattgtggttttagtggtgaaaatgctagatatccaaagagggcaaaacctaagggacaaccaaatagaataatccatctccaaaccggtaatgctaggtgagaaatggatatttcatctcactgaacattccacattttatagtcaaacaagtaacattatttcctccaaatataattggaataaagtcatgcccatgaagatatgtaaataatagatttgttgtagagataaggctaattacatcataatctccaaaatgtggttagcacgcttcaaaatttttaaattttagaagcataagtgtaggcttttccttctatgtgactggatgaaagatacatttctatcaaaatctaaaacaagacattacatatgtgtaatttttcttaactatacaaataacaaagtctttgaaccttattacttgagtttctatgactcaggactcaagatttgaaaagaaattcctaaatacagagaaagtgtcatacaccagagaagactgaaaaggcaagacaactgagtgcaatgtggtaccctgacttggatcctgggacagaaaaggatattgatggaactggtgaaatcccattaaagcctctagtttagataataagaaaaacaaacaaacaaattaactagttctgaagattatacatgattgtgcatgatctgatttttgtaagcatacaataaaaatatgtccgtcaataaaacaaatacctataaaatgatcaaagaatgaacaaacttagatgacatcaagtgtccaccaatttagtagatttcataataaattagaggggtgaaaatttaaggaagaggcttgaatgatatccattagggacattttcttgcaaagcaaatcccaaaggcaagggcatgaacttatgatctattaccagccagagttcagaactgtgaatagaaaaggaatttactttcagctttcaaccagattagacagtaccttttccatgcagacattctggaccatttactctgacctataactgcacattttacatttgcactttgtttccttaccctccttcaaatattttaattcggattggctcagtttgtttggatccaatatctttatctccatgaatatctcctttccctctttcctttaagatatttcccactagtttcctttctagtttgctgccaaataaaaaggacgcatcaggtttcatctgtaagacaagaagagagaatcatttcacatgctttctccaagacacaggagcccctatgtcccactcttccatcatctctgaaaatgagcctaaattctgtactaaaaggccaggaactagttatataaaataaggaccactagggataaaatcagataagaatgacagtttccactgaataaattcaacattctgttacagctatatataataagtacatatattatatataaaaatatatagatacacatatacactcagcactctgtgcaatgctaatacttaaaagacacattctatgttttgaagtagcaatgaaaacaatctatattaattaaggaagtagtctcaaaaattattgaagggaaaatggtaactgataaaagtgaaaacatatttttaaatcctctatttgcctccttattaatttagcagaaatttcaaaattccccttaatatttttataattttacatggaaggcattgatggttcttgtaggaataaaccagccagcaacttggaaaaataagttttgaaggagacagatgtctcgtcaatgagagtaagccctgcagcatttgcaaagctcggtcctccttcttcgtctttcctttcagcctccattccctgctctatggcccacttcacaattccctgaattcctcacatccagagaaaattagacctgctaggtcactcacaaaggtcagaaggaaaataacccatgggaattaatcccagtggtaggatttcatggcacccaaatttttaaattttaaaagcataaatgtaggctttttcttctgaaaatggaccatgcctgagacctcagaaccaagtgcagtcagtggcttcttccactcctgagtaaggccagactttctgaaaacgcccccacactgaccttcattttacttgtattttttttttaggccttatatccttcactatgtagtctgctcagcaatcaaatccacaatacaaagttcttcctaaaacagtatttgttacctgagtaaactgcttccaagcacttgatgatgtaagcttgccggttccaggcctatgcatagcagccagagtataaatttctgcagtgattttttgcttggacctcagaagagccagcgtggtcttggtgttcaatcctgatgggtttggattacaggaactaatgcaccatgaagcataaaccgaggatttgaaggtggcctgttgcacataattgggttttgtataattcaagaagcaccaactcacagtagttgttgtccgcagactggggaactgaagaatctgctggaaatctgccatgtccgtgagaagaagagttgagtctgccacgttcccgctgggggcagaggccatgcggaccagcatgccaacaggccgcttgtggcccttcccttcctcttccagctgaccatctcctgctggtaatgaagaactctgtgggctcatgctcatgtccgatgccgtctcatcgatatctaattcatctgaagattctttgctttcagaaggcccactggacttctgccccggaagtggtgcccgggaaccggaaagcatctccttgctgggcaggaatggctccctggaagacgggctaacagaaggatagtcttgagatgaggagggcgacagcgaggagaaggaagatgaccctgactgcaagccatcttttggctcagaagcacatccttgtcgaaccagctggggtttctgggggcgggagaggtcctttttgatgtctgagttggtcagctccacagcactaagctcctccacaatctgtccgtacatcttttcttctttgacccttttctgctgcttggtttccatgaagagctccaagctactggctggagaaagcattcgcttgctacctcccagggtggccacgctgtcagaggtggaaggtaaacacaaggggatggaggattctaagccgaggggcaaagtctgaggtgctttccaaatggggtacttctccaagcccgcatgctgccccagcacctgggcaatgttgaatcctatcccttgcatggctgcgttggtgaccagtgtcctttgggtcatattctcatcgactttgcatatgacaatggcagggctattctgcccaagtatctgagaaatgcttgtgtacatgacacttccataggatggtacgtgcgtctggatccgaacaggaaccactgttcctgggagggactgcaaagacccagcatttgccgaggcaaaatcttcttgaagaacctgctcagagggcgtttcagttgacttactgctctggtctgatggaaactttggaagaaggttctttgggtgtagccctgatgctcctgaataacatgggtaggtctgctctttcgtgtgtgcatactcagcaggtttctttccagtgtgctctgccacatgctctaagggatagctcgaatggatttctgtctgaaaagagggcttgccatagctcttctgagggtgctgagcaaagggatgtgggaaatgtgcctgccaccagggaggctgctgagctggtaaatgaaccatacaaactgtaggatactgaaactgaaacaaggcattctggattggagaaaatggaattgtctcttgatgtggaaataagtgtggctgttcaggtaagtgcttgcttgtcatataggatgttggttggatcaagggatttctcaaagattcctgactgtccatgtgcatgatctgtggctgggccaggtgcagtggccccgagctcagcgggggacaaggacccgccacctgcttccctgggtcctcttgctgaagaggaggcagcacagcaggcgggccatggtgccacccggaccggaggccagcatgcaggtgctccagctgctcttgcttcacgctctgatccatgccaacctcgccctgggagatttctggggagccactgaaggaagcttgccgcaccagaaagcatttcttcctctccctggacggtgataccgtggaggctgctgctcccgacacaggagcatgggacagattcccataatcaaatgatttgctccgaacttctgggacttccgctgggtgaggacaaggcatctgctctgatgagcagcgtcgcatctctttctggtggtgatggcctgggacagacaatgagtatgaaccagcagggacagtcagaaactctgaatgcttcccaaactcatcctgcttaggaagtgcagaaagcttactggtttcttctctttcaaaagacatggagaaactggagctgtgggacaagttgctttcttggctggggctgcgggagaggcctgtgcctgtggattcaaagctggactcccctgaggagtgctccatatctgcaagtcgcagacgcttctttttgggtggcaacttctccgcggggagctgggaaagggtctcacttctctggggccactgaaattcttccacaggcttctctggctctttgctctgggcttccttctccttctcaggtttatcaggctcctcggtcactcgaatctcaggaacctggatgttgtgttgccgaactagcctgggctgtgtgtgataggactgctgctgcacctgctgagatggagagggtttccccccactttctgcaccatccccaggtggagcccactcaggactcactggggcttctgaaatctcactgtcacaagtctctgaaggggaaggggctttatcctgtgtgcaagccacaagttcggctgactcagacctttcaaatgaattgggtcggctcagtgagttggtgtgctgaatcacagaaatcacatttccaggaggtttcctgccccctaggtctgacatcttgtctgaatcaatggctgaaggtgactcctctgacacaagagatggacttccaggctgcagttggggccgacatgggtcaaagcgttccgtgtgaccatgagaaaggttttcgtgtccagccatggcaaatccactcctgactccttcctgcatctgcagtttggggtcataatcggaagccatgatgcccacaggagtgcttacaatgctgctgcagatcatgggcgtgtcctcttcatcccctacgctcttctctttccggcgtttcctgttttcacaggtagttccaaacatgcttggtactccctgcaatggcaccacgggatccatgaaatattctccaccatgctttaaagaactcaagcaggaaatgtccctgtagttttgctttggtgtttcagagtcctcccacttcttatagggtttccgacagacatcatagtcatacccaaccctgtccccaggagacaatttcttttccttcagggatgaactgctgatacccttcaacatcctgccatggtgctcgacttccacgtggccctcctgtaccgaaggcagctcaaatgccgcttgtcttcttagcatgcgctgagggggtatgcccacggtccctggatagaatacatcgtcggaaccagtcatcctttcatcaaatgagtgacttcctctcaaagaaggaggaatagttagattagttgctgaagaagttggcactgagttgcttctaataaggggtgaagagtctacaggagcttctaagagaaccgggttgctgccttggaagtttgctggataaagttttccttcgttcctgatagatgatggaataatctggggttgtctggactcactgttgaacttagtggatttcagcatgctcgtttgactggggtcgacatctcccttgcttgggatcagctgtgaaacaggatcttcaaacatcttgacatctaacctggtgttaacgtgaggtaatggttccattatgcccttcctacccattgcggcacgctcctgacttgtggttgtaacactgagtgcatttctcggactaagccgacagtattttccaaagatgatttcttcataagactttgcatttgtgttgggagggcttatttgctgctcagcactttctgagcgagaaaagtaaccagaatcagtgcttcctttactgtgcgggctcagaaggttgagcgatggctcagaatcttgtccttttttctctgacagtcttagtgcaagtttctgtttgactgtgtgcgaatcatcagccttagtatttaaagatggatttggtagcatatcagggccaatatactgagagctttcattagggagaggaatcccacttttagggataatcaaaatcggcaccttcattggacctcccaatgattcttccaatgacccatgatagccgcctctgctggcaatgtccagtgggatgggtggaccaggactcattttgtcagaagcctcggcaaataaagaactctcctcatctgtgtctgtactctgttcaccatctgaatgtatttctgcttctacatcaataaaaccagcctctaggtccaatttagatacagctgactctgtgaaaggtactaatcctgccttaattgcatgggcatgtgacttcctgtgcttgtacaaattgctctttgtcttgaaagagaaaccacaaggtatacatggatatggccgctccccagtatgggacctgatgtgttttttcagtacactaggtttggcacacgctctgctgcagtaagggcaaatgtacttgccaggctttttgggtttgtgctctttcttgtgagcctcttctgcctgttcaatacttttctgggagtattggctataagcagggttcagacttgaaatcttttttctaggataaccaccactgtggccatgtataggaaaaggaaataagtcctcagaggcaacggatggcaaagggccagggaaaagccacggaggaccttcgaggctctgatgtggcttggtgctgtgcatgaccccctgtggcaatgagtgctgagggaaagagagtgagtgttggcatgagtaaggactcggacgatgcggtggatattgcttctctgcgacttgctgcaccacttcactaggggaggccagtttcccagaaccaaacagttgtgctgatgctgtgtttccgatttgctcaggctctatttgtggttgccgctgtccttcatgactgccaaaagtgctcatcttaataacagctgattgttcctgtctccatctacctgatgctttatcagtttctccagaccttgaggtagctttttgtcctagagctgtgtccccagtgtccattttgttacacaaggtcttaagtgctagttcccctgaaagcagtgcagactcatggagtgtctccaaagctgtgcttcttaaagcttggttgcttccatgttccagggtgtctgcaaacttgctgattgctccttctctttggaaccttccacacgcacaccacagtcgatgggcattagctagtaatgtccttggaccagggctataacacagttctctccattgtagaaacgtccatccaaaagctaagtgcaaatctataaagatttcttatggcatttgaaaattttcaactaggatgaaattgggatgatgaatagtctaggagaaattttgcccatcaactagagcaaagttcaattgccagtttcactaagataaaatgatctgaagaaaaagaaaatacaaagagattgtcataacagtttcaaataagaaaccaaaaaaaaaaaaaacctaactaaccaaccagaaattagataaatttgaaatgttttttactccaaggaattatttttattgagattacattaattccacaattaaaatatattaatttcaaactcagcattaagtcatgaacataagtctcttccatgtttgaattttggtcactcttttaaatactttttaactttagaaaaccatttgaaggaaaatccttgatggatattatctacaaaagtataaggttttagaaagccccattaaaaaaaaatagagctattcctaaccaagttttatgacttgtatgccaaagtgtattacatatctctatatagagatatgttttatagcttaatacaaacaatatgtggccaggcatggtggctcacgcctgtaaacccagcatttggggaggctgaggcaggtggatcacgaggtcaagagactgaaaccatcctggccaaaatggtgaaaccccgtctctactaaaaatacaaaaattagctgggtgtggtggcatgcacctgtagtcccagctactcgggaggctaagggaggggaattgcttgaacccgggaggcagaggttgcagtgagctgacatcatgtcactgcactgcagcctggcgacagagcgagactccatctcaaaaaaaaaccatatatatagttacatattaatataaaatataaatataacatagtatacatataagcatacatatatgatacatgttttataaaatacataattcataaagtattatatattactataaagtataactatattttacagcttaaaatcagtgattaataaaatgacatcaaggctataagaattagatgtcacagaactttggaaaagataaaagggtgcatctaaacaaaacaattataaagtcttcttaatatagaaaacaaagcatatttctaggacagtttaaaaacgaaatgattacctgaacagtttagagttcttatgggcatgattgtcctgacgcttcctggatacaaaataaatgcagttagggaaaattgttccattaaaccttaccatcgatatatacaaatacaaattccaatttccagttcattatataaagggttcacaatgctatgtaccctaaaacgaaagcaagaaactgcttcagaaagcattacaccagaagagtaaaccttacactgacactgtgactcaaaaataactcagagaaaatattataaaaacatcatagtaatattttctaagacataagattattatatatgaaacatcttagttacttaaatgtaatcagcctagttctaattccctagatattaaaagttgagatacaggcgttttttgttttgttttttttgagatagagtctcactctggtgcccaggctggagtacagtggtgcaatcactgctcactgcagcctcgacctccctgagctcaggcgatcctcccacctcaggctcccaagtaactgggactaaaggcatgcaccactacatccatctaatttttgtattttgttgtagagatgagctcttgccatattgcccaggctggtctcaaactcctgggctcaagcaatctgcccatcttggcctcccaaagcgttaggattataggtgtgagccacctcgcctggatgaaaatagtgggtttttttttctgataggtttgaatgtttatgtttaaaagaataaatttcccttttaggaaatttacatcatagcaaagtgaaggagtcctctagatgatggcgtatggctcaggaagacttgacaactaagtaatcgttcaattttaagtgaatactcaacttccttaggggagtgttcaatgaggtacccagaggattctgagaacttcaatgataaactgtatccactgtcatagaacctcagatgtttccttgataggcaatgtgtccgtttatcaaaataaaaaagatcatacacattgacctagaaattccactgctggaaatatatccttacaggtgtacttgcacaagcgcacaccaatatatatgtacaagaaccgcttaaataaattatggctcaatgataaaactgaggcatttaaaataaataaagtacagctataagtaccaatatagaaacttgttcaggggatagtaacattaaatgcaagaaaagcttattgcaccctagtacgaagacacattgttaatcctatgggtgaaaaagaggaacagttgatcaacagaaaattcctgtgaggatgccaggcagcattggcaccagcctgaccaacatagagaaaccctgtttctactaaaaatataaaaaattagccaggcgtggtggtgcatgcctgtaatcccagctacttgggaggctgaggcaggagaattgtttggacccgggaggcagaggttgcagtgagccaagatcgagccattgcattccagcctgggcaacaagagcaaaactccatctcaaaaaaaaaaaaaaaaaaaaaaaaaaaaaaaaaaaaaaaagtggaacctgggattcagaggaagaggaaagaaaggatttttaccttccatctcatgactttcagtaagtttaatttttgtttatttttcttaacatgagcatgtttatctttttaaataaaacactagttaataattttttaaaatgctaccatgcagatgtactgcagattcctaaagcgaaactcaaatagtagtcttacttccatgggcaattttctccctaacatcgaatttgactgtgatgatgatgatgacagaagttgcactttgagaggggaaaagcacccggaaattcccacaggaacggtaagtcttttgggtgagaaatcagtagcccccagatatttgtagtaagacatctgtactcaaagattccttctgttaatggccatgaagcctaagagatttgtaaagcagcagtcaaaatactaaacaaagatattaatctcagtttgctaaaaagttttgctattggatttaattttttgctgtgcaataattttctttagcatccctctgcaggaaatgaggcaaaaacgaaacacaaatgatagtctcataatattccaatgcaaatttccttgtgtcaattccaggaaccatgctaacaagaagaagacacaatgttgaatctaaattggctgactgtgtttaattaactaaatatttaaggttcatgtagacacaacctctgccagacttgtagaggtaaataaataccctctaaaatggaaatatactacattttcaattcaagacaagcatgtatgaatcctcaattaggactcagagcttgaagtgaataatttctaagttatttttcagatttaatattttatcatggtattgatctatgtatgcagtttcattgttaattataacaatgataatgactgtcatttactatatatttaccatgggctgatacatactgttaaagagtttcatatacattgtcttattttatcttcattatacctctatgctaagggtattattacacctattttacagttgagaatgattcttagagaggttgggtttcagaatcaaaattcagatctaaatttggtgacttctaagtctgggaggactcaccactactctccattaagttttattacaacttaaaataatacatcttcaataatatcttcatctaaatatttccacttaactttaatatatgaaatgtctcaacttttaatggttctgagagaatataaatgagctctgcatgtttgtagtacaaaaaatggccccaaaatgccatttcctagaaataaaaaaatccataatttaaataatgttcaaaatatgtatattaagtattaatgagaacagcttcttgtaagaccataataaagtctcatgccagactgttttcttttgttctttgaaaatcattacttttatttttagaggaggggggtctcactttcttgtccaggctggactcaaactcatgggctcaagggatcctctgggccctgcttcccaagtagctcctaagccactgtgcccagcttggaaatcattagttttaaggaaaataagaaccttacaagtgaaaatcaggtatgtatcattttctatcttttggttgacacagaatatataattttgctcaaaacataaacttcaggggctgggcatggtggctcatgcctgtaatcctagcactttgagaggtggaggcaggtggatcgcttgagcttaggagttcgagaccagcccaggcaacatggcaaaacaccgtctctacaaaaaatacaaaaattagctgggtatggtggcgtgtacctgtagtctcagctgctcaggaggctgaggtgggagaatcacctgagcccagcaggtcgaggctgcagtgagctatgattgcagcactgcactccagcctggggaaaagagtgagactatctcaaaacaaacaaacaaacaaaacaaaaaacagcataaacttcaagtaataagtacatacaattttataaaaaacagggttggaataatttatttcataagttattcaataaaatataatgttttcacttagcaatgaggtaatacctttataaatcagacatttaatttttatggtataaaataataaaaccattcttatacactaagggcatatcatatagtaaatgcatcaaataaaattcagaaataatattttgctaccagagaatacaccagaagttgaaaaaaagtgacttacacaaaattcaaaaccagatacctcatggtcagaacaaaacatgtctagaccattaagttaattgtttaatttttaggagaaggaggataatcagaaaaaaagtcttatctatcactttattttaaaaaataattttgctaagtttaacataggatctttctatattccaacagcatttattatccagaaagtttttaagattcaaaacattaactcaattatgcaaatagcttctgtcaagaaaatctcttccttttaaatttctaagacaagcctacccgagatgccccaccattttaccaggaagctaggtgatatcccacgccatgctttctctcctgggttgtgcgggaagagcttccatctttgtgcctaagctggaggtcccagcactacagggacccctcctctgatccacaatgtctagtttttcacttcagtgaaaggcttattagggaactagaaatcatgcttatttcacatgaactttcacatttgatttgaaacatgtttgaggatgtctttttctctccaacactatccttggggagcctttgactaactgctatccataaaatcacgtctcttcttggagtttctgagacatataaagaaaggtaggtgggagagaaagtgagcgatggcttcttttagaatttattgatcatatttatgaaccattaaaaatatggactatttgtatttgtcacttttctacagctgctttatcctggaaactgaaaagattctgcaatggaaattgtgtgcatcataatctattactgaacatggcatgactttctctttaaaaacaagcaggatttgggagggtttgaaagtttctctgctactccactcatgttatactgaggaaaataaattcactttaaaaacaatagggttttcaagattagataatggcatttgtcttgttttgttaggtgacacttttactaagcaacttaactcttccaaatggcataaattcttgagcttacattttattactaaaatgtataaaaatgcttatagataacaaaacatttttaaaagtatgttagataaggaaatctacattaaatgaatcattaagtcaggaaaatactttctttggacttcataacattattacaagtcattaaatgtaccattgtatctacctgcaattttagtttaatttctgcaacagagatccacttagaactataaagatctatagtaatatggttaattatagctacagtatttctctatgactgtgtagagtcaattcatttttcagattctctaatatttcattaaaatatataccaggtttcctaatcaattgatatatcaaaaaatgcagtatgagagtaattctcatatgaaaacagcgagtcgtcactttattcactgagatttccttttatggtaaccaaacccacacaaagtcatttttggcacccactgccaacaaaggagcggaattccaaatacagttttgcattcacagttaaaattttctctagtgggttttaagtgctatgaaaggagtaagataatttactggagaataaaactcaggggatatgactttgggtttcctgtggatgctgctacagcccacaggagtcctctagtcagtaaagacagacattgtctggcaggctcatcacacttttcagagggggatcatgttaaaaaagagattacctctgcatggctatttcagtggtaatggaactaaaggaactgaagcgaaagaaaatgatattacagggaagagcaggcattcttctagaagtgtgccctctcctttggccactcttcagagtcccactcaaataagtttggcacccagttaaataatttccccagacagggtcccaaaggaaagacacataaacagcctcctagatggacctcctcagaggtctcttcaggataacggctgggtgggattggcaggaagacaggcttactctgcagaggaataaagacctacagtacccagggttgtcaatctgggatcttttgcttaggaaaacattatctcagaaaaaaaccttacctcaggaaattaatcattacttgagtggtggcaaaagtcaagtgagcattaaataatgacatcctaaataatgacggtatacaatgactggcagcaaacacggcttctccacttccaacattttaataataaaacatttttaaaaatgtaaatggtcacttggtcttttcttgaggatttggtggtatgacacttctaaacatttcgtcttttgttgaggatttgtggtttgacacttgtaaacaaaatacgtgtcttatggtaataattagtgaatgacattttagaagggacatcattgtatttgttattaaagtgccacagatcagttgtaaaatctttaaaaaatacatgaacatctcggggcattgtagttgtaacattgatcccacgagtcacttagacactcattgcccaaccaccgctcagagcatatatgctcagagagtatgggatgaggggaaaaaggaactaccaagaaagaaggcgtgatgagtgccagagtccagctgaataaagacttatttccacaggatgatttttaaaaaggtggcttcctgagagccaaattcattataaaggcttcttttagtaaaaattcccataacaacctcagttctctccaaaatgagcaagttgtctatatggagaaaactctattatatacaatcctgccaagcaattcagaaaacttttggagaaaagtaaaaatactgtgatgatcatcctctaatttgatgtaattaaaatctaatttgatatttaaagcctaatgagaaacaaacatattttttcacatgggctgcaatgcaggcatcattgcatatatttgtagagtttgcctatttagtcaagatatttatgacttattttggctacagcatgctgcttttaatattttgtcataccttttaaaataattttttaaattgtgatttcacttttctactgagatgttttctcattatacagcaaaagttattaggattcactaagtagagtctaacatgaaaataaactttgtcagaaataaattctgtcgaataatgctattttaattataacaatgataattaattataattaagattggtgggctgggtgcagtggctcacgcctgtaatcccagcactttgggaggccgaggtcaagagatcgagaccatcctggccaacatggtgaaaccctgtctctactaaaaatacaaaaattagccgggcatggtggcaggtgcctgtagtcccagctacttgggaggctgaggcagaagaatcacttgaactcgggaggcagaggttgcagtgagccaagattgtgccactgcactccagcctagcgacagagcaagactccgtcacaaaaaaaaaaaaaaaaaaaaaaaaagactagtctactatgaaaaacaaaatacaacaaaacaacacttttctctctagatggaaaatatattgtttcctccctccagtttatatatgagtccatagtaggccaaaacagcttttcaagtttaatgtaacaagagagtaagaataaataaattttagttattaacctgttatcctcatatcaaaaaactgcatcacaaccgtctttgatttccaagatgccaactctcctcacaggaactcatgcacaacttctgggaatctaaaagatgaataagaagatttaaaagatgatgacatctgtaatgaatttaataagcacgctcattcttcttcactcacagaacctgccttcctttaggaaagaaaatttggaactggatctctcaagaagctttttttttttgcccccaggaaagaatttcctttcttttaacatagtttaaatcttttgaataaatacttgtaattaaagggaattccctgtaacagtgaaatgctagagttaaaacttcaagtaccagcactagaaattgtgtcattgtagtccatgatacggttctgccacaaagctgagatttctacagaacttctttgggtgtattagcaactaaacctcgcaggatgaagtctcagataaccttgttgtaaatttgtttctatagtttatttcagcaatgttatactttgtgctaaaattaaattctgaaataggaatccaaacccaaccaaagcaaaattcagactttaaaagtctagtaagtaatgaagaaaggaacttttcatatatggaattaatatttattcaagtatgatccaaagaaatgcatggaagatcaaactacctaatctgaatagattaatcaacaatcttaacagagtttatctcccagtataaaagacctacttaaaaataatattataatacccataatcgtatatttgttatttttttaaaaaaatcgcccttttgtcctgacaagttattacaaaactcccataagaataactaaagcattaaaacataacagttaaagtgtgctttcctgcagtaccacttcatgtgaacattcaaagtgcttaaaggaagtagtttgcttcagtttccccctcctttctgcacaccactgcagtagcacttcaggacaccctgtgcacttgagacatgaatcattataagcaagtaggcccactcggttcctcaaaagacacaaaaggtgcaaaaatagcttctgcaattgaagcaagaaccacgtcagtaaccagatgaatgtgggtggtcacataagattctggtgctgcaaagggcaaattattaagcaaatgctagatttattttcttttttaaactttattcttcttgcctcaaatcaaccgtttgctggcactcaaagtgacacctgacaaggtctactattctcaaaattgaaactttcatcaatgctaaagagcatgattcattaacatagaaggaatagagatgatatcctaaaaaatatacattttctataagataattaactatatctctatctatctatctattttttttgagacggagtcttgctcagtcacccaggctggagtgcagtggcgcgatctcggctcactgcaagctctgcctcccgggttcacgccattctcctgcctcagcctcccaagtagctgggactacaggcacccaccaccacgcccagctaatttttttgcatttttagtagagatgggggtttcaccatgttagccaggatggtctcgatctcctgacctcgtgatccacctgccttggcctcccaaagtgccgggattacaggcgtgagccaccgtgcccggccaactatatctatatttttaacacactaaatatcacatctgttttaaaaaatcaaataaaagcacttcaaaaaaaacccacaaaaactataatctaggctaaagtaaagcatggcattcctcaaaaaaaaaaaaaaaaaaaaaaaaaaaaaaaaaaaaagaagaagaagaaatcactgagttattttgtactccaagcaaaatgcatccaagacataaatgggccaaggttctaaagatgcagatatttatacggaaccttaacttgcagtagtcagtgactacctgtgactggtaatctcacagtcaccaaattaagaggcaagaaggtaaaagaagagcttaattttcagtaggccagcaccaacctcccttcccttccagaaatcatcattcctaccagcagtctccacaggcaaaacagagcacgtgagtgccccccaacaagctctgatgggacagcattcccagttctgactccgtttttccagtcttactttctaagatgatggctactggaaatggtaaacactcctttcatgacatgcacatgtatttgaaattgtagattacagaagagccccctttttacccggtaagaggattcaaaaactggttctgttgcatcactcatgaccttttaaatgtttgggtttctcttgaagaagagaaaagcaatggtaatcatgttatacttatccttaccttaaagaaagttccagatgagcatgattttaaagcaaagatgcaaataatattagcatgaaagatatgatatcaattgcagcgtttttgcacaaatcattttgttataaattgaaatcagtaatggcctctacatgggacttggttattgttcttattgaaatggagatatggagatgccatctcagaaatttattttttgcattaattttaagtgagtttttgtgtctttatttctccatcaaaataaaagaaaatcctttcatcaaacagctcttgagaatgtactatgacaactcatgctcttattctcaagaaatcaacagtttacatagtatgctattaaagaaatggactaaaggaggaaagatgattatttctttaactttgcttttaggttattagcttcataagaacttaacaggcaatgaaaccttaatatttaataaaacaaacaagttttcagaaatagtgctaatgaatcttgataaaaatccaaaggtcatttaaaattccttcctaaatatgaggtaaaaattatatttcacttcaccacatacaagatggtttttctgtcaacctgcaggttaatggaagagacccttgaaaatattttccaatcctccatctcctatttgtaataaacacttggaagatttgagtattactgtttctatcccagtggtttctcagccttcccattcttagaagaaaaaaaatccttggcattagttacttgttgttggatgcttataggttattactattaagctaagcaagagtcaagctactgattcatagatgacagataagatagacattttaaaaatacccattgttagtggggttgtctttttccattctctacttttccaaattgtttcaaaacaagttacagttaatgctttaatatgactcttacatgaatctagcaagaggtgaaggtttcattggcagaactctcaagtacctcccatcacccttgttttttctgaggttaaataaatacacactatatcacaattttaggagaagagctgataaggtaaaccagttacactttagatgagcattgtcataattaaaaacaataattattggctggatgtagtggctcacacctgtaatcccagcactttgggaggattgcttaagaccaggaggttgagaccagtctgggcaacaaagcaagaccctatctctataaaaaaaaatttaagcaggtgtggtggtgcacatctgtagtcccagctgcttgggaggctgaggtaagaagatcatttgaacccaggagtttggcgctgcagtgagctataattgcaccagtctgggggatagagtgagaccccgtctcaaaaataaataaataaataaataaaaacaacatcaatgaaaataattcttataaactcaatggaaaaatggcaaatagaaactggaaacaagatatgatagttttatttctcagtaaaaagagtgtttaagtattacatgtttaaaagaatgaacactactcttcactagagaagagacactttactcttatagtagggaatagaaaagattcaaaagtagtgactaaagatgggagaagagcactgaaagagatatcaatgttcaagatataatccatcaatttcacaagctttttgtagaggcatcttttcctctctacaaaaaaaaaaaaaaaaagactctaaatgggcccattgttccactctggagtgcgtaaagtggcaaaggaagaagaggctgcgaaggactagagaaggcaggtacaggatagacaacacacatacacacacacacatacattgacaggatgatgactataagcttagatcttcagaaatatttttgatataaaggtaatggatgaggttggggttgaaatgtaaaaaagaaaacatattaaagggacatgactaggaaaagagaaacatagtagttttggaacatggggcaattcattactgggacaacaatgtagaaggttttgaaaagtcaagaaggtgcatggaaggaaggattcccacagagttttcataataggaggctggggcaaactgagtccaaattagccagaaactgcccataaaaatgacaccaaagctacatatggtctattgctgattctcagcaggtagtgcaggagcacagaaaagataggaaacaaagcattgtgtaaattaaaactagtgaaaacaaacaaaaaaagcagatacatgtgcattagagattgtaacttaggcctctttaaataggatttctgattattctatgatactttaagacatttacttatacctaatgttaaatgacgagttaatgggtgcagcacaccaatatggcacatgtatacatatgtaacaaacctgcacattgtgcacatgtaccctaaaacttaaagtataataaaaaaaaatccccccctcaaaaaaaagacatttactgaatgcctacgatatgccagaaatgggctgtatttacacaatacagaaaaagaaaagacaagcattgcatttaagagcacagagctggctgggtatggtggctcacacctgtaatcccagcactttgggaggcccaggcgggcagctcacttgaggtcacgacttcaagaccagcctagccaacatggtgaaaccctgtttctactaaaaatacaaaaattagccgggtgtggtggctggaacctgtaatcccaactactcaggaggctgaggcaggaaaatctcttgaacccgggaagcagaggttgcagtgagccaagatcacaccactgcactccagtctgggtaacagagcaagactccatctcgaaaaacaacaacaacaaacaaacaaacaaaacaaacaaacaaacgaagagctcagagcttcagcggggagatatttgtgaattagttcaacaaatgacataaatataaacagattacaaaggagattacaagagggaatggtcactcctttctggaaagttagaaaaggctttctagatgtaacgacactgaacttaatatttaaataaaactatatatgctaatatacagaaatgcacagttatcaatgttagatttagagacaaatacatttgtcagatgaaataaaaatacaagactctaccattccggtttctctatgattatatatactttattttgtgtgatggaatgttggttcatgaggatgcttggggaataaggtgttctagttaatacaatcttatggttaggtaaagaccacagagaaaatcattttttgttaaacatctggtggtaatttattttcaaaagtacactagcttttgccttgagttaattacagtctactaaccataatttaatcttcctttgatggttcaggatcatatagtgttctccagtcattctgcatcttggctgtgctcatctggtattggccatgcaaacttctcccaacatgtgtccttaaaacacacgtcatgttttctaagataagagctataacctaggtttgttttcttgacccaatttgacatcacgtaagtcatatatctgactaacttgattttaggagcaaatatatgactacaaacttctattactatttaaatgtttagcttattctaaatcatataggcagtgtttagggctatggaataatttagaaaccattgaatttaatctatcaggcaactaacaaatgaaaaaggtgagaaccagagaagtcaaaagacttgcttagggacccacagctcattatgatagttctggtctacagcttaggtctttaaactgtcaagtcaattattttccattatccacactacttcctcttattcaaagtttatttatctaaccctatttcagaaattgattgaatgagtaaagaagtaaaaaatgaagaattaataattttgaaattcaaatgagcaaagatatttataatccataatcaaagaaacagaaaataacagtagttaaggatcaatgctccactgaaatgtttatcaatttttatactaaataaaaataaatgcaacaaaaattttaatttttccaaaatgagtaaatgacagaaaaattagaagataatcaatttccataagcagtgcattatttagtatccaaagcaaaaataattacttaatttacaaccaattttcagtataagctattttctaagatttttatgctcttataacgaaaatttttcagtaaatattttaagtagagttatgagaccatcttcctaaaagcaaagatagctctttcattgaaagtcaatggaggcaagccccttgttcataataccaaaatttcacctaggagacctgtgaagacatggtaacaccaactccacaggcactacttcttctgctgcattggttttgcaaaagggcagagccaagtagatgttttgtataattaaaaatctttttttgctctctcttttgtgatacattttcccatttttatttttttccttcccttccatttcctctatcttatcccttaatatggtaggtaaataactacttctagccaagccagcttaaacatttactctttaactaaatatttggagagacagggataaaagcaaaaaaggtgtatttgactaccatactctagtgagaagtatatatgacacaacaaagtcataactccaatgtactgttttctcaagttttatcttttacaatgcttatgtttactattcggttgctgcagatatacataaataaggtcatgattctccaattttctttttactcctgggtatgccaagactagcataaagaaaggccgcagttaactttgaattaagtaaacaaagagaacagagaaatcaaatcataaaatatgcattatattcataagtattcatataacaggctgaccttgcctgaagaaaatccatctttgagggaagatcctcctgcatcagtggaaataatacccaaagcaatgaaagcacagctgaaaatatgaattgcatcccacatttcatgctacaaacaattctcagatgtgatgaaaaataaaattgtcttcagtctctcgtaggtctacacacaataaaaatctctcaaaaagaaatcaaggcaaagcctatgacatatcatataacctaatcagacagaccctatctacttctaataactgagctgctgaaagaatcaattctatttcctctcttgacaattttcctagagagtggggaaattggtctgtgtgcctgtgtagagatatacaacctcaggaaaccaaagaacaaatctggactcacactgtcccaggttctataaggtacatagggtaagtggatactatctctcaagacttcagaaattgacatgaggttagcacacagcaaataacctgaacatcagttgttctcagagattaggaaccatatgatcaaaaatggcttgaacaaccaggaaagactagacagagggaaggggctcaagtggaagccatgatttgcacaaatgaattaactagataaagatttattattaacctgtgctacatggttattcaggtacctccttgacattttgacaaactgtgaatggcattcatacttttggtctcatctcagaatatatcattgcctacaaagtttaaggctaaaaaaattcaagtttcaagcaggcatttataagatcctattgggcaaattctgtcaggcaattccagaattccatctgcaggctcattcattcagtcaaattacattttttccaaagctcatatatactaatgtgatgaaataaaacattactaaaatgcaaacttcatatttctttgagtttgaatccagatattactgcctcatttaccaaaaaatccccaaatacatataaatttaaatcaatttcaatgacaccaagtaagaattaaaaatagtgtgcatgtgtaggatcaagacaaatgagagaacattctgctttcaaagagcttactgtctaatgagtaaggaaaacatatgaacaacgagctataaaagcaatagaggcatgaaatggtgttgtgagtatatgaagacaggagattgcttagaaatgctgcatttaaggaactctatcttagattttgaaagaaggctcagatttgcaggcagagatgcatttaatgtgaggttattatcgtgacatagacaagagaaggggtattggagaaacagtctgtctgcctagaacattaggcacactgaggtgatggtggtggcagaaggtaaagaactttagttggcagacacagagagacatcagtggttctgagaagacaactgccacagtcacagagacactttagaaagctattatatcccatttctttccatccctttcgggcaaactctgcaaatgtatagcctgaaaaagaataaagattaagaagaagtttgttttaaggcaaggagacttggagcaaaggaggaaaagatacaagtaataagataatggaataaactctttaaaaagtgggatactatgcagccataaaaaagaatgagttcatgtcctttgcaaggacatggatgaagctggaagccatcattctcagcaaactaacaggggaacagaaaaacacggcatgttctcactcataagtgggagctgaacaatgagaacacacggacacaggaaggggaacatcacacaccggggcctgtcgggtggtggaggacaaggggagggagagcattaggacaaatacctaagcatgcggggcttaaaacctagatggcaggttgataggcgcagcaaacaaccatggcacatgcatacctatgtaacaaacctgaacattctgcacatgtatcccagaatttaaaataaaataaaataaaactaataaataaataaatgaatatttcattaaagaatgaataaaagaaagtgggaaccaaaaaggaactcaaaagcataaataaggaatctgtcagaagaaagcatgaaaatttttctgttttagaatggagggaaggaagatataatgaagcaagataacttttcagatagaaaagaaactgaggagtcccttcttaatatctcagaaaagtagaaggtgaggtctgctgatgggagcagggaactagctgtgctagaggggcttgatgagtggggaacagtcaatttgccttaagtattagtacttgcagcagtcttaggaaaaacactacttcttattaggccatttaaaaagagtattttccaaacttttttctgagtcaataaccatatccaaataatttaataatatatccaaaagtttatcttttattctaaaataaaactcttaagatgattaactataagctattatgtatgaacagtagatttaagactgttatattttttaaaaactgtatatatctctcataattctacataactacctagagtagaaaattgtgatactcatgctgtgcttcattgtatagaaatttagggaatatttactgatgacttgaatatttactttttagcatcattagtgactgaggtgattcttttcagtgaattaaccaataatttaacaaaggaaattgatgacgatattctatgccacatttcttttccgataccatgattaccaaaatatgtattgcttgatactatgggcagagtaaggtgtcaattctagtatatttagcaattaaaaaggaactccatgttttataatttattaatttctttctttctacctcccccctcccacctcccatccttccttctctttctttctttctttctttctttctttctttcttttttctttctttctttctctctctctctctctctctctctgtctgtctttctttccttctttctttcagacagggtccagctctgtcacacccaggctaaagtgcctccctctgccttctgcctcagcctttcaagtagctgggactataggtgcccaccaccatatctggcaaatttttgcattttttgtagcgacagggttttgccatgttgcccaagctggtctcaaactcccgggcttaagcgatctgcctgccttggtctcccaaagtgttgggattacaggtgtgagccactgtgactagccctcatggtttataatttctaactgtctacttaaaatgaagtgatatgggagaaatttatctggactcaaaatcaggaagaattttatttttatttaaaattagctttatagacactacattttaagcctattctattccctctttgggctgactgatagaaagctaagatctaaatctgtggccatcttataggaaggatctagacattctaggcatgtgttttggtcactaacatcacttctagcttcaagtactatttctacttttctttcccattgtctcatactgataattaacaatatgtacacaaacaaacacacagatctcaataatggggactattaaataaggcaataaatgtaactaggaactgtttccaaagttgaatctatttgtatatttcaatagtttgagcaacacaactgtgaagactaattagttccagctctgtgaaaaatgacagaagctctctgaatatgtgccttttccttagccttcaactgtattgattccaagagaagaagagctttcgtaaatataacagaaaaggtacatataacataactggataggagcactaattatttttgcttctctaaggaactgcttaagaataatatggaaataatatggtcaaattatattatctttgagctatggtcaaatttccagctactgtcaaagctcagcagcagacaaggcaaatgcatctgacatattcttggacatggataacttacaccggcagatcctacacacaaatcctgtgcagtgtactgaagcgggtggatgaaggttttgtctctgttgaacacccatggggttataaattcagatttagaaacatgtactttaataagttttgaagccatttgatcagaaagcattacaagtctcaaattgacctctacttttaaggtaaagcttcaactatcctaagtgttactccaattttaaacaatgaattaaagagcctgaaaatcattttcagtgtcattttgattaaccaattatatgtgatctaatttgatctttctcctcaaataaatgtaaacactaaagagtgtgtgtttggaactcttaatttgggtttcagtcagcattgagcaatatctaatataaacatattggcttaatttttatattcctcacacatataaataatttgaagaatgcaatttaaacaaggcaaccagaagttatttgccctgaaaaattataataaattaaaaaattgtttttagttttgaaagcagtttgccaaaatctgcaggcctgtgaatggtctgaattcatacaatattcagtgacttctcatttattgatgttatttggaatctcactttcattctttctcacatatcactgaagggaaaaaatttgcttaagaaaaaaacaacccacctaatcaagaattcttcattagcacagattttcatcaaaacaaacaaaagtagagaaaaataagaaaaaacaaataatcaaataaaaacaaagaaaattgcaacataaagtattttaatcattttgtccaatttctatcagacttgctctggtttcactgagggccttagataaggtgccagaactaattttattgcagcttctgctctctgattttaacatagatgtaaattatttgaataaatatttatagattatagtgagtctttcaacaggtaactagcaatacaatatagagaagaaaatgttttagtaatgtcttgtctatgtatattatttttcaaaacttatttcagtctcacaatagccttgtaatggaagaagagcatgagaaaacggatgctcagaaaggttaagcaattgtcaaagaaattcctcaaagatcacacagcagtgggtcactccttggcctcctgcttctcagtgcaaggctgtttccattggcggtacatggacataggtttaagatcccatctgccatggacaaaccgtgggtgaatccctgttggagcttgagtttcctcatacataagaaggggataataaaggtgctggcccatttctccaccactctatgggggagcccacgtggagaggacacatgaaagtgacctgtcaattttaaattgccaagtagtagatatattgctgttgtcattgatactaatgaacaaagcagttttattgctgaataaggaaacccaagctgaagaaatgttaatgtctaggccctaactaaaacttcctgcttcactgagggctctgagtacgtcctatcagcatagtaaacagtcagaaagcttttatacagtgactaaagttgactcttgaatgccgcaggggttaggatgttgatcttacccctaccctggaccgagcagttgaaaatctgcatatgatttttgactcctccaaaacctaactactaataaactactgttgaacagaagccttaccgataacctaagcagtggatgaacacatattttgtatgttgtctgtattatatactgtattcctacaataataagctagaaaaaatgttattaagaaaatcataaggaagtgaaaataaatttactgtactgtactgtatttattgatcccattaagttttcatcatctgtttacaggatgaattatctgcctgaaatggtggcaactgcagctgtagacctcaaactgcagtacacattaagcaatccagctttttctaatgtcatgactttcctctgcttctggggagcacttctagcattagtaatggcacttcctgtgggtcccatggtgttattcaaggtttaaactattgcattaaacatgatgaaaaatgtgcaagaaccaggagagatcactttttattgcgtctgcactttgctggccgacaaacctctcacacggagatgattggcatcacatggcgttttaagtggatgcttgcaacacttgagctcactgcagtagcaacaggagggaactacagaattattacggtagtacagcaggtacaacagttagttttatgcagatttaatactgcatctttacctgtgtttacatgtctctcatcatgaatggtgccatgtatggtctatgtgtgtgcaaaagttttggcaaattttaactttttataatagatgtatgtatatttcatggtagtaaatgacaaaatagtgtctacatatattttatacactcctaacacacctaactttttctttttttgatgtttctagattttttgatatttctgatattttattcattaaatagaaaccaccttaacatcaacacaatgcttacaagttctggatgaaaaattaaaaaaaaattttttagaattcattaaacttcatctatccaagtcactccaaatttatgtgaaatatttagttctaaatgatttcacaatactttcctacatggaacaaatagttgtaactcatcaaaagtaacaagtctgaaatactttagtcagggagacagtaattaggattttaagctaataagggcataaatattttagatagagaatagagacaatatcacccaaaactgtaaacaaagtgctattcttcttgaataacagttttccattgcatacatatgtgcttggggcgcccagatagtatggacaaaatacccccttattcccaattttgctttctgcagtttcagttaccctcagtcaaccatggtgggaaaataggtgagaacagtacaataacatattttgagaatgagagagagaccacactcacacaacttgtattacaatatattgttataattgtcctttttaattattagttattgttgtggatctcttactgtgtctaagttataaattaaactttatcataggtatgtatgcacagaagaaatcatagtatacataggattcagtaccctctatggtttcaggcattcaattgggggtcttggaatatatcccccttggataagggagaccactgtacacacaggtctggaaaaatcctcttttttgccagaaacttagtgattttatgtcaaggaggaatattataaataattctgacttgggcttctaggtaacagtagctggtgcctgtcaaacattaaaagggattttcatcctgagaagccataaggaattctctcttatggtggtgaggagagaaagtcagggatttctttggtcattgctactaccatgagtggagacagcctgatggcacatctgatacacagaggagacagtcagacaccccaacaaaagaaactagctcctcttgcagtgagctgagatcgcgccactgcactccagcctgggcaacagagtgagacttcgtctcaaaaaaaaaagaaaagaaaagaaaagaaaagaaaccggctcctcaaggcttcacagatctctggagcaagctttggctgaaagcacaccaccactgtattgttgcaattcatgaatcaataatgtttccatttttgctttagatagttcctgtcaagttccctgttccttgctgtcaatagtgtcatacaaatgctataattaaaacgccttggttgaaacaggtttggttggctggtgcttccccctttctagatccacctgcatgcccatgaagatggcatgaaaccaagaaatagcaaggttgtacagtgtttcgcctgggttgcagttttctgcctaacctaccctctcaaaatgagaagagattatgctcctaactgcttagggacaaggatgacctcatgcagatggggttgattgatgaagtacatagtctttcgagtgaagacagaactgagtcccaattctaatgcacaattcaccagctatgagatcttggttatataactaattctcctaacatgtttctttattatgaaatgggatactaatagttattatgccagcaggttgtgagtattaaatgagatagcacatgcaaatcattcaggacaatacctagcacttgtaaaatgtcataaaatattggcattcttatttatatattagcagagttaagtttccagaagctataaatacaggcaaacattgcatttacaaaagtaggtacttgacttttattatttgagctataggggtaacaagtgaccataagttgaaaatggttatttgattttgcatgcatgcaagcacatgtgaaatatgtgtttatatctgtagattttgtcttagcacaggtgaaatactgaaaacatgaaatattacttaaagcatgaaatgctgaaaaggcaaactgttcttaatgtatttcataaacaaaacattactacatagaatataaatgccaaaattcctgctttggagtttgttcttgtattatgtcataatgactagccattaaatgtaactcatttttttggcttgtcagtgggaaacaacattctcgtcctaagtgcagcccgggaggagacagcgctatctatggtaacacctaggcatccttaaaagacagataggaatatgaatcttgtccatttcagggacagccatttcttgctgaggggctaaaccactaagaaaagaggagacagagcatcaggcattatctcttcttggaagaaatgaatattcatattactattcattgtcactagtcactattgaagtgactaaaaattagtaaatttctggtcatcagtggacagctgcaacatcaacaaattatttgaaaaatcaacacctgctgaaagcatgttttccccaaaaccttattgaagtcccaaacatcagagttgtcaactaacttctataatgctatctgaaactgcaattaaagttcaaggtggtagaatagcaaactagtgacatcaaacagcaggggagcctctgggctaagatgcagttagtccacaaacatagtccctttgcagtctagcagggaatgatacatcagcaccaggtccatgacaggaacccagcatcgctgattagtttgaaattttccttgctcatttgtgcatgaaaagccatatatcacttaatgccaatgaccaagagtcttctcaaaccagggtcaaattgctaaaggctatttttttcctagcatattgaaaaacctcattttttcccaagaactttcccagaaattagactaagcagcaaatattttccctttacttcagatttattgtctgggctaccacacacccaggtggcagcaaaaaacactgaaaatgtctgcatttggctggtgtggaataaatggtcttaatagctcacaaatatctgaggaattaaacctaggaagacagcatcaccacattgagctgctgaagtgcatgtctactacttcaatttttagatgacaatattcaattaacaaccatggtatcatattagtcattattaacacttactaagcacctctgcctctagtatgcaaagtgcagaattcaagtttaatatggtgggactctaactgtcagatggcatcttcactggatttatgcttctctatgaaacaatgggttcctttccaagctaatcatcttaagtttctaagtatttggccttcatttttatatatgcctaatatgctcagaaacaagaaatgcatgactaatcacaagtaaatttataaaagaatacattttctgcttagagtgataagtatctttttgatgagaatgatttagttttattgagagagattaaaatttaaaaccagcaactaaaatcttagaaatgcttccctttaatattctcagggatgataaacagaaaataaaaaaaggagaatttgagaggcttaggaggaggaatccctcaaaatgcatagaagatatttagatctatgaaaataattcaaagaactggctctattatataaaactggaaagatccttctgttctgatgttgagtgtctctccctaggctaatccaaacggctcagaaaggtcatgtgctataacagacaatagctttagaagatcataattttatcttttgttgctttttgatgttaatgagtaaataatggcatttcttgacaaagactagttacatagtgataactggcagaaacctctacattttgaccagagtgaatactgtaggagtcacctcactatatagtgtggggaacataatggactgagcctgcacaaggaaaagaggccagggtagcccatgtgatggctcggcttgccctgtctattcagttctgatgttctctgcaggtcagaagagaggacctttcccagggactcaccaggtatgaggtcaagcagtggccagtgtcaaaaaaaaaaaaaaaaaaaacgagggaatacacacaataccttcagttaagaggtactatgatagcatgaaaagaacactagattaaggcaaatgtcagcagactataaaatacattctcaccagaagaattgcttgaacccaggaggcggaggttgcagtgagctgagatgagattgtgccactgcagtccagcctgggagacagagtgagactctgtctcaaaaaaaaaaaaaaaaaaaaattctcacttgagaaagttagataacattctcacttgcaaaagctaaataaggccaacgatcactgagatagtgattgccagtaattacaagaatctaagcgaattctcttttactccagatctagtatttccacatcacctctcagttagcagaccaattcagctctcctgattatgtacccttgtataagtcacttccacttagtgggacttggtttcccatctataaaatggacacaataattcctgccctgctatcttcctgggttactgtaagaactaagtgaatctccatatgtgaaaacaatatgaaaatgaaaatcactagatcattgtaagatatgaattttaaatccatggcccttctcaatcacagttttatagatgtcccatcacaggccttctgtgtcatgacttaagttccaacatagttcatttgtattcatctttaaatgtaagtatatccttctccttaaagttctccacaagtccttttctgtgaaaacacaagatagacatctactaattattccatctcactgtgccatattaatctgtagactggagtatgaggccccaggaggttgggattctgtctgtatttgttaatatactaccagctgctgtaacaaacaaaatccaaaatgcataggggctcattctcaatagcaatctaaaatgtgtgttctgatagatgggtggctccatactgggaggaattaaaaagcccaaactccttcaaacttatggcttcaccatctgcaacaaggattcaatcttctgccatgattatgacaaaagcacagaagcatagagggtaaaccaggagagggtttgatgagtcaggtgatgaagttgcacacagggacttccccccacattccattcactagaactcagccacatggctcatctctctgtagcaaggcctgggaaatgcagtctaactgtgagtccagtaagaacaggacacaggtttggtaaacagccagccagtctctgccaccctcatactcgaaatttaaaggatgctttctaatgtatgaatgaactgactagtacatctgagtcttggccatgaagtaataaaggaaaaaaaaaaagaaaactactatacgtaaatcatgttcacagctctaattcacttaatttcacaaatcactgtttgcccttctattcctaatatatgcaaacccaattttaaggatgaaaaatgacattgctaaaagaaaaaagaaaagcatcataaacaaagcttaaagtttctaaaaaagaatcactccctaataagggaatatcatggagagaagagaatcatgaacagatagaattttccagcaatacacaaagaaaagataaaaataatgtgatagcttctacttgctgtgcaatttactttggaattttacatttttatactaagaggtaaagtcctgccatgtttctgtagctaagctagactttacaacataaaattctgattttgatggtttaatatctaagttgttttaaaataaattgagtttaaagactgaccaaatgtatgaattaaaaaaaagatctttggcatttttaagtaaagtcactaagtacagcaagaatgaatgcagggtcttttaaaggcatcatataaaactctgtagtatatacttttaaatgtctgcatttgaccaggtcaagattgctagtgtatttaattcttactaaaagaaatctatgaagtataagtttaaacttcatttggtaactaagtgcatatgccagcatttcatcataacctagaagtttcaggtgatgaaatgctacagtgaatgctccaaccaggaggatctctttactttagtggaatttgcttcaccacacaagctttcaaaatagatttatttctgctattttttctgactatattttaaaagagaaatgacataggtttcacagatgctggtgaaataattacagttgcaaaggcaaggcatataattagttgaagaacagggttaaaaaaagatttcacctacactacgtgggtacaaagacttagggttaactgtgaagcaactgctgtctgcatctttcatagctataaccaacactgaggcaaaaaataccccaactatatatatatatagcatacacacacacacacacacacacacacacacaaaactcaggacacaaagagaagatatccttcctaaactcaaaagcgcacagatgcttacactgaaaataaagtcagtagttgccttcactgcataggcgtcagcaaaaatcaggacagagcaaggacaggagagagaacaatgaagaatgattcctcctttcctataatcaagggccacaattcactccctgagacacagagagatgacttctcttctttggcacccagtgtatgggaacatcactccttcacacacccctgactcctgaggagtgggaggctgaaagtaccaggaaaggaaccaaatcatctcattttcatatgaacctgttgaactcctaagcatttcaacttctaagctgaaagagctcttaagcatgaattatcaaaagctgtttatcacctgttttcacaatctcctaattctaagaagtttccaagcaagtctacaatgacacagtgcatcaaactctagtacaaactttaattgcatatggaagcacaatgccagtgtattttattcaatatgtataaattttaattggaaaaattttctcacagcttaaacaatcacaccttagtgatgaagagctcaaaggacttgtgaataattataaatgaatactatacgtagttgtggcctggagaactccactcaatttcagaaaatgttacaccagtactaaagtagattgattgagtgtcccacaaagacagcaggtaagaggtggtttggaaggcaggtacaataatagggtcacactctcctgatctggcttgacaccatgataatttttagaacatcaggattcataactctagtcctttcagaggaaggcaggtaatgaagatgtgtaaagtggcttgctgaagacaagaaagagaattattagtgcccaaaagccaactgaagacttaatggcctgcctttatgtgaatcaaattgaaaaaaaaatacacatttggaggtcctgagttatgacccctgcttggaaaaacaaatgccagcatacttctgtcaactaacctaactaacctttgcataaggtattaagcaacagtaaaaagttaaaaattgttctctgacacatgttggggtgtagatactctagcttattagtcaaataaggactctatagtcataatagatggtctgtgggagaagggcaaagctgacatccttttaacaaaataaggcagcctaataatgtgcttgagattataaggccattccacctcaccttggagaaaggcttaaaaaaaatcccacaggaaaagtgctagataattattgtgaatagactttttaaagatgaatggagaatagtcatcctttcaattggattccacaggccatggccacaaattttagcctttgctccccaaaataaacaaacaaacaacaaaaaacacataatcaacaagttcccttaacagtgtgctgagtgccaccctacataacgccagattgtgaggtatatacccttcaagatgaactagatgcaaaacatacaccaggtataataaaagaaggagaagatgggctgtaaacaggggagtaattacatgggctggcaaggctagcagatgtctttagggaactagagagccaaaggagccaggagggcctggtatgtgaccctggccacttgtaccagccagcctgtgcacaagagggaacagcttgtgctccccatggagggacagggaagcaattaactccaacattcccttctcaaggaaccccccagctcctctctaccccctgaaatcccagccagcctcagagagtatcatggtaataagccagatcccaacactgccccccaacaactgccccctatcccaacttgggaaccttttacttagagcttgctctttctgttggtggaagaggacacagagagacaaaggaatcctgccttcctttgctcatcttcagggctttccaagtagggcagagttttacagaaaaaaaaaaaaatctacttttcttcaaggcgaggaccttatacagaaaatagcatatgggaacagtttcagggaaggtctgagaagactgcgtgtctcctgacctagctctaccatctcatcaacttgctgagctcatatttaagcatacaagagctcttcagactgcacatagattttataatgccacctaccaagggcctaatttggagggctctggtagaggcttatgaaacaccaatatgtagggtgctaaaagccttacctttcattaatttaacaaatatttaatgagcatataccaagtgtcagatgttttgcctggtgccaggtctacaatggggaatcagacatcatctccgtctgccctgcagaaattgtgcctagaggacagccctctcaacacaggttagaactactgttctcaacctggatagatctcaatacatctacacattaactaacatcttcgtctaaaaagcagtattttaaaaaatttcatcatcaataccaatacctgtactgagtattactgtacctactgggttactgccctgtagatctgccttagtcttattcactgtcagtactcccaatatactcacattttggagaaataggatacaaaatggcttatgttctcaagtagcttacaatctcctttgagaaacaaaatatttacatgaaaccataaatgatagagtggaaaagatactatggaaaattcatgcaaatattcaataaacaggctgcataaaatttggtatccaggctgctctgcctatggagtagccattctttattcctttacttcttaataaacttgctttcactttactctaaaaaaccatgtgttatccaaatcataacacttctcagagcaaaggggagaactattaatacttaatattgggaatgtctctggcaattcaaaacctaagatcactattttcacaaatccctttttttgggaggtgaattctctaattcaaaaaccatattcagttcctcatcaaagaaatatttatggaaaatttaccatattcaaggtataatggcaggcttttctagaggtaggctttgagcaggagctcacagagataaataagacataattcttatttatctatttattcttatctgtctgtctatctaagacattaaaataccataaacgcataccatgtgatgttcttatgctcagctttttgcatatacattatctcatttagtcatcaaaacaaccctaggagataaacagtattactactattttatagatgaggcttctagtggttaagtaactgtccaggatccacggtccctctggctgtaaggagctggcattggaactaggtacatctcattgcaatacccagctcctactctgtgacaggtactgcatggattattctgaggaggaaaacatgtatttcttgttagagtaatcaaggatgactcaacaggggataagtgatgttacatatagatcttgaaggactgagttagaaggattttaaaaggcaaagagtagaggggatggcaacccagggaggtggaacaatggaccaatagcctggagctggaaagactaagcattgagcaaggaggagtcaacttggccagtacttcatagttctgagtagaggacctaggaactgtaagactggaagacaggtaagctgaagtcacctttccctttgtgtttaatttaagcaaataggaaactcagtttgcatgccctgagtacactccatagtgaatttgcattgacgccaaccagttcatccaggtcaagatgtctgggaggtagagggcttcatacagctggcctgaagggggcattctatcatccaaaggcatgacagtgccaactcatggctggatgtagttctggcaaaactgaaatgatgtaaatcaatctaatttttttccatagaaataatgttataatgagtgtgatatttcatataaatggctggatacccacgttctcataaaaagcaccccaaacgccttaaacagtagtcccataacttgtatctgctgaagaataatatcttcagtgtgtacatgtaaattaaattggctggtgtcatagtcataattttaataagtcgaaactatcccaggagacaaaacctttgcaatattgggagggactctaggacaagtcaaagtgactccaaagagagaggctatgcacaaggccaggaggccaccagctggcagaaagctgccataaagaacagaaggactggccagtgacccaaaacctgtggggtcaagtcgtaggcaaaaggattacaagatcaaggccagctgtagagcatgtccctacctccaggctcttcctcatccacataaagtctcctaaagcaatatttctagtcttactgctctcctgctcaaagcctttcagtgactccccatttcctacccagttccaaactccatgtctatcacttagggccctccagaatctggtttactgtccatccagcctaatcttccactacatctactccaacaagctaggctgtagaaagatggcttagtcattattctcaagcataagaggcatctttatgcctttgctcaggccatgagcttggcttggcagactttccttatgatctgtatcatgatctattaaaacttacctagacataagacccaactcatatgccagctgtttcatgaaacttgatacacaagaaatgctctgtaaatatgtctgtgggtgaatggatggaaggaaggagggagggagggatgaaggaagggacggatggaagagatagaggcagggatggatggaaggagagatggagggatagatgggtggacagaggcaaggagggagggagagatgaagaaagggatggagggaagagagagatgtgggagggatggatggatggatagatggagggatgaatagacagagggaaggagggagggagggatgaagaaagggatggatggaagagagagatgggggagggatggacggatggatagatggagggatggacagatagagggaagtagggagggagggatagagggatggagagaagaaaggagggctagatggatagaaggatggatgaatagaaggatggatggagggatggaggaaaggatgggggagggatgaatggatgggggatagaggcagggagggaggaaagtatggaaggatgaatggatggagggaggaagggaatgctggatgaagggataaatggatggatggtggaggacctcataacgaatctctcagctggtataatcattctcctgtcagtatgccatagtacatatttgttcctattttaaaacgttgcatgctctcttcttccattaacatttgaatacagctcttctcttccttattaaatgaaaggctcctgaaggctgaattatattcatctttgtatcccacacaaatccgagtacaaggtctttcacagaatacgtgcttaagatatcacagtatcagtagtatggtatgcccagcagcaggcagaaaacatgcataatggaaagcataatccatgtaagggatgaatactagatatgaatggctgtaaatggacctacgtcagctttaactattccagacaaaagtcaggtctctaatctgaagttacctttaggcagagacagacaaggtcatcacctcttactcctccttcaggcctcaattctggcaccatcttttccctgaagcctgagaacactcgccctgcctcacccatcctgagattctaagccctccctctcctcactcttggcactgggcacacacccctttaagatacaggctgagtgtgctcctatgtaactactgcccccgtgtctctcttcagagcagaagagttggctttgctcatctctgtgacccattattccagaacagtatttggcacacacttggctcttaataaagacttctttgtaagtacttcattttagaagtacttagctaatattctgggttttctgtttgtttgtttgtttgtttgtttgttttgagatggggtctcactctgtcagccaggctggagtgcagtggcacgatctcagctcactgtaacctctgcctccctagttcaagtgattctcctgcctcagcctcccaagtatctgggattacaggtgcccaccaccatgtcctgctaattttttgtatttttagtagagacggggtttcaccatgttggcaggctggtcttgaactcctgacctcaagtgatccacctgccacagcctcccagagtgctgagattacaggcatgagccactgtgcccggcccaatattctaatttttaaacatctaccaggtacaatcatcattgttaacaaacccaggatatgttgctaaatctcttagggtcataggacataggctaggctttacagtcaggcagccccagctgggaatatcagctctgcttcttctaggtttgttctcttgaataagtcacttaccctctctaggctgatttcctcacatcacatcgtccatagggataacaacacctaccctgcagaatgttgtcagggccacaggttatgtaaataagcacctaacagagctcccagccattggttgttgctcaataatgatagcaattataatgactagactaagaggataggtaaaagtaaatgttgatatatttttttcaatgactatacgtatatattgtttttaattatagtgtatttttacaaaatcaatcttaagaatttaattcagtaaccccatacatagtccacatctttggggctataaattatttgtcatgctttcagtaagaaactcaatccaacaggcaaaggaaacataatggaatacatagatgtcttgagtttatagaaaaacatgcaaaatattaggctaggttcagtggctcatgcctgtaatcccagcactttgggaggccaggggggcaaatcacttgaggacaggagtttgtggtcagtatagccaagatggtgaaaccccgtctctattaaaaatacaaaaattagccgggcatggtggtgcatacttgtaatcccagctactcatgaggctgaggcaggagaattgcttgaacccggaaggtggaggttgcagtgagctaagatcgcgccactgcactaccgcctgggcaacagagtaagactctgtctcaaaaaaaaaaaaaaaaaacaaaaaaagaaagaaagaaacagaaaatgcaatatatggcacaggaggtaaggctataggatctgtcttcaaactgatttctgcttcatggttttccaaggagaattgaaaaaaataatcagtggataggaaagaggatgtttcctcaacattaaatattcaaagcaggtcaataagagcactacacatcaggaattcttcatcagtctctgtgcctcccaaacattaactatgtaagcggtacatgtgtacaccatattgagaaaaaccgatgtgttttggacagagtctccgaagaacaaaaatgagtgtctagcttcctgtgtaaaccaatgtcattacattcaaagaacagtacatcaggaaattccctagaaaatgtctgttttcatgaggcacgtgcatgtgtgtgtgtgtgtgtgagagagacagagagagagagagacagagagaaagcgcaaacaagctgatggcattccaccatggaatgacctcagagcactgtaaagcaaatcattaaaaatgcaacacatgcaaactcttccactgcagatgcagagggattagtgaaagcagagtggtcacttaagatcagtttaagaaacctggctgcttacaaatgggagtaagtaggtggatttttccaaaccaccctatttacatcttctaaaccctatcattttgtgcaatggctaaaatttcatgcatgtcacgagtgtttcccctccccctacacacaatgtagctgctttgaagaatgtcagattagaaacaaggagaaaaaagagccattcttttaaagtctcaaaaattcacaactaaatttaaattacacaactttcagttgaagtaagaaaggcagagccaacagtccttacatcatggtatgagaatacttcctaacacattctctccacacggatttcacagacctcaccccccatgttaagtgtgtacactaagttaaatcctttatgtagcaattatcctaacagtgcctttaattcttcaaactaacggatatcatatcaatgagtaaataaatccaaaagaggttctgattcaacctcagatgaacatggagtagctgaagccagatttaccctcctgcctgaaaacagcgatagaagtagacaacatgcatgaaacaatagctctcaagatgctgggagccacctggcaggaagggacagtggtccctgaaagaagggaagcaaatgaggtgaactctacaattgccccagcagctggcctggagagagtgttcaggccatggcctaggaaagggtgacctaggcagagatcagcagtccccgagtggaggacttggagatggaagtccagggagccgaagatggttaaaggtcacagggtgaaataccagggaggacagcactacaccgagcgaaatccaaagagctgtgaatattcagttgagtactgattgatcagcacgtgaggaaactacctgcagccagggaaaaaccacctgaaagtattagagggaacagtgcctagtattcacaaagggccgccagctctgttcccaacagccggaggggaaaatcccataatttatggggcattggttagagtactaagaaaggtcttgccttgatagtggagaaaaatccactctagactaaatgctgccctggtcctacctaacaaagctttttaaaaagcaagacataaaaagatcatactgtttctaagtatcctataccatgccccataacaaacctccgtaaaatttttaggaattcagaagtttctagtagccaataaggtaaaattctggcatctaatccgaaattatgaagtagaaagtggaaaagtgtgacctataaagaggagaaaaattaactgatcagaaccgacccagatgatagaattagtagaaaaggacaataagacagttttttaaaaactgcattccatatgttccagaaactaaagaatggctgtgttaagtggaaacaatatggaaaagattaaaaagaccaaaattaaacccctagagaggaaaagttcaaaatttgatatatataatacagtggatggcagattagacattaaggcagataatacattattgaagaaaagattagtgaacttgaagacacagcaataaaaatgattcaaagtgaaacagacaaaatacttggccctacttgaagtccacaattctgaaattgtgtctgaaagttaaatgctaccacttattctgaggctcagacaaaattcattgcatcattcaagatcaactgaacactgtaaaaaaagtgtttatttttgttaataaaattatgactttataatatttaatataattatttcactttataatctttctattgatggatatatacactgtttataagatctgtcactgctatgtatacagccaaatatacatcaataatgaaaacccataggcaggttattatttttcagttactatagtcagaattatattaatgcaatcaaaattgttatgagggctaatttcacttaaagggttatattctttgtttttctgatctagtttctgactatcttttgtttcacctatgtctctctgttatctgtggttgaatcttctggattctgaaaatcattcacacttatgattttattaacatatatacatggatgacatacatatttaattgattttccttaaatttgccccttcattgtagtaagagatagtatattattaaatcatttaaattcaatcatgtataagatataagacattatgtctggatgctccatcatcagttcagagtttttttttttttttttttgagacatgatcttgctctgtcacccaggctagagtacagtggcacaattatggctcattgcagcctcaactttcaaggactcaagcaatcttcccacctcagcctcctgagtagctgggactataggtacatgccccagaattttttatttttttgtagagacaaggtctcactgtattgcccgggctggtctcgactcctggactcaaaggatccttctgcctcagcctcccaaagtgctgggattacaggcatgagccaccatgcctggcctcagatgttttttaatatatttggcttctctttacaatctttcctctatcattttattgactttctagcagatccatgctggtcactgcaaatataatgatgaataagacatagccctcagagtctatggtctagagctagacaggtgaaaaataattttacaccagatctatggtcaaatatggacaaagcactagcaagcagaagcaaggagatgactaagtgtgctggtgagagggatatgggaacacagtaagaaaaacttcatactggagatgatcttttatgtcttgaaacatgtgcagaagttcatctaatagagaaattgaaatgtgacatcagaggcagaggaaatagcaactgtaaatgcaccaaagcataaagaaaccaggtatattctgggaataaataaatgttggtattactaatgtataccctaaagcactgggaagtcatcaaaaatttctaagtttgggaatgacatgattagatttgtcttttagagaaacaactttggaaccagtgtggagaatggtggggagttgagtggagacttcgggcaaggacatcagtcaagagttgactgcaatagttcagggagatatgatgaagaactgaattgggcagaggtggtgggttggaggaggctgattacagagatatttaagaagaagaattgacagaatttgggaatcggttatatgtgtcagtgtgatgagaaggtgagaaaggagtgaagggtgagtccaaggttctagcttggatgtctatagtgatagtggggctttgcatggaaagaaggtaggacaaacaagtcttgagggaaaagtatgattgtaaacatgtctaatttgaagtttctttgggctatttatgcagagatatctagtatatagtgtatagaagtaggaaactagagcttctactacagaatagtagtcaaagaaatcaaagtagataaaacactcagtctttgcaaagtatatggagtaacaagggaaatgagaaagtcttgcttagttcattttgttctactataacagaataccacagactgggtaatttataacaagcagaaattttttgctcatggttctggaaactaggaagtctaagatcaagccatggccttcttgctgcaacagcccatggtggaagggcaaagacagacaagagaccgcacaagagagggacaaagggggctaactaatccttttataaggagctcactcccaagataacaaacccactttctcaataacagcattaatccattcatgaaggcgtggcctaatcacctctccttaggtctcaacactgttgcactggggattaagtttccaatacttgctctttgggggggacacattcaaactacagcaaagccctctgacagaacaccgcactgcaacatttaataaggctgattgggggacagaatcaatgatggagactgaggagtaatcgggcaagtagcagagaaaccaggggcaattggagtcaagaaatccaagggagtagaatatttcaaggaggagaaagttcaaacacaatagaaaagtcacattaaatgagaaaattttaaatgtctactgaaattgccaattgatagatcattgaggccttttacatgaataattccagggagactgagatgttaaaaccagattccattaaaacaaaaggtaaagaacttgacatttctaacatagattaatctttatgaatttcaagctgggcatggtggctcaggaagcctagtcaacttattacattaatattaataatgataactgtgatcctcttaagtgattatggagtactcattatctgtcaggcattgtgctaagcgtttcacatgcatggtcttgtttaattctagataatttagatgactccacaagagtctttcttgaatcacaaattgctagtcttctgcacaaaatatccaacttgattatctgtactttaagaataagaactgcgtcttataattcccttcttttgtgccatctggtaaagttttggggacataatagaaactcaatatcctttaaaactcttgataacataccaagttcttgctatacacataactttgtattggacaatagagaggatttttttttacactacccaattctatacaaatttggaaccttattggagacacaaagcatgcaggtgaaaatttaaattatagctctaaacatcaattaagtgctactacatttataatagtagtacatgagtgcagtaaaaaagagattgctatgagctaatgtcatgaaacaaatatttatgcagctggtagaagttaaattagggcttgaatattctgacaggcaaagacaaggctttccaggaggtggaaatgcctgagcaagggaatggtcatgcatctcacgagagccaagagttcacagccaatgatttatttagcaaaatcttcaaccctactgttctttgcccccagttcagcccatttccagaatatattttttccttccttatatttccttaattcatctctttgtctacttctcatggtcacgagctctgttatcctatcctatttcaactacgaccacctcctcatcactcaactcacactattagcaccgctaagaatccacagttctacttctgaagtcgctttggatttcctagcactctgcacaacaggacacatagactaccagataccatcccctgcgtctggcatttctcgttcttcactctaactcactgctgttttccccacacaaatgtgctccaagacctcctaaagcaaactatacattgtcctcttccaagcctcccctggctcaaagtcaatcttaatgcacaaggctctaaatcataatttacagcttggaaaccattaatcctgtacagaaggaactgagtttactgccaatgagttgttcaaatactaagatagattctggttctatatgaatttttatttaagttccctataaaaatgtttgtaatagcaccagagggtgtgtgtgtgtgtgtgtgtgtgtgtacatatacatatacacacaaacacgctatctctctctctcaaagtggggaggagtgggtgttgaagaatgacagctccttgaggacaggacacacttttgttcaactcgacttgaactgtattagcaagggcatgagaggacttaagaaacaatacaaaataaggcagataggtatgttcttcaagctatcctttgatcctggattctaaagactaaaatacaaactaaggttggagggcccaaattttcttctctgagtctcagagattaggtctatatattttagaaatgtaatagtaccttcttaaaaaattacttggtaattaacctgactgaaagctctggctaaaatactgtggctccagcttagaatactctatggttgtagccaatgctagaaaaaacacactttcagttctaggctctgttctctcactaaatttcactttggctgtatgctgatcatttgatctcatttggagacgaccagcagtcacatatacaccatgaagtgacaatcacaatgccaaatctaagttatttcatttcaaataagcattggactattattactaatttaataagcaggaaatgcccatgtgtcttatgtactatgctggacacaacttgcatggagataaatataacattactaataagtacaagatcctcaaagttcacactctgagatgtaaataatgaatgacagcacaatttttaagagtaaagaaattgacaaggcaacggaagaacaccaagtaggaagtgaagataagaatctgccttgaagaattgtaaaatgatgcgcaagaaagtgacacttaaagtagatcttggctgggtaggatggctcacacctgcaattcccaacgctttgggaggctgaagcagggggatagcctgaggtcaggagttcaagaccagcctggccaacatctctactaaaaatacaaaaattagctgggcctggtggcacatgcctgtaatcccagctacccgggaggctgaggcaggagaatcacttgaacctgggaggcggaggttgcagtgagccaagatcacgccactgcactccagcctggtcaacagagtgagactctgtctcaaaaaaaaaaaaaacaagtaaaataaaaataaactaaatctcaaaggaggaaggaagggatgtgtatgaagcatgtattatttgccagacacaggtgacaaattacctcattgttgccaccattttagacatggtgaatctgaggcaggacaactaaagtcacctgctagaatgccacacagccagcttcaaacacagctttgtatgttttgtccaatgtacaagctcccttctaaaggcaaggaagccttctttaggtggaaaagtgaaataatctttattgcacttaaagtttcctaaaaattacctcttacgaaatatttacttataatgattaacagtttatggttgtagctgtaagtttctatctgcccatacaacgcttttaaagccgggcacggtggctcacgcctgtaatcccagcactttgggaggccaaagcgggtggatcacttgaggtcaggagttcaagactagcctgggcaacattatgaagcttcgtctccacaaaaaattagccaggcgtggtggcatatgcctgtaatcccagctacttgggtgggtgaggcctgggaatctcttgaacccaggaggtggaggatgcagtgagtcaagattgcacaactgcattctagcctgggggacagagtaaaactctgtcaaaaaaaaaaagaaagagagagagacaagaaagaaagaaagaaagaaagaaagaaaagaaagaaagaaaagaaagaaagaaagaaagaaagaaagaaagaaagaaagaaagaaagaaagaaagaaaaagaaaagaaaaagaaaagaaaaaaaaagcttttaaaacccagtccattaaaaaatgcccaggaaccaggcaaggtgggtcaagcctgtaatcccaacactttgggcagccgagacaggaggactgcttaaagccaggagttcaagatcagccagggaaatatagcaagaacctgtcaggaaggaaggacagaagaaaggaaaggagggagggagggagggaaagaagggaggcagggaagaagggagagagggagggagggcgggaaggagggaaggaaggaaggaaaaaattagctgggcatggtggtgtgcacctgtagtcccagccacttgggaggctgaggcaggagggttgcttgagcccaggatgcaatgagctatgatcactccactgctcttcaggctgggcaacagagtgagaccctgtctcaaattttaaaaaaagaaaaaaggggaaaaaaagaaaaatgcttggggttcaaggtctatgtaagagatatgcaaaacttcaaaaatgttgcaaaatgttgtgtctatgtgcattttcctggggaaaagagtcaggagcttttatgaatcttaaaggggtttataaacctctaccccagaaaaggctatgaagcaagaatctacaaacttctgctaagctttttaatgttttccaaaaggaaaaatacttttgtaaatttaagtttcacatacaaggaaatccatttcatatataacagggaagaagattcatatattctactataaggtaacaacttgataaggagacaccgaagtgaccctttcccatgtttctaataactattcaggatgttaacagtgaaaggaccatttagaaagctaatttccttttcatcatgcttgttaagtgtttactttaattcacatcctgtgtgaccctatgggaaaatttttaactaatactggggaaaatcccatagggttacacaggatgtgaacagggcctgtactgaactaccttcagcttgaaaaataaaattagataggtgagtttcactttctgtttgtcataagttccactttctggctcccaaagcttagatccacagtacatccatgtccgtgcaataaaatcccaagattctcactctctgttaaaggaaggatttcggcgtgttgtatagcaaaatcctttcagcagaaaaatgcaaatctgtggtgctaatcaaggagaggcggctggagcactcccaaatgctcctccatacctgggctcacacacagttcagctgccgttttccatttcctgtggggaacatacatcataccacttcccctatagaaaaaagaaagcagcccgatttaattgctgatggaaacattgtcatactttccactggccaagcttgaaactattactgatctaaccttcattaatttttccacaacaatttgcagaaatgtcaggaagcagctgtacgaagactgattaattgtccttatcaccactactttaccaggctcgctctctcttctctctctctctctctctctctctgtatcctcaccacctcccctccctctcttccagtttaaaaatataattgggatttttctgttttggttggtattggtggtggtatatcatactctgaaatatccagatctatttttgatgtctttcaatggcccaaacattttcagatctggaggagaccccatgaagtttgggacagcatccacgaaggaaaaggttgcttcctgctgattactcagttatagctgtttaaacagacgttcatgaattcaagtcttacagcaacactgcatttattagtcaatcacagacgctaaaattcacttccgaaatgtgaattagaaaatcaaatgccctttttctatttttttttcactttcttttctccctcatcattttcatttgagctataccatctgtcccagcctatcaaataatgtactgtgcatgcctggcaaaaacaagtggaacagtacacctcataaccccatgtaggcaaccactgagcatctataaaagtggtacataacagaatctggccatctggggataactagttatagcaagcttagcttctcagccagcactcagatttgcagacttttaactagttggcaaagcatcaaccagtgttcaagaagagaaacactaacaaacattttttttttcaaaacacaagaattcagatataaattttcaaaggtgtacttgccaatgttgctgacaagaaggcttcaaaagcaaagatcaaggcactgtcatgtccttgaaatggagccagagtcaatccaaatctagcattttgcagcattactaaactttttgggtatgaacatatttttccttccccatattgcctgaatatatacaagcaagggattaaagccgaacagactttgaaccaaatgacatagtacctttcagagacagctccagcagactgggaagagttcctcctaggactacatttaaaaaaaaaaaaaatccaaaggctcttcatcccagatacactcattcgtagtctaaccccgaaccaaagaaagacagattggacaactatggcttaaagcattaaagtaataactggacatgtagcatagtggcccagatcatggaccatggagccagaatacttgctttcagtcccatctctgccacttgccagacatacaaatattcaggcaagttacctaacctctccgtgcctcagtcttttcatccagaaaatggggatacaaataatattgttaacagaattatacagcatttaaaaatggcacgaggaagtgaactctaaatgctagctgttaactgtatatttttctgttgatatttcaggtatctattagcctaatagtgaggaggaaataatgtgacacgagttcctaaattaatttaacaaagcccactgggttggctgaaagatttcccctgataatactcacattgcttgaaacaccaccaccaaaactaggtcaagcaatcaaggctaaatattctattgtttctgttgactatcccctagctgtcacaggacagcatgccttgtgatgccatgggacatagaggcaggcatggctggagatgaccacacctcaccaccacctccaggcctggaaagcaggggtggggagaaagccaccacagaccagcaaagtgcaaacaaagacagaagctggcttggacttcgtcataatcaaagtactcatcaaagaagccaaaggcactcattcccttggcactaagaccagggttgaggtgccaggaggccacacagtgcaggaaagacgctacttttaattccggctccaccatatgaccttaagtaactctcacactctaaagccttaatctgcagtaaaacacaggatttcgtctacatcagaccttttgagtcttttggctgccatgacctccttggcagtctgatgaagcctgtgggctcattcttagcagaatgttttaaactacactggattacaaaggaaaccaattaccatgaatataggtatctcaaaataactttcaaagcaaacttgttgatagtaatatacataattctttattaataattaaaaacaagatatagtgcaggtctaatattcaccataattcggagtagtcataatcataaagacactttgagatatgaatcacaatggtaatgtgatatgaaactgtctgtgatttctattggtgacaacatcactgacactgctgaaactactgtcatttgttgcttacatgaataatgaaggaagtgctaaacttcagttagagattaatgaaacagtttttttctcaaccaaattttctgaattctgtccatttgtggttaagagccccagcctaggtaaataataaatccctttataattccattatctcagatcaatgattgcattgtgtccctggctccctccacagagaagattcacaaagagaaataaagcaattcctattctttccaactgtgtggagaaaaacagatttacaggatagaagtgtctttcctcatccctctccaagtgagggaaggaacacttattgacttggaaatgagttacccaaacactatcaagccctaccagcctacaggcaaatacataagaagtgacattaacaccaattaaccacagctcctgttccagccccacctgctcacacaggacctccagtccccttaaaaagtcccaactaagtatatctaggattccagcaagggagacttacaagagcccacaggcagtctgacagccagtcacaacaccatctgccatggcttctttcctgcaccagctccccctagcgtcctcaggaaggaacccctctgccgcctctgcagatggcgccctcagtaagaatcctaatgcccagttgcccccacagacagcagagtccatacttccaggaaagaggggtccttgtcatgggtcccacactttagaaagcctgcatatcacaaacaagcacaaataaattcactgaaaaatccacagcacctttatcataggcatccagatgtcctgtaaccctaaaccccgcgacaacggtttaagccccgagggaaatgcttctcttgcccaatctctttgcaccagtcaaagagtgactgagttggaatgccctgaaggttcgtggattgtgacattgcagtgtggagttagacatcatttccaaagcagagaagattcaagcagcattaatgcttaggtaaaagaaaagacttaagagtcatttctctcagatggtgtggacgcaacagattctcgcataacaagtgtaaccatgccaagcatccctttcctggtttctcttcgtgctctgatcagtggttctagaatcgttaataattagagcagcatttggaacaattgcacatggcacttgaagagtgtttcgcaattaaacaattcttattcttaaatttgtaaagatgtaacctgtatgaagcatgatgccaattctttacattagcaactaaaatggacactaaaaacaaacttgtgaatagttttgcttctgtaaaaacagctgaggatttaattcaatttcaaaaaaatattaaaaagcttcagcagcatttaaataattttgaattttaaatgttttattcattcattttaatatagatttatttacctttcagttttaacatgtgattttggatattttgtaagaaaaatcctttttttaaatagcttaatttaaaacatttttatacttattctaatttacatatatgatgaaaatatactaatattttgtatatgttgaatacaattacattacatgcttaaatcctttaggtcccgagaattagtacatgttgacaccttagtatatataattgcttttttggagttcaaaaacttaaaaagcagagatttttaagaagcagtagaaaatctgaaaagagtcagtctgtttaaattttaaagctgcaaataatgaaagtaagcagacttgtcaagcatgacccatataaaattcactaacaggacattagaaattatttatttaataaagatttaattactgttcaaaacaataaaaatgagccagaaaattattctagtcaaatccacaacgtgaactggtcagatgaaatccctgcaacttcatgttctgtgcaaataaagattttatcactgaccaaatgaagaatctttgtgggcctccatttgaactcttgccccagaggccccataaatactggcagcaatgaccctccccagctgtgtgttcgtaaggtccaaatcaagcttggcttataaccaattctccttcaagactgtcaccaaagcagttccatcaggttttttgcttccactcttcttcagaatctcacaaagtttatgcctaatacctcgtagccgtgtaacacaatggctcagatccagtcccagaggctagggaggcaacagttacacccttaattgaccaacttggaaatcttctgccccatctcagccagctacaaaaccatagctgaataccagtgagtgataacacatcttaggggtgagggaggggtggttctgcaatttgaaaccaataaagtccatacatttatagttcacacctctggagctggtagaaggcatttccctacccgacactaaaattcaggtcaagtaggaggaagaatggccacagaggccagagagaatgaaggaagattcagaaagtgccttttcacatttttgctcatgatccatttcttaaacttattggacaaatcttgtagcaagtttttttcttcctaacaatttacatgagcacaatgaacattttccatggagcctgcccttcacacttagaagcttagaggaaggatatttcctagacatctggattaagggactgactcccacagtaatccatatcagtatttgtttaaagatctctatggggtcttgattttcatgttttaaatagagaaataattttagaggttttgcagacacatactaaagtccaattacacacacacacacacacacacacacatcacatacccccaaaagcacgaggctgagtggtgaaacagtgaagggttgagttgcttgcccaagctctgcaagctattctatgaaattcagagcaagaacctcagtttcctgatgtttcaaccaatgacctttccagttaatcactgagccctcccaccacagctaaccactcacattgttgccatgatattgatattattcaatttagaaatctcttattaaggttttgataatattagaaaataaaacttagaaatcattaagctatcaagaatcattcttatattttatacattattataaaaatgtgtaaggtcaaacatatctgattttaatagacattacagaaattgtacagaacatttccaaacttaattctctaaggcatctcagagagtgtgactaaaaatgctatcgtgagttaaaaagatttaaaaatgtgttctccagaaaatgttaactaattgcatctgttctaaagaataattaaagtgccaataatgaatttaattaattaatttaaggtgccaaccttaaaataaaattgttttaattttttcagcagactttcaacatgcttcaaacatatgcacataaaaagggcatatgtaaaataaaaataataaatgattataatttaataaatttaaaataaagcaataaatatcttcaaataaatgaattaattatcttcatccactagtttgcttctatattctaagtaaaatcctaagtgaacagatcttccacgctaaacagaccaatcatgtttcttcagaaaacacaaatatcatatatctgatttagaaatttattttcaatatctgaaaagtatctaagctcgttaaaataaaatatatcttattacataattcttggtttaggagaaatttccgctatgtgtatgtttaaatagcttaagaataaaaacttacatcaagactcttaaaccaagcttgtcctttaataaaggataaattattacctgggaagggacatatcactacactcaggtttactgtgacctaagagattggcttaggtctccccagtctcaatggtccctcacaattccgaccatgatcactggttgaaatatcttgctagtgcttccaaaggtggaagatgtccccatattttggggaattccctgaggatatttacatgtacagatgaacaaacatactaaccctatctatcccaggtcttcccatagaaaaggagaaaatcagtctaataaaacattttaccacttcaattctcaaggaaaaggaatcccaatgttgtaataggtaaagcctgataagaatgcatggcaattttttcagaagctctgagaatttctactaccatgaacctgacagctagattgttgtattctagcaggctgagcacattttagggttctaaatggcagggaatagctttgtggggtagaaacattagtatataatactcacctcataaatgtaatttcaaacaagctgtctactcataaaacaggagagctgacttatattggctagtttcctataagaaggatgtattttatctaaaattttgcctgttttctctgctcagctatatctgtcagctgccggcctgggataaaacaggaattcagcaaacgtttgtggattgagtgatcaagtgaatggatgaatgagtgaatgaatgattgtaaacacgctcactctccatactcatgtacttttgtgcctttgtggggtttaggagcaattgcttcttcttccattctactactcctgttaatttctctcttgttattcctgttaaattataggatggtttgatacaatttaaaatacccctttgtaataatatgggtacctctgtgaaagttcttttatcaagcccggttggctatataattgcttgaaaaaacaaaaaccaactaaacataaccatgatataaatttcacccctttacattttataataataggctgttcatcttaacaaagcaatttctgaatttttctttaacaagctctattattattcctaaagtttcaattattaatagtatccctatcacctcctgctagcatattgcacccctgccctgtgtttcctcaggctgggtgtgacaaagtacgcctgcatatgactgtgtgttttgtctatgtactggcacataaatatccttgaggacaggaaaagaactggtgtatgtgtctgtgtgcgcgcacgcacgtgcacgcacttccctggattgttctccatggaaatctccctccagatgggaaaagagccaaggagagcccgaggacttccctgaccctaagccaagggtgtggcaagtgtgctcaccattatcagctggtgcccaaagggaaggagtgggaaggaggaaggaggtagcagggaggaggaggaaagctggtagtaagtgtggagatcttttaattgcaagaaaataatctgggagcctaacatttttgcagtattttaaagtgtgcaaagacttcacaggactagcacattctcaaatgacacctctaagaccaacccaagcataaagatcttctgaggcttatataaactttgcccattaaggagaagtcacagaaacagtgcaggcttttcctcactggtgtacttatgtactcaagataagtaataacctttagaatgttttcatcctgtgtttgctgtgttttcagctatatttctatactgaaacctcttcaaattcacacagcattcttaaattgccaaatccattggtcctttcttagatcacaacattggtgatgactttgcggcatgatacgctgaacactcccttaaatataaagctctaagctcaagatctgacataccctaggcactcaataagtaagagctactcttgtcagcgagctcctcctcccttagcttccttgagacttgcctctgttagttttccagctacatttctgacagttaaagtactttggaatcttttatctgatcttcaaagcccagacaaagtgttttcccccaataaacttccccacttttgcagtgtcagaattaatgccactctctcgtgttctcataatctttgctcaactctcattatctcactaatcatggcctgctttggattttagttgagctaatttttttttttcaagacagagtcttgctctcgcttaggctggagtgcagtagagcgatctcagctcactacaacctccaccttctgggttcaagccattctcctgcctcagcctccccagtagctgggatttcagccatatgccaccatgcttggctaatttttgtatttagagatggggtttcaccatgttggtcaggctggtctcgaactcctgacctcgtgatccacccgcctcggcctcccaaagtgctgggatgacaggtgtgagccactgcacctggcctgagaacatattttatatccccaactaaattttcagctacttgagaacaggaccattcttatttctctcaatactgagcacaatgtcttgcacatggctggctttccataaatgttggttgatttaaaagttgacaacagatattaaattgaatctttaactgcttcctgtttcccacctttcatagccaatcccaagccaaagcctatagaatattcatctacagtatctctcccaaaccctctttatattcctattatggtcatcctagttcagaactttactacctcttatggagactatcccaatagcttcctaatttgcctccctccaggttttccagttcttcttggtgatgccatctgtggtgagcagattaatctttcaaactataacccaatcatgtgattccttagctcaaaagtgggtaaagtttttctaatgcctaccaaactgatgtgctaattacattccagacgttctatactctctaggtctctcggttcctcccttcctcttctttcatgtctcctcttcgcttaccaatgttatgttccaaacataccatatgacttttccttccataatcaccccaactttatccatcccaacactttacgtaggtgaatatcattctcgccacctatcaaaaccttgcacatccttaaagctgtcctcaggaaatacttcctgctccccaagccctctacccaagcaaacccataagaaaattgatacgatttctttctcttcacaaaacattttatttatacatctctgaggaccctagtacaagttttcttatatccaagtcaggtatgtactagtccgatttctattttaggtagggtttataagcaacttgaaggctgaaatgcagacttactcatcattgtattcctccacagcaccaaaacactacattgcatatggcagaaatgccataaatattcattgagtttaaatgaactaaagcttttaaaaatagccaaaaaagctcaggttccatgtaagaagaatggggctcaagccaactgagtgttggcatctgtgatgattggtgtcctcaaaatttccacttaaggatgatgacagaatcaagctctgctacagccaatgaataatttatttgtgcacaaaacattctgttaatggaaatctttttatggctcaagatctaaaatgtatttactgccctatagttattaaatgtttgctttaatcattaggtacacaaggtaatgacaaatgataattacagtatcattatatactcttaaactgatttaatcaagagtatctcttctgaaattcaaaaactcctcagtggatggggatgggaaagattacactggaaccaatcaactcactgctaccatcaaatttaagaaactaaggttttctgttgttagaaataccaccaattgaaaaagtaactttagatacaaatgcctagtactttttttttaaagctcaattaaaaatccccctgcctccccgaactagactgcctcaatcaatgaaacacatcagagaaaaagagaagtgcatgtgtttgcgcgttccctagatgttccagcctgccaaaaaatgtttctttgctgtgctatttcagcaagtcgtgagatggcaatgatcaccctcctcaaaagaaaaagatagctatttttcctgtatgtttttattttaagaggctgggaggcacacttctggctgctgagagtactctgacacatacacatgttcctgaggaggtgaatttgtgggggaattttggcagggtgaaggttaagaaaacctaaaatcatcctaaactcttgggaaatatttaaggagctgaaaaaaaacagcaaaaagaggaagatgatgaagtcttccagtgaattcctgtttccaactataaaccctcatgaaaaacgaaaagtaaagtactataaaatacatgctttttatctatatttatatcagactcaactggtacacaatcaaattcatcacactactagacaaaccagcttctctctttacctcatgttttctattaaaagtgatattcaaactccaaagctcaaagcctggggtcatcactgaccgcttcctcctgctacccacccccagaatgcatgcacatccacacaagctcaccctagacccaatcaggcagcccctatgctggtgtcctgcatactttccttcatacagccagtgcctgtcaatccttatcactaccctccaaccagactctcacaccggtctgatctcccaccacacaaagtaggcaggagaccagcaagtactctgggtacaaatggcaaagtgccaaaggccagatccaggcctgatgcccttgcgtgcctgggatccagggacaattctcagaggcagtgaaccgtggaagggtcgagggtcctaagaaaaacaatttgagtggaacgcagccacaagggcaccatgatgcaaaacctgagaagtaaggagctgagggggatatgggaggaaatcagaaagaacttcctcagcctgggattcgagtctccactgaggtctgcgatgcagtgccttcatctgtgatgtaagcgtgggaggacatacagggcacaacatgagatgacagctcttgtttgaattcatggaagtgcctcctaagtggcttctatgcttgcagtgactgctgccccccaccccacctcacccgccatccaacagggcccagcccgacccatctccctgaagcgcagctctgagtgcagtgctctcctgctcaaaggttttcatgggcttcccacgcccctttgtcctgcagtcaatgtcagctgtgctttgccttcacactacacaggaatccctcatagtcagaggccacatgtaatttatctcattaaattttttcagaggtcaattatttttgttgccatagtcaaaacaaggagaatgagacctcctggtcagggactgtaggggtttttaggtttgttctgctgtgtggggaaggggtttgttactcttttactttaagagcaatttttgcactacaaaattcataaatttgtattcatgacctggctctggatatttaataggtatcagacttgcagattcatctcacaaatataattaaaattaaacctgtgtccaggtatcgattttcagtccccaaagtgaattttaaaacagaaacttggccaggtgcagtggctcacacctataatcacagcattttgggaggccaaggtgggtggatcacctgaggtcaggagttcaagaccagactggccaacatagtgaaactccatctctactaaaaatgcaaaaaatcagctgggcatggtggtgggtgcctgtataccagctactagggaggctgaggcaggagaatcgcttgaacccaggaggcacaggttgcagtgagccgagattgtgccactgcactccatcctgggcaacaagagtgaaattctgtctcaaaaaaaaaaaaaacagaaaacaaaaaacaaaaacaaacaaaaaaaacctcacaagcaattatttttattaaacccaacaaatatttattaaatgtctactattttttcaatcaccatttttaagaataaagaagacacaagcaatttacagtgcaggcatatgacaggaaaacttcacataaattactttattataaagtgcaagtacaaaaatgcatacaaaaagtggcatgagagaagtataaattgttaaggggtgatgcgggcaaaggagctcaaacatgaagagaagtaatactacaataaaattattaaccagactccgacgtcagtaaagtgcattaacccaaaatgcaaataatagatgaggtagaaaatgcgattaagaaagcgaatttttctcttggcaattcatgggtgagacatcaatgtgatatcagattcaaacataaaataaagatctctatgtgggggattttgtccaatatccaattaaaggatttatagtgaaaactgtaactgccaagggaaccggaactccagaggccattcttgatccacaagggatattgcttggaaatcatgagattctcagatcagggaagtgattgggtaaacttaacaattggtatcatcaggtttcagtttccagaaggtgataactgacagaggtctggaaaatttacagtccacatctttctacagcattttattccttggactacctcaagattccctaaaagtataagatttgactctgcccccagattttgatacggctggcttctatttctttatgtcagtcataataaaaagaacatagtggccacatccacaacgctccaacatttgaacactgccagttaactagactggtgacttggtagtgactgacatgttagccaaaaatgggagaaacagagttggattctggttctatgactcactagtgctgtgactttaagcaaattactcaactaaaaccaacccccccaccatgaagcctccggtcccttatacacaaaataaagtgtgagtaataactacataatagctattgcctcaaatgagataatgtacatggaagccatttgcagacagagagtaagtcattacacaaatattaattcatgccatcatagaaacaaggcatatgatcagtcactaagattcactgtgtaggttttgcatggagagtgaaaaatgagaggctccttcacacagccatcctatactgcaaactgaaggagacaggaaggatagacagaaggaaatactatgaaatgatatgaaagaagccttcagtcagggtttcagatggctgcagcatgcttgtggaacaaaatgggatttgctcatactactggtttagttaatacttactgatggaatgatgaatatgtgaatgaaaacttattaaatgcatgaacgaatgaaggtataaccaggtaaaatacttgaaaaacaaagcaggaagagtcaaattgtgaataagaaaaaataagaaaataattttggaaaaatgaagccatgtagctcaaataagctaacagtactgggctccactcacctaagctagaatagcaaaacaaagggcagtctttgtaaggaggccagaagaaatgtagagcatacataagagtccacattttcacatcagtttgtaaatattaatactcaaacataaatactgatagcctcttctgttatctcaaaatacaaggaaccaaacagaagacttgtatgcatctgaagagctataaaaatataaaaggaagtcctgtataataggaaacattttgaaggccacaatatactgaaacttaaaggtctactctgaatgatctgtgatagcagaagttatagtacacccggagataacagatagcaaatctaatttgcaaccttatcaaatcgttataagaccagctaaaaggtatccaaatagaatgaattaaaagggttttcttccttttcattttcctaattggtataagtaataataagaaaaaacatataaaggcatatcaaagagaaaggagagataaacagatgaagaaaaggtttggggaaatcacaaaatatagcaatttccacagaacacagaattatgtattttggacttcctaatttaaagtaagacttcagtgatgtctgactccagaaattactaacagtaataattgtataattatcagcaaattaattactgctctttaacccaatattttcaagtttatgagagtcttaataattttcaccttctttttttaggaaggaatatcacttacataattcctaaataaatatatccaatgtagtgacagcatataaatctgatcacccatgtgtttaaaagcccagactccagctaatatcactttaaaatgaataatgtcaagaccagtcaaaaacattcactgcttgaaggaaaatgccaggacatgcaaagcaatattattataaaaaataataataatttgtatgtactaacttttcaaaaagtaccataaaaggaagaatattgtgtggatgagaatgttcctttcttactttgcaaactgttttctatttactaccaatttgtggtgggaggagttgggcacatttttaaaatttattatttgtaaaaaaagttacattgaaaaaaaaaccctcatttgggctaatgcacagggccaggttcactgataaagtcactaagaggttgctgattatgtattccatatgcatcacgaaaatgcttaccgattccatatgaagtccttccttaccaaaagaagtatttgatttaattgagaaaatatacctagctctttgagtaaagaccatgttgacaggctaaagaatcagtcacgtgatagatgaaatataattctggttacatttaaccagtgactgcaatgactattacccctattaatcaccatcatcataaccactactgtgaactcctagtacctgccaggtatttaatcctcatagagccttatgaactaagcagcatccttatttaatgcaaaacaattgttacaaagcacagtgaccccaatgagctgactcaaccagaggagtccagaactcacagtgcaatacacaaggaggccatctgcactcaatgtccaggccatgtccattctcaggaggcactgataaaacagtcgcttgaacataatttaaattaggtaccaccaatttaaatgtcacttaacacttaggatactttggaaataactgtaaaagccaaacttgggagtagatggaaaattaaatgttgcaaataaagacatttaagttagtggttcagattattaatttcatcttctaacatttattatagctattgaaaaaattaaggctttgcttttcacacttttaaatatatgtcttcctaatgggtttttcatctaactgcctcatatccctttaattatccaaaactttttccaaacagcaccatgtgcccataacaatgaaaattattggtggcaaatgaagactgaaccatgaaccttacgggccaaatgaaaaggggtctctggaatgtccacacttgatatttctacactcactggatgctcaaaagctacactagcatatcaagttcttaggcagtggagattattttagacaaagggagattattttagacaaagcttagggcagttgttggcactacataaactacaacgctatcgctaaaaaaccacctgacatcatcttgtcttaagatgttcacaggtaaagcagacactattagtgggtttagtttagaagctgtcttcccagatgattagacactttcctctcttgttcgttatcagtcatcaggttttaaaatagctccagtttatttggaggaaaattaagtaacaagctgtacaattttagaatcatgaataacatttagaatttcagaaattcaaatcttgtgacctaaattaggaatacaatttttttttccaatttttctttactgtgtaaagggttaattaaagtatgagtttgcttggattttttaaaaaaattaccaagccctaaaatcagtatcatataaatttctgatgccaaaaatctgtttgacagagcaggctttactatactgacattttaacagtagccaaagtcctgttcccactaaattctgtcttggcagcaccaataatttgctaaaagcctaaactcctcctggtaactaatgtgttctcaacctcaggagctttccacagcagcacagtgcaacaaggaagctgaatccatcaagtccttccttaagatttctattcttattacagaaatcatgatttctataaaatgagaatggtttaaaatacagaaagatgctaatttacttcaaatgttcattacatcttagatgtgaatctgacaaaatgcaataaaactacatataaaaaccttattcaaagtaaaatctgatatttttacattacttcaagattataataagcaaatcatcattaatacatcaaataaaataatctggtttcgaactataaatgacaacattttctaatcttcagctaaaatcagacatttccagaaatgcaataaagtatgaatattttcatttagataatatccaaaacatctatcacaggtttcaagagcctcaaataattactgtcaaaatttcacataaagctcatttaatattgtgcttgaggaatctttccaataactttgaaatcaaaccatatagaaagcacttggcttgacttacctagtggctgtatgttaaagcatcggtaaaagagcattccaaccaaatcaattcacttaatttttcaagtagatctgattactatggtcttttaaaaaattcaaaggctccacctaatgagaaaaaaacaaagaactacatttaaaccggagcgtgattataggagctatacattaataacacaaaaatcaaatccagagtattatgatattatactatcttttcctacgttactgtgctacttaaagctatcaaacaacaaaagcgtctaggaattaagttaaattttccagtttggggtaaaatgaatgttcaagcatagagaaaacaataaaagaatacaacaaagtgtgagaacagaagagtttgttattggcaggtggaaataatggttatacaatgtcagttaagacattaaaattagagatgggggaaaatgcaatttattgctttggaattatactcattgattcttctaatttacttatgcaatgaaaatttgtaggtgacagttcctgaaagccattaagccctagctacatgcaatctctgttgagaaatagaaactaatatctagacagatcatttaaacataaaaatggtcaagaagtcttggagataattcactggcatggatttccaaatcattctgagaatgttacaccttgtctccacagaaagtgtttactctcctaaggactcacaaatagcttaattattatttataaataatattggtttattccattcactttgccagtagaaccacttttcctgaatttcaaacattaaattactatctcagctctaagagaaagtttgagagaaagcaagcattaacttaactagagagagagcctaaaatgaatgctagagggttgagcagaagagtgaaatagaaaattggacagtttctagctactcccaaattaggtcttcccaaggtagacttagtatgttcaaacatactaatatttcaaaaagtctctgaacatcaaacacaatcatattcaagtgaaagttcaaaaacttattccaaagccataagcacaagattttttaattgtgcaatttgaaattggccatgcactgccactcccccaaacccactaaccacattaacaaaattaattgataatctcagtattaaaaaataaaggttgaaacagatgttatccactagtattagaaggtagttgctccagaaaagaacaaaacaaaagatgttgctaacaatagagaagacaaatagcagtaactatacatactaactagaaatccatgtagtcatgggaaatatgttttcactttcaagaaaacctgtgtctagattctagtcttactgctattcaagaaacaattatttaggaaactcatttggacatggtctcaaaagacttcttcattaacagagataaataatctttattccagggttcttgccataaacatgacaagacaaatgtcaaatggtttggttatttaaaattacactgaatcaacaaacacaatcacctgaacaatgaactgcaaaatgattcaacacacacatttttcgcatttgaatatctagagcggcgaaaatatttctgtacttttcctaacattttatgcaaaagttacaaagcctctctcaaataatatttggtagctagcttcataataccacttctcaatacttcccaggatggtttcgtgcagaagctagcataacttttctttctgttagtcactttccaagaaagaggtagggcactcccttcaagatgcaggacaaacttcaagattcttaaaaatcctttctcattgatttctcgatgtacaatgtaaaactgacttacgcaaaagtctttttcagtccctcttcatttcttaggtagggtattgttttctaaaattatgtaattcttgcctcgtaagaggtcttccatttcctaagacaaccagtcattaagcaatatgttaaaaggtttttcacctgtattgcagcaactatgctctcatttctaactggttgtctaagtggtcagtgacttcaatctacttaggaatttttcagtgttcccatagagtacctaaaagtggtagtaatggacacctcatatcaaagttcaaaagcactaagtacaaaatatattagtcacccatatggatgattcagctaaatgactgtactgattagcccagaagaagcagatctgttgcctgtgcaacaggtaagcctcgcgtacaaaccacaatataatatttatttagaaatgttcacttccttaaaaataaccacatataatgaaaggaaaataaacacacgatggtaaatggcctacaatcgctacaccatacagcagtgcaacacctcaaataattttataacctgatgaaagtcactgactctaaacttccttacttttaatttgtttgtattgcctgccttaccaacctgggcaggggttgggggttgggggagggactcttagtgttttttggctctatcagaaaatctaaggacatctgacctttgtatttcagttatatgttacatggtctaaacaatggagcaatttatcattagctaatatttgatcatgcttgtcaccaattggtttgtttcagttattcgcatgtaataaatcagatgtacacacaatgctgggcttgagtgactttctctagctgagtggtctaccgggagtagtacacaggaaccatgctccctgagttcaccaggacactccctgggagcagttgaattgatcatactgttgcaatactgatcacagtaaatgagctttttgaggagccctctagagtagcaaccacactctcgagtaagcctgtgtatcataatgtctctatagacctaaataactcttttaatagtcatcaaacactctcctttcattgacaatgaaactgaagcccagaaggtcacttgcaaaaggtcatgcaactagaagcagttttcctgaatactattctactgttttcccctttgcatcgtagagccactgtgcctctcataggcaaaaattcaatcatggctagcaagagtttactgaacagcaactatgttaaacttgcttatcagcttaggatgggaaggaaaaggggagagtaatgagttcagagtgagagagaacagacctcaaataccacggtctccagagtacccccttcatcatggttacaatcaactcgtctcttcacaaacccagtggagaagtggccaattaaaatagggaaatcaagaataccttgacaagttatacgcccaagacatcttaactattttgtagggtttcaaagtgactcttgaaaagccctccccttgtggctaattagtacagctatccttatttatttttttttttttaatatttttttatttattttaatattaaatattttaatatttaatattttattaaaatattattattttaatatttttaatattatttttccttataaacacttaaaacattgatgacatttttaaccagaaaaacaccatttatcccattacccaaacacaatcttttcatttttaaaaattttaatctattatttgtccccatgtaagcatattttcactgagatgtcctcataatgcacatataattgtgtattctgattttttaatttaacatttcgtaagtatgttatttccatgaaattcagttttcatttttactagccatatgatattccataaagctaacataaagtcatttccttcatcattcctatatgtggcaacatttcaaatgttctcactaattttcagtaccaccaatactgttttttcttagaatattctcaaaaataggattatcaaattgaaaggcaaaaatatgtttataatggacttcatatttatggccatattgatttcaagagattgaaattatctacaaagccaccagcagtagatgtgcattctactttcaccaaacttcctcaccattgcatgtaattaaaatttcttttcagaggcttatttaatgtaatatgatatttaagggtgtcatttttattttaatggtgaccataattattctcttatttaaaaattattttattgtctttcacctctaatataaaatgtatctactcacataatttgactacctttaggtcatagttcttcttatgaacttaaatgaccctttatgtaatatatattaattttttatacattttttcctgtaaatttgttttaaccatttaatatatcaggcatatatttagatccatagcataaggtatgtattcagatagttctgaccaattccaaattatccataatactatttactaagttttccttcctcacacatctttctataagcttgctttattatgttgtattataatttgtctatttctgggctcaccctttagttacatcaatccacatatttaaaatggaacttttgttcagactgccagtatgatgtgactggcattgtgttaggtcgttttcatgtgcataatcacatgaactttgtgtgtgtgtgtgttagttttaattactgttgtttcgtagtatgttcaaatccatggtagagctagaaactactcttcattttcttttttcaaatgttcatcgatattttcttttctgcatgagtatatgtgggaaattttcacccattttttcagattatattatttaattaagtgtactgtttgccctccatattcagtcatactcagaatattcccattagcagtctgattaaaattgagttgaattatatacatatgcatcttttcaacattttgttgtcccatgtttaaaaaaattgcatattattatgaatctctacatatacgacattttaacatttatattcaatagacatttatattctgcaagtctcctgattctctgtctttcctcatttccatttcacttgcttggaaatacttcattcttcatgtccagcaattaaattgtgtgaattcctcacaaggttccctaaatcacttcctttacatgccggaaaatgctgattaaatagaagacaagtacttaaaatcctatcttaaataaaatatcttcatttccttgaccaaaatgaaattaaaactgcatgtaaacaatatcaccaccacaaaataatatctcatgtaaccattctattccttagaatatttacatgacaaagccctgagttcctttaaaacacagctgaatggcttcagctagctagagccctcctccttcccttccacccaccattgtctcttatttctgctatctgtgaaacagttctgagttcaaagatagagaaaaagtgcagaaatacaaatcacttaaaattataaataaaatatgttaaacctaagtttgactgaaaatagtctaaattttgttgtgcatgttaactaaatccacgtgttatcttccttgatttcacaaagctaggtactctcaaggaatcttatggtttacataaccgatatggtacatgaagaattctagactctgtactgaaagggaagagaaggacaaaaagaaaaaatgggaagaaaaaaaagacctgaacgtctgtgtgtagataggcaaataagaactgaaactgtttgccatccgcactttgaaagtcacactatgtgtcaagtttgtcaagtcgagtgaaagaaggagtgatgtgcttctccactttcctgaagaaccacgtagaaaatgtggcaaatatttaatttaagccttgtttcctgaaagactgcaagatgcccacaaattttctttcccagagttcaaaatagcaagctgagtgggtgtaagcactttaagtgaaaaaaaaaaagtaactaaggaaaaggaaatcgtactttctgcttcttagtataagatttttttttaaaggccatttaaagagatattagtgattaggatctggtggttgtcttgaatcagaatacaaatacagtcctggtgacctcagacagagccccctggccacatttaaacatgattcattctgtgtaaagatgaaactgacaacatcgtagttacagtaagagcaagctgttgtctgctacgatcagatacctaaatcacaacaggaaaacacttgcacgaagggaaagctgaatgtctatagggcctctaccctttcccaagagagggaccttcctcagcagtgctttataatattttcacatgtagatgagtcaccaggggagcttgttaaaaatatgggttctgattccgaaagtctacgtggaaccccaaagttcccaggtgataagttcgctggtctacactttgagaagcaagactgtagtctgtaacaatagtttcctaatagccagacaccagaaatcacaatcaaccaattaagaacacttactagttacctgtgccagttgttataataaagtacataacaggtgactgagctaatacagaaaaaaagtatgttttaaaaaaataaaagctaaatgtgtgaaaaagactctaaggataataggagttgagaacaggaagagttctgtggggactagagtggtcgcaaatggcttcatagagcaagctggacgtgtgcagccccaagttaagggaaggggtggatgtagagaaagaaagagcaggccaccactaagggcaattctagaagggagagcctagagttcccacaagagaaagctacggtgagcctgctttgtggttatagatattatcattggaagcttttaatcagaattcactttgaaccaggtgaaaggaaactctggccttgtttaaaatttgtcggtttggaaattataattctattccaggacaggaaagaatgggtagttttgccttagtcttatgcaaattttctccattggcagcagcaatagtgttatgaatgacattttaggtttgagcctgggagcacaaaattaccatttttgtacatatatttatgcatatgtatgcctttggttaacatatgtctttaatgattaagactttcagagcattagaatcataacttttcactacaatagatttaataatcttctgttacttcgagtacttgaattttacttttattataaaaagaatttttttctcctgtaacatactttcggatggcacatacccacacaacaccctcaactccagcaatattcttccattcttctctttcctcccacactggctgacaatgggaagaaaacatatccagaaacagaatgaaattattaatgaattataccttatgtgttttttttaatcttaaaagagtttttcctaccaacccacaatacgttgggtattgcacaatggattcaacagaaaagcaactgaggattccacaggtcaatacaaacataaacattcaatctctaaactttttttttttaatgaagagaattgcagagggatgagcatacttgcaagctgcaagaaggaagtatttgaaagagaaacctaatattttagctctcctaagtcaggtcagtaatctcactgagttctatttccatcttttcatcttgggaactatgaaattcgtcatcttattgtaagcattaagaaatggtacttggaagacttacaaatcttatgtttcacattaatgttaaatgccatgactatggtttagccacagttactgtccgaggtatgtttctctcctaccaaacttcactatgcttcctgttcttagtaaggaagtcagaatttaggcaatgaattacggcaaaactgctatttcaaagcatcaaggcttgaatgttaacaagatacctgtaacactgcgattgggccgaacaagatcctagtattcaggatgtaccaacagagtcaccttccctcccgtcaatccaatgcacacacacatgcaaacactcactagtgacaagaaaaaaaatattaatatgagaatgctaaattactgctacttatgaatggttacaaaaacaataaacacatatgaatggttgcaaaaacaataaacaaaatgcaaacaggcacaccctagtgagaccacgaagtgtgtcttctacaaatctcttcccctttctatcctggtcctgttcaggtgacctggcctaacctggacatggggtctttgcaggctgcacgctgcatctactgcagaaaagagctggtaagatttttcatgctaggttgtcaaaaatgtaacgtgttctcattatgaaaacatttacattaagaaaacagcaaaaacaaacaaaaatcttgggacatcatgaaacttaatacaaacaaataactgttggtgaagagacagatttgggggaggggttttgcaagaatagaagcaagacttcctcctctgtgggaaatattagtaatcctattaaggcacagtgcaaggtgtgtcatagacactagaagcagatatggtttactttcagttctctgaggtgattcttattggaattgaagtggctcttctgaaaacaattaatcaacaataagttctctctccctccctctctctctttctctcttcaaagtgtgtgtgtgtatatatacgtatgtcttttgactaattattaggcgtagtcccatttttttctccttggtacctatcactataatcatctgtgtttctgtgtcacctgcttttagaattacacatggatattaccagaagttacagagttaaatttgcaacagcacagacttctaactacaagcctgggaccatggtggaaacaaaggttcagttaaggaagatttcccgagccagaattgatgtcctcactaaccaggctgccaggcttaaatcaaatgaaggtcgatgcaatgtccccagaggaagctgttcaactcgccgggtcggttccccagagccctgccaaggaggctcctcagattgacagcgccctggcagagctgctgtcttccccaggcagagaggccctcccccggacaacaagctgggtgcaaactcgtcttccgcagacaccaaaagagagcacagcaaagctaagcgactggggacagccacttgtggctgagacaaaggcaggctccccctgccgcaggacgatcactaggactgtcaggctgtcgaaatgtatattgcagacaggacatccctcctggcatccagtgtgagcgaagtccaggccacggcaacaacagcctggcctgaggacagcctgcaccacacatcaaagccagaggccctgggaggctggccagccgccaaagacgcctgagagcggcaggggagtgtgttgccttaggacaatagcaaactgggacgtggtagagtctgtaaattccaagcactggggaggtcttctcagagattttaccctctcctgtcagggctgtgatttaatttcctttgaagaaaaaaaaaaagaaaaaagaaaagaatatacattcccaaatcttctgtctgcaaaggcagacaccacaacgcaagcttaatgcactctggtccttcccggccagcggccactgtctaacacaatacagctaagtgagatgtgacattctcccggtccccttaatagggcattaagtctaaggagtacttaagatcatttaaatgcaaacatcattgttccattgctactagactcccagatatttcccatcaattctgtttaattagagtagcaccacacgttaattataacctgacagttttattgatttcacagggcacatcatacagtcccattttaggtaccaaggacttaaggtgaagcatgaacctctcagtcacaaagatgactcagcctcttgggctgatgaggttctgattcttctaccaggagaggtttacccacttgctcaacagaaatagttcagtaatcatcttatgtcctcacttatttcacagcgttttgcaaaacaacacatcaaaaacaaactaaggaaaaaaaaacctgtaagagtgtaaaagaaatatccatctccctctgttctgtggtcttaatctgcaattcttaaggaccaggatgaggtgctgtgaaggctacgcaggtaaagctggcaccaaacagaaatatggtgcacttctgcccctgaagcgactggccccactttgagaagccatgctgtaaacatgctcattagaacagagaggactggtcagttttcctttcagaggaaatgaatatgagttgagatcactcaactctaatccaccctgtacctcagggttatactcccagcagcacatgctccactaagccagcagtttgtcatagcccagcgtgtcatccataatggcatgttgggggtggaatcacttccaattcctcactaatctggtgcggggaatgccaaggtacagagttttacttgattgcataaaacatagagctattttcagcttccaaatcatcgttctggctctttcaccagtcctaaagccatattacaaccctttaaaaacatcttttctattcggttttcccttattttaatataagcaaacacttaaagtaatcccactaagtctctgaaatatgaagccatgaaatgttagaaaaaaaaaagacgaaaaagagtttaagagttttacacatatttgcgatttaaaatggtcactgctgctatggtagtgggacttgagttatctccaaactccttataaaaaccctgggcaattaacacttagcaggacttcggtgcctgatgacaaaatcaattctgttatagtcacacttcgaaaaatgactttgaagagtaacaataaataatgaaaattaaacaactgctaactgatataggaagaacttcagctatttctgtaataattccactgggatttgtgctgaacattataaaaacaggatgttttgtttgttgttcttcataaaagactactgaaccagtataagactccaaaatatatgaagactacaaatctacatgaagtctactaatattaaaaaaaagctaagtggaatttttattcatgtatttaacatttttgctcaatgtaagatgacctcaggaaacatgtttcttatttttatgaaagccaaaaggaaacacagttatataacataattctgcaatggttcagcatcacagtgcagagaacttaatcctaaatataggactgtcacaaatcagtcttcactgctaagacttcttatatttaacattaacaacggattatcccatggtaaccagatacctgttccatttagttagaggctaatcctaacaacataaggattccaatagcaaacttttttctaatgttaccatcaatgaactgtgatgaagctactgcaccaagaatgaacttaatattagtggatttagagataacttaaagtggtatgattagcacacaaatacagtcttatctatggatgtgggatgggggaaggtatcacttctgtaaatgaaaccattattttttactgcttaagtaaatgaaaacattcatatcctcttttcctgacacacacagctgtatttggaagtgtagaagaaatagggaggaagtatgtttaggaaagaattgcacctgaatattttcctaaaggctgggcatggtagctcacatctgtaatctcagcactttgggaagccaaggtgggaagattgtctgagcccaggagttcaagaccagcctgagcaacatagtgagactctgtctctaaaaataaaaattaaaaaaaaattcaactggagcatggtgcacctgcagtcccagatactcaggtggctgaggtgggaggattgcttgcatctgggaagttaagattgcagtgagctgtgattgtgccactgcactccagcctgggcaacagatccaaacactgtctcaaaaaaaaaaaaatctgaaacaaatagttgggctctgctctgtccattctgatgcttttgaaatagctggaaaagtcacccaaataactgctgctgccattccatgaactgatctctatttaaatcaagtgaaagcaccagttcaaccccaagtctatgaaaggaactagaggcttctcttcacttctgaggtcccagaggctacatctaatcactaagcctgattgttttattttctgtaacactctaaaaagtatctttttaatatctaaccacttatacacttttctacctggtgaaatctattttttcctatttcaatatctataatttgctatttatgtcatctgttaacctattcaacaatcatttaccatgcacctatcacacaccaggcactgggctgtatgcaaaggtacacaaatgtgttttatgatcttagagaataccgggcttggaggaagtatgaaaagtgctgtagtacaaattaccacagagtccataggaaagagaggaggagttattaaggaagctctgacagtggagacacttgcagtggatcttcagtaatcagtagacatttgtgaggcggaaaagaggaaaaccaagctgaaaggaaatatattcggttttagagcaaactaagtttgaggtgccttagaaacaactgggtagaaatgtccaagtagacatttggatacatagatgtagaatccatgggaatatgtgaactgaaaaactagtattgaagactattagcatcattagcagctagagtgattctttatttatttatttttttttttttttgagacaaggtcttgctctatcacccaggctgcagtgcagtggcacgatcaaggctcattgcagccttgacctcccaggcttaagccatcctcccacctcagcctcctgagcagctgggaccacaggtgtgtgctgccacacctggctaatgttttttgtatttttttgtagagacagggtttcactatgttgcccaggctggtctcaaactcctgggctcaagtgatctgattgccttggcctccctaagtgctgggactacaggtatgagccaccacgcctggcctagagtgggtttctgtaaaacagtctgaaaagctacagagagtggcttaagggttgaactttgggaaaagcctcaaagactaggaagtgtgcaaaggggctgagaacagagacaggcctactaagccacagcatcacagaaccaagtggcgaaaaaattaaatgataaacagagtcagacacaaatcaggtcaaataagtcaaagacccaaaagatgtcactgaatttcaaaattaagaggttataaatgttcctcgtgaaagcaggtggtcgaaactgtgaagcagttgggacaggtaaagtagtagctagaaaagccatcaggattattggttttattgtttgcttgttttcaagatggaagggattggagcatatttaaatttttctagttgagagacctttaacagctatggccctgaaaaaaaatacaatgtcctaacaatattttactggattaaattttggccacagtggagagataattatgacttgattgtgttaatataaaagttcaaattctcagcaattgactactaatgatgatataatgatttggggagtctttaattgaaggaatatgctgctgttctgtcgaataaatcaataaggaatcgcataacactgtggggaaatcttgaaaatgaaactactaaaagataaactttgaccatataattttcaagctgaacaaagctttagagatcatccacttaaatctcttattgtgaaacagatttaaaatcaatgcaataataacaacttccactgaaaaatatcaaaactaagtttaaattgtgcaagaaagaaaatgattatgacaaagaggctgcccaaactactctgagaaacttttaaacattttattcagacatctagatgggagggaattcctaagcctgacaattataagttatcagtaagtccacctagacaatttctgaagaagcaccctgaaagaattcactgactgctcacgctcctagcacataatgactaattcatcctgctccatctggggtcatacctcaccgtggttctcaccctgaacactgtcgcaggacaagaaaacagtcactttgaaaatagtaagcaagaaacccaactgaaaaatgttagttttacagtctggtggtttgtgttgtatgatcataatggaaaacccagttttattcatgtgatgaaaaattcaggaaaaaaagtgtttctttataacttaggaaatgacttctagatggttagtttctgggaaatatacaaataatagaagcactttcatattctttcataagttgaatttagagttttccaactcccttaagaggtgagaaggaaaagcaacaacaagaggaagcaactgtagccagcctggaatcaataaggcctagtaataggatttggctcatagccaagagtggggtccacctgctttcactgtggtaagactcagggttgaggctcttttatatacagacacacaggtacaccccaagcatgatttaatttctctataagatgtagcaaatagttttggcaaactagactctttaggctgctatgatttccacaaagaggaatgttaaaagtttgggctgactactgaaaaccttaaggaaatgaaagatctagaaacggtaatggagtttgaaacaatcatcacagagaaaaataaaagaaagcaacatttactgagtattttcccatttaatcttttatgaggcaggtacaattattaccctagcttacaaaggacttgaggccccgaaaggctcaggaacttgtctacagcctcactgtaagtgctggagagagttttttaatcctttaagcctgagtctgaaccatccctcttgaaaatagacatagtggcaatgtaaaaagatacatgggttgaagaaatctaaatatcctgccatgactggcactcaattttcagttctagtcataatgattctgacctgacaaaaggatcaccatgccaaaagaatgtttaatgtattgaaccattcctgattactcactatttgagctggtatgacagaacctcacggtggaagagtttcagtggggttcactcatgtctttatacaacaatgatatgctgctttcacacttagaacgaaggtcattgctttaaatttggcaagaaaatcaaagtctttcttatccagctcaagagcattattttacccagatcattgtcctaatttactttggcaataaaaagtgtttattactataaagtaaggctaaaattgatgggtttgggagactttacacaccatgttccactaggttaattttggagggcatgccatgctttctatctttaaaaagtatagtctatttcttccttcttaaagccacagatttcccaccaaacttaaaacttcagtccattatattattttaaattttgttttaactttattattgggaaatgactttatttaatctttctatcaagaagtagcatttcgctttttttaataaaatgctcacaataaactctttttttctctcatttattcaattatttattcaacaaacaattgtgcattcccataagccatgattcttgtcttcatggagctcaggggctagtgaaggtcagacactgaaaatagattgttactgtgtggaccccataacaaaaggcatgctgaataatcaattacataacaatatttgagaaaggcagcactcttctaaattctttaaaacttgggagctaagtatccctcctatcatgacctgaaatatagagtaattcttaaatccaccacagatatactttatttcaacaactcccagatgtctcaggacaccctgaacccagtttcaaaactcatcagcatagatgttttagagatttctccaaagaagtcactggcccatcactatcacattctagtttaggtagacttaacactcaatctaatgaatcaatttgtgcagtttgacaaatttagagtaacaggggaaaaatacataagatactcagaactggaaaaccctctgagtattagagtcttctgtgttgtatctttcctagtctaaaatgataaacattcctatctttgaaaaatttgatataaatatttgtcatttgatgtagaaagtgaggtatttttgtgcttatcttttaattactccaaacttctcttagtttaattgcatacttgtacaacatatacctcttttcttactttttctagaacctgctaagattccagttattttcttattgacttccttcagttggtagctagatccatagattaaggtatttttcttttcctctcttggcagattaagttcatttggcacagatttgtacacaagatcatgtccaaaaggaatccaaggaaattaccagatatctatttttttttccacatcagagaagcaaaccctagctaatccagcttgtctgccctctgagcctggggcttagtgtgagaagttacactcccagtagagaagggactctaagctggctacccaaagggtctccctgtggtttcgataagaattcacttgtaacaggtgctagcacctgttcttccggctcccagaatagttcctacttaaaatgaatcatactctaacagttcacttttaagcttactatttgaaatttggaatgtgtttccctctaaaaccagtgtcataaatactggttggcatgcaaggccacccttcaaaagcctgtataacctgatttagaattcgcctaaggcaatgtaataagagcaacatagaacctacccaccttagatggcatagcttcttgtcaaatagtcacactgagaaattgagtcaataggatatgaaactgccttttcctacaaggaccgtaaaagtctaggtgaaactctaagaggtaaataacaaagtaagaatagcaagacacagatgggccaggggcatcagtaggaagaatctcagtggctcttgtcttttgtcagggcagcagtggtggtccaggcattggtagcagcagagatggcagaagaatggaaaagaaaagagggcagggaaaataagtgaatcagaagctagagcagcctttgaaaagggagtgtcctagaattgagggcaagagaattgaggaagagaagggaattcctaccacaaggcaaccggggaattccctggttggggttgccattcactctgtcactgactgggaatattcactgtttagtcacataatgttctcagtctttgtttcttactctggtttcttaaattcaagctctgtgttgttcataaaaacccggttcaggctggtggctgtgccatccccctcagatttattgttagcctgtggtagttctcaattagggtgattctgcccccttaagagacactaggcaatgtctgggagttctttctggttgccaagactgggagtgggaaggggtatgctattgtaccctggtgggtagaggccagggatgctggtaagtattctacaatgcacaggatagtcgcccacaacaaagacttatctggctccaaatgcctaaccatgctggagctaagaaaaccggtaacattgtaactctgctgcaataactttttggtacatgtcactaggctcctgatgtttaagcaagtgattataacaaaaatcctttagactaattgtattactcaaacttcatcctaaagatcgtgctcaaccaagagaaattctacaaaaaaacccatagtattcttcagaattacaaagtgtgacatttgttttttaattgaagatgtccaatcaagacagccgaactttaggaggctggcagaaagggcacgggatgaacttggtatcacctgaatgtaactgaaattttccagggaaggcactgcacaaactcctctgtgaatgtgaaccctgccaccaatgccacatcctgcttcttaagcttttccataaacagcagctgtattcctccccaagcatcaaatgacaacccaggaacatgcacacgttcctgaaatgctcgcagccacccagtattaaagcaataatctcccccagggaaaagtcctactgggccggatgtaggaaaaagaatgaaagcaggcacagctttcaggtccactccaccacaaatgactccatgacccgggcaaggaacgttaagtaacttctttctggtcctttttttcctcaactaaaagcagaaaaagtttggcttagtcatctgcaacttcactttcagttctcaccaccatgctggttttcttcccaaaaggtaaagagaagggaattggctccaaagaaagtaggtaagagggagcttatgaaacccgcttcattaagggtcccagtcacatggagtgtctgtgggctacaatagatgaaccacccacgtggtaagttcacccacaagagcaacttttttgaacacaggcaaaagctgaccccaagcttgataggcgaagtctccactgagctccaggccacatgagaaatgctgactgtgaggatgaaggaccaatctttgtgtgtgcacagcagggaaaggactaatcattccacactggcctcttccgctacaaccttctgtacaagtaaccgtcatccccagagcaccatcttatcattaggaaggacagaagaagaagagtacagtgtgttttaaactgtctttgtgttataataaaaatcacaaacaaaaacaaaatgggcacaaacagtatgaatttgaggagcctttaattttaatgggcaaatacttaatgtattaataaccacgtggtagaaaccaaaattagttctggggaacctctcaactatactgaattatctgctgagataggttttgttcatggatctacaataagaaaggaatctgttttcctgagtctccccactgagttttttatgcagtgcttctgttcatatgcttaagtgagccatttaaaaggaagagtgtcaacgttggactcaggctttactggtatgaaagtgtaaaattatatttgtatccacagatttccaaaatctcagtatgcaaacttattaaaaatacactatggtggaggcatatataagaagtgaaagtattctttcacttatttcttattactgccagttcaacattatcacaagctcacagggctatgttttcccaactgaaacaccaggatgttaatgtgtctgaaatttgagaccttctgataaattatgcttgtttgctggttttgttgttttttggtgtgtttgttttcagtaaaagctggcactttataaaatatctgtcttcagtatttgacaacgcttgacaaccattctctcgttactttttaccacatcctggtaagggggaaatggcaggtaactgcatcgcttttcactaaaaaacagacagcaaggggttaaaaaaaaaaagaaaaggagaatttatgtctcccagttccacctactgcaccactttaatatccaggattctccccaagccattcccagagaaaaaagtgaaaagaatctcctttgacttgcttgggtcactgcccccaagacactgaagactcaaagatactgaagacttcaatgtacaatacattggtggtgaaactaaaagtcatatgcaaggagttgactcccctctcactgcaaataattctaacatgaccgatgtgctacagaaatcaatagcagtaatgactaccttttttggaactgcctcagcagtcagctggagagggggccttgctaagcccaggcacactgcctggatcaagcactgaaatcaagcttcacaaaagagaagcgtgagtaatttacttattaaagagataactgtaaagtctgatacaaacagacaagcgtaaagccttcaatgcacaaaccaaatgcttggcttggagaccataaaatgcaatcagcaatgaaatctaggttatatcactcaactttcaaaagtctaatgcccctttttatccttagaaagatgacacaaagaaatgacctgtgagggagacttctggttagcaggggctccccaaagacactgagcccacagcaggaagtggaggggaaacctcagtgactggtccgagaccaacctggacttccgtgtaaggtacaatgcagataaaggggattactgtacttcaagtgggttctgaagcattctacattattcaaaaggacaaaaatctagtcaggtgttgcccaaatggtctcctctgtgatcatttttctcatgttgttcagaaacgtagtggtgatagtgcatttgtgagactctgtggccaggaaacaacatctctgtaaccccaattttaaaatcatgacttcactgtcaccaaccagcgaatgccaaaaataaaaaggtagaaacatctaaaacgctgttagaaagtgaagcttgagttcatgagcaaattagaaaaaaaaaaaaagtcatttgccatcagatgttgtctgtcaacttaaaaaaaaatccaaataaaaagagaattcaaacagttcttctacaataagctattgtatagcccctagatctaagtcattcacaactcccggaaataactgcatattcgccaaatgctcttattttgtatgttctcacggggtttcaggacttgtgcaaattgttttccaagcaccatccggccataatgaccaggttagaactgataattatgcctgcctgtctataggtttgtcagctaaagaaatccacagacggctgcatcatgagcagaattctacttcgggtgcagctgcgctgaccacactgcattagaaaaacaaccctctttgcaataaccagttttgggcatcactggttaaaaaagactagtttcctgtttttctccaaaacttcagagtgtgggtattgctattttttaccccacccacacatttttctttttaattgttgaagattaggtgctgtaaacacctaatcatgagcatttctttatattaaaactccaggtttaattttaggtcggatttgttctttccacacggggactcccctttgttaagacttgtgtggcttctcctgcgggcggggggaagccacggggctgcgggctgctgtctaggaggggctggggtcgggtcttgggtctgggaacttatctatggcccagtgttgccccaggcagctgtcccccaccattggcttcctgatggcccagctatgcatggtccccggcagggatgctgcagctgacctagggcgacaggtggttgggggaagagaggctgttccccctagaagagtatctcaacccaggcttgggaaacagcccttactgatgaaggctgggggactaacagtgacataaagcatcaagatcccagacatatcatcttatttctgtttatactatgccgtttctcttcctcactttgacatgttatttcctttctttcaagaggagtttgaagtatatgaaggcagtgcacactgtagcagggctgctcctggtgcctgaccccctcacttcactctggcccctctgcaaatgtcacctccttgcagatcccccctctcccctacctaattaacacacaggcatgagtgctgggcaggatgataaatatctgtctcccacactgaatagaagctctcaaaggaggcagcactgctctgttcactcctatagccccagtatcctaaacagtgcctggaaaataacaagtgtttgattaatatttcttgagaataaatgcccccctcccttatctgcttcatcttttatcacacctcctctcacctgccctcttatttttttattttttaattaaataaatttttttttgagatggagtttcactctcgttgcccaggctggagtgcaatgacacgatctcggctcactgcaacctctgcttcccaggttcaagcaattctcctgcctcagcctcccaagtagctgggattacaggtgcccaccgctacgcctggctgatttttttgtatttttagtagacacggggtttcaccatgttggccaggctggtctcaaactcctgacctccagtgatccacccactttgacctcccaaagtgctgggattacaggtgtgagccaccctgcccagccctctcacctgatctcttgggcccacctctctggaaaccctcatttactatactgcagtttgtttacatatgccttttttataaaccataaactcgtggagcttgaggactgggctcagcacacctggcacataacaagtgctcaataaacatttgatgggtgttgttaaatgaatcatttgagattagccactttgaaggcaggaactatgtagatactgtagaaacacattctgtctctattttttttaaccaatactataacttttgatccctacaagaaaagtctgaggcatttcctcagccaacagtatatgcttaaaggcatagcaataagacttactctgggaggatcacttgagcccaggagttcgagaccagcctgggcaacaaagggagactccgtctctacaaaaaattaaaaaatgtgtgatggcacatgcctgtagtccttgctatttgggaggctgagatgggaggatcacttcagcccaggaggtcggggctgcagtgagctatgatcctgccattgcactccagcctgggcaacagagcaagacccagtctcaaaaaaaaaaaaagaaagaaagaaagaaaagaatccacataagcttgtcgaaacaaagactagagaaataaaaacttaaaacgataaatgaggcaggacgcggtggctcatgtcagtaatcccagcactttgggaggccaaggtgggtggatcatctgaggtcaggagctcaagaccagtctggctaacatggcgaaacactgtctctactaaaagtaaaaaaattagccgggcatggtggtgcacacctgtaatcctagctacttgggaggctgaggcaagagaatcacttgaacctgggaggcagatgttgcagtgagtcaagatcacaccattgcactccagtctgggcaataagagtgaaactccgtctcaaaaaaaaaaaaaaaaaaaaggaaagaaagaaagaaaaagaaaaaaaagaaaagaaaatgataaaagaagtgtttatcactgtactgctatgcaagaagttgaggtaatatcctttgaaagttcctgaaaagaaagaattctaagcaaaatcaaaatcttcatttttgttaaagttcacagtagggaaagtgttaaatctttttttctcctgtaagttctcctcttaaaggaaagacagaaattcagcaaagatctctatcccctcggacctccaacatttttctgaactgtaaaaaagataagaaaaaaactgagccacaatcacccttgtatgttatgtacatgtattgacttcatattgctcccattcatgttaagaagaacccaggtgataaaaacttaaatgaactcctgatgaaaggaaaatatatgtatattttatcatttgtttcaagaatttaaataaattattaatatgtacattcatactataaagctctacaacagtggtccccaaccttttgggcaccagggactggtttcgtggaagacaatttttccatggactggcggcaggcagggggttgggaagactgaagtgcactgcatgtattgtacactttatttctattattagtacactgtaataatgaaataattttacaactcaccataatatagaatctgtgggagccctgagcttgttttcctgcaggaaaactagatggtcctatctgggggtgatgggagacagtgacagatcatcatgcattagattctctttgggcaagagacctagatccctggcatgcgcagttcacaatagggttcacgcttctgtgagaatctcatgccactgctgatatgacaggaggcggagctcaagtggtaatgctcgctcacctccacttacctcctgctgtgcagcagttcctaacagccaacagaccactagtgatccgtagcccaggtactgggacccctgctttacaggctatccattgctgcacaaattttgtagtagctttattccgcacaaattctgcaacttgtctaagcaatagactttttaaaatgagaggaagcttctttaattcccatgtgccttatttaatgttggaaaaactaaaaaagaaagagaagttaagtcaactatcatttcacagaagacacagatctattttcaaggaagttaaaatctactcagacagtatacgaacatgcatacatcagatagcagaaacatcacaacagaacgacatgccagcaagtaacacctgaagacaatactctcagcatattcaaatgctgaggctcattcacaaaggaaaatgcaggctagaataatagacctctttggttctgtacgtttctaaataacataatcattgtcttatatattattaccaagtagcagtctttccccattcattgacaaatcaattggaatggccttcccctgtatgattcatacataaaatgaaatttactaataatgagaagttttgacataggtactaatggcttgagatgaataaaccagatttttatatatgaaaaacatattgtctcctcccatggaaaccagagctgtgaggcaataacattggaggaactataagcaaaatgccagagcaaagaagtaattctattacttgaaggtatccttggatacagtagaatagcaccatatactaacagaatttattttaaacccacatacacatttttcccatccgactgttggtaaaaggtaatgagtatgaaacagtaatatcccaaatttaacactccaaaagaatctgtttgggctttctttccaaatcatcaagtaaatgcccttaaaatttgccctctccctccaaacaatttaatgtcatctaagttcaaagttgtcagtcccacactttcaaattataaatagataaaactcagtgtatggaacttctgtttagaaaaggattccatttcaaagcgggctcctaagaaagaaatggtaggtaagcacaccagtccgggtggaagccttactagagattagaatttggcccacctgcaagaacagatggctattctggacagctgcaggaagatgggggaaatagcttgagggctactgattgctgtaataattaaaaccaacaacaatgacaaagtggcacttgaagttttataccgttacttaaattttttttcagggaaatttaggcttataaagttagagtggcacatcagcccagcagtttgttaagactctattatcaatcttttatactggaatctgttagcagccctgcattctctttttacactgtagagaataaacattaatacccaaaacgtgtgtttgactaacatatttacaagaataaagcaatgtattgtactagattccagatgtgaaagataagtgtcactccttcagacaatttctcccaatttctcctaacttgacagtttcatattgcatttgctacattagcaaatctattatatattatgtaatacatctattatatatgtaatatgtaatacatataatcgattacatgtattacatattttataatacatataatcgattacatgtatcatatattttataatacatataatcgattatatgtatcatatattttataatacatataatcgattatatgtatcatatattttataatacatataatcgattatgtgtatcatatattttataatacacataatcgattatgtgtatcatatattttataatacatataatcgattcataatcgattatatgtattatatattttatgaaatgtaatatatattgcatatattatatattgtgtactatatctattacatttaattatatatgtaactatatattatacattacatatattatgtaattatatattatacattacatatattatgtaatatattatatgtaattatattacatataatatatttagatatcatatatatttttatataatatataaattatatatatttatttatatataatatataaatatctattatatgtatatattgcatataatagattatatgtattatataaaatgtaatatattgtactttacatataatataatatatattgtgtactatattatatgtaatatataatatgatatataattacatatattatatattacatacaatatgtaatatatattacataatatattatatattatgtaatatatgtaattatatgtaatatataattacatataataaatatattacataatatataatagatttgctaatgtagcaaatgcaatatataaaaaaggcaagaacaggttctgttgcattttttttaataaattccctgttcacagctccagagtacaccacaaaatttaatataaaacctcttataacaaaactatatgttaaaataaactaccagttatagtagtttgtgttactttaatgtaaatcctagatacaaaccaaatcttttgtatctgccttgtccaatgttcttgacattaacacattaagactgtttttatttcaaaatctcagattcttttggaaattacaaattaacttctttaaattactaatgactattaacaattactatacaaaaaatagcttttctaagatattgctttctgaagaatcaaggcatatctgataaaatattacaaaatatttctaaagacaggacacgcaaatatcaagttatgaattttttaagagatttaattgagttctcagaaagaaagaggaaataaaataagtttagagaagaggtcaaattcaatagtaaatgtcatgccaggtttaaagtaaatgaaaaataccaaaatcttcacaatacctcacatctacattcatctaactacgcttttgcatattgcacattttgaggtccctgctctgtatgaatctctcggacagagattaggatcccccaaggagtaagacacacttctttctgtgggaaagctcacattccagtgagcactgattcaaggaatatttgtagtccacaggtcccaaaaacacacttataagcaaaatctttatttaaatctcatgcttattattttatgtagctttggttccatgtggagaaatgtttatactgctgtaaacaaagatcgtgttaagaggatatgtgtgtgttagcaattttctaattaaatgtgcatgatttacctttgcccctaccattggaaagaccacccagtaagcagccaagccagcaagagggctgtagggggtgtcctttctttcctctctgctacccttgttgagtattttactcttttgtctatctctccccctcagcccagcagccttgaactaaaacctgccttggctcactctctgtatttcacctcctgctcaactcccagtcccatcaccagcagcctacaggagtgtcacctggagcctggaggtccctttaaccaagaattctaggaacagcctagaaacggagggtaaagtgctgctctcacaatagcagaaagagctgtgttcctcaacatcacagcttatcactcagaatgaagttttccaaagaaactgacatccacattttaacttcttaactattactaatacttcaagtacactacaggtcaactcagcttttgtgacttagcgaaaaataataaatattaatatgaaaactgtttatacgtttaggatattgtacatgcacatagaggaacaaagaaaactggagtctacacaagacacttgttcacccaataattttttgagcacctaataacttgaagctatatacatttgctattacataacagttaaatgcctttattgcctttctttttaaggattgcttctgagaattagagcctttcattctactcatcctccaaaataataaacacagggtaggaaaaattcactgcacaaatctttcactcacatggatgacactaaatcatatccctcagaattctcctttccttgaaggtcctaaccctgtaagaattcatatagccaaccaattccattacaaactgcaaagacctcccaaggggctgaaacacctatccaagtcatcaattctcacataacaaaagttaactatgtctatatctgtgtctatctacctatatgtgctagcacttagaattcaaaaacagcttttcaaaaatagtttcctccagcaagagatttattacagcctattttacttggccatgtgaattttgtttttgtttttgttgtggttgcttttttgttctttaataagaaaataagtctcttgatagctactattgctccaggaaaaccaaatctcttctgaatgattccagatatccaatatgctgccatttttatactccaaaagagaatttggatagctatgtataacccatgaattcaaattttgttttctattgtgcttctaattgcttattcagttaggatgtgggatgatgcacattaatgctgtcaggagcattttaagaaaatgctgagtgaaagacataaaaatcctaatttcattaaaaattagccaaaagacacattagggttatgctaccaactagtgaaggtctgaaactgagaagaaaaaaaaaaaggaaacactttaaggaataatgttaccagtacctttttcttttacttggttcaaaatccctgcataattaatacagtaatacttcataaatgcctacgaacgtaccacctcttctctcttgtagtttaattaggtgattgacttcaggcatactataaattataatgacattttaattacttttttaatgtgcacacttaaaagatttataaacaggaatagaacagcccagtacattgaaaagaggcacaccaaatgaaatgaagcacacgacctaggatgatggcaggcagacgatttctagaagatagaggtgaaccagaaagcgtttcgcatgcttcagtaaacatcagctctactgccttgggacgagttatgaacaacctatacaagctttttaataatcttaacttacaaggaaggagctggatccctctgtcagttacacttctaggccatcccaagacagcctcttcttacagtgaaaaagcacagacttttgaggatcagaccttggttcgaatccttcctttaccactggccagctggatgaccttgacaaaattaacctctctaggctttgagttcctcatttgtaaaatttgtaaatggaagaaaatacctgttttggagggctgtggtggaaattaaattaggtaagcagcatgctgcaactggtgaagaggcaagctctaaatcagactttctgaattctaatcctggctctgcctctaatgccctctagaaccttgggcaagttatttagtttcctgcctcctttccctcaactgtaaaatgaggataatatcagcaacagccttgaaaacttgttgagaacctaaataagttaatacacagaaagcattcctacctggcacacagtaagtgctcaatagatgttagctactaataaatcactgagcataatcattgatgctcaataatacttggccatacttaatttttcttccttttctacaacccttatttcccattagtagacagttcctgaaattccacatctgctgtgaaattttcttgtagcgttaggtcagtgctaactcctaactcctttattacctctttctcccatgtatgtagatccatgtcaaagtgcctacctttaattttaagtttctataccatgagcatttagtctgggagattctctttataaggcagaatagtaattccaaaagaaataggtactttgatgctaaggacaacgaggagaattactgggaaaaggataaatatataaagctgtggaaagggctttctctttatctttgaggtcggtctctcccttagttgatctgaccacatcaggatttcattttactctaatggggtgaaagtgcaatgagcctcaggccaatgtggctacttacccctttctaactgctaaaatacaatttccctttgccattaactatctttataaaaagcgaaaaagaaaataaaaattaagctataatcttccagtgggaattttcagtcctccctgtggtaaactggtgaacaggagaagttgacaaagggtaaggatccagagggttataagaaatcttaggtagagaggtactgactccagtatttccaacctgctctgggtaagtatggtggtagaattcttgtaataaataattggacgtgtgtgttagtgtgaatatttcttttaatccaaatacacttattaggaagcatcactgtctatatcagaaaacaaggattttactcttttgctattaggtatttcatagtctttttttttctttgcatgctattaagtatcaagttttgtgttaataactttacaggaaggctgtggccaaacctggtgaagactacacatcagtggtctttcttattatacaagccaggcaatcatatatatactcaaccagattgtattaactatcagtggtatttatcatcatggcatctaatctactatacatttggtcaaagataaaaaagtatctggcttgaagtgccttctacaagccagttgttatcgttacagattgattgcaacagatatgcttttggtacacagaatctgaacacattatctctgactcttcctccacccacttcagtgacagctttggtcagcaacagctgcagctgatatattactctacttgtttaagaaagtgacataaatacagagacgagatgacataaagctgtgaatgttggacatggctcttataaagttttcctgagccaatcaaaaaaacaggatatgtgctaaaagaatttgtgtatgctgccagttacttagaaaacatgtggacaaatatatgctttcagtaactaacgcattaataaaggtggattcgcatgcaagacttggttgctatcctagtggttttaaggcaataacaattccaataggatcccatatgaatttcttgaaacgttgtgctagaataggtcatttatttttgcacaggttcctattcttgcaaataaaaataaatttccaacagtctcacggtcatccattgaataacatgacttcaagtcctatatactgtcattttatacctctaatctggcatagattagaaacagaaaggaaaattatgcatataatcttaaaactagaaagatcacattgcaagtcagctgtgtcagtaatttccgctttcaggagttacacaatgcttaaacaatagttatcctaccgggctacagttcacttaacctcacagtccagctgatgattgatgaagggtcaagagggtagcagactttgggtgcacaacacttcaatcctttatcaaaaatggcaagaggccacatactacaataacggaacaaatacttccttttaccgtacagtaaattccttcctctgattggctaaagcttcagtgcatggttcacaagaacaaaaatacattctatcatgagcaaaacacattttaaagagcaatcacttaaatctcgggccaagtgaaatgtctatatccctataataattaataaccaagtatgtctatttgtctccttatgctaaaatgtccatgaaagagttgataagtggacttctgaaatctaactcttcagctcatgttgcacaaatccttattcatcaagacacacacccaactataaaggcaattaaacttttcagtatgtgcatgaggaatacccagaatgatctaattcaatatagggcaaactacaatactacttccatctttgaaagtttttaaaaagccctatccagatcattattataaattaattcagaatcaggggatatatctattttgaaagaaaataaggggataaaacattatttcaaatgtgtgaaattctggttaattggattatattatggtaaataagggttaatcagaaaacacttatcctaacccatgttgttgaaaaatcttatttttcataattgataagtattgcctctgtaagtatagcattttctcctttttagtgtaagtctgaacatcgattcaaatttgtagaataatgtagatttaggttaggtagaagatttaaatataatgttgaaaatcctagatcagtggttctcggccaagggtgattttgccccctaggggatatttggcaatgtctggagacattttttattgtcacaactggggagaaggaaaactactggtatctattgggtagctggccaggaatgctgctaaacattctacattgcacatgacagcccctccacaacaaagaattatctggaaccaaatgtcaacaatgccaaggttgagaaatcctggcctagatgttgctttaaaaaataaattactgatagtatgtcatgctttcttctagctacctacctcttccctgaaaaatgaagtgcatgtagccaaaaaaaagtatattatagctaatcaaaattttattccataaaaacaaattcatttgataaatatatatagtatcaactatgtacaaatttctgactcagaataaaaaaattatttcataaaaataatgtgttcaaatgtaatacccaaatcaatgcagtctttacacattaatgtgtgtgaaataactaattttaaaatttgttttcagtattttaaaaattctgaagtactatactgaattttctctgatcactttcccacgtcttaactcacttgatttttagcatgacaaatagggcactccaacttttaaagctatttataatctcagaacccaaagaaataaatgtaaaagtgtatcgccacttttaaaatttaaaatgtattaaaaatgtatactgaatcacagattaaccagttaaatcaaactaagagttacgttatatatacattaattattttactctactctccaacttcattttattaacacagtgacccaaaaaggcttgggttgaaagggtattaatactattaatcttgtaaaacacacacatgttcaaccattagataggtgttcattaccttccttcttagcaaaaagagaagactgacccttaatttctcccacagaacactgatccaaagtggcccttcacagagattgaaatgcaagcctcactcagaggccacaaagagacaggggactcttaaaaccatctggcagccgtgaccactgaagggctgcgcattcatgttctacatatcacagacagaaggtcctggatccccaccaagacccacctgggtctgcagcagcccacaccctgccaatcctttggggttcagcaccaaaggttattattgacttgaacatttttatacagcagagaaggacccatgggttggaatgaagaaatatgtccagaatccaggaggtctgcttcctcaccgcactctcactgaccacatgcctgtgagccagtccttgagtgtctctgaggctcagtatacatatctgtaaaacaggtgttgttgggaggattaaatgaaatcaatgtacatgaaagaactttataaactgccaggccccataaagcgcatgaatttgttttttgcggaatgtacaatagggcctctccttcttctttctctgacgtcccatgagcatcctcctgcccccttttatttactctcaagagacaggtcatcaaactgaaccaaatcccatcagatagaatccacaacagtctgagagatgcgaatgatacattccatcactttaacatggaactctatttcttcctgtaatctgtattgagtggcaagtgctctgggtgcattacttcagttaggcttcacaacaaccctaccatataataatcatccctgttctaccagcagaaaagtgaagcacaaaaagatttaaaactcacctgattttcacaaagctagaattgagggaaccaggacaggaggcaagcccatttaattccagagcccacactcttaacccctaccacaaacaacctcccattttaaaaatagagttgtttctaaaaccaaataccaatttttgtaaagtgagcctcacagtgtgctgagagccaagcaatgtacaattaccataccatatagatatactgaatcttttcactttgtacacctactcttcccaactttctcttggtcaggacactgaaagcgggaccagtgaaaccgacattttgcctaaaacatggttctaccagtgattttcttaagttcaagaagaaagtcgcttctccactgagatatttacaatcatctctgacattgcagaagtgaattactggtatgtttgatgagatgatgcaatcaatgaatatgtgaaaataatggtgataataatacatgcttattcataacacttccaggttacagaatgcttccattatacattatctcacaagactggatcatccagccatgaggggaagaaaagatgtgcaaatattggaaggaaaaaggtaagccaagcgtcagagtaaccaaggagagaactagtgcccagggttcttgcttattcattctacaatgaaaactgaaattttggaacttctgaaggactagaaaagaacacatatcttgtgattccaaaataattttgaaatattttccttttatgcaagaccataaaacaaaacaaaacaaaaactttattaaaataattctatctgcatttttatattataaatataatcctagaaatacaaaatttaccttatggagtacattgtgtgaatagatcagaagtaaaaaaaaaaaatcacaaaaatacataagtagaaaagtacaatgtttgcattaataccctatttggcccccatccatttttatctctcctctccctaattactactagccactgcaggcagttataatgacttagtttgcctatcccctccaggcttaatacaggactttataagggactcaactaaggcatgaaatggttaattgatggaaattaggtactataaaataaatggcacacagacaagccaccctaaattcagctgaaatgcaactttgagcaaaagcaaaccacaaatttaatagcactacaacaaaaaatgttccttttgaacttgacagttcccagtcattcagcccagagtaacacacagggaacagtcctcagaaagttctgtggtgtcttctgaatcactgccattacccgagaaaaccccaggaagtggtttgactgagtagctggaccagtgcgtaggtatcagctgatgtctctcacacatacaagtcagtaacaatggggacactgtgaaaccaggaataaccttccttatctttagtagttggggaaatcatttctaactcagtgagtatataacttgggaacaggtcaaatggttaattattcactgagagcttagtaattaatctgcgttagatcaaatatcatcagacctgaataacataaggatgtccgatgtctggaacaatgagtctttggaatcgcttccataaagcagcaatctttcctaaacagttatgtccaacaaagaacaaagcctaaatgcaggcagctgttggcaaaaactaatcaaaatggaccgtgatttcataaaacctttcaaagtcagtttattttaaaatataagttgatgccatctttttctgctccagcaaatggttggagcaaaccatactattaggtgaaactccagctgctgataaatctgggcggtggcaagccagtgagctcacccggaagaaaaccatgcagtcacagagtccatcctcacatgtctttatctaacaaccaaaggaaaccaaaggaaaaggtccaagacatcctgccaaaccaaaactaagagagatactgtgatttatctaaacccagagatatgaactaactagctacctcttttctgtaacagaagttagccctttaatggccacgattgagggtcataaaaggaagttatgatttcatgcagtattgggttttttacaattcataaatttcccactggatgcttttcagtgtattatcccaatggttagcacctttttgactgatttgactattgtttttctacattcccagcatctacaatcccaacttctggaagttttaattatccaaaggatctaacaaggtcacaagggcaaccataagacacaacttttacccataacagcaatattcccctcacaagaagaatctgcaattccaattctaaagcattacacagcaacccttttttacagacaccacacagctttgaccccagcaagagcccactgcacagaaacatagaacagactcacctgccttcaacactcagcagtatatgtaccaagagctctccagctctcctgtgcgaagccacagccaccttttgggaaatcctttatatctactcactagaaaaaaaatggctgtgtgcccccaatccaaacaagacatttaaagaagcagacttttttcttatctctactttcccaaaagaagtggataccttaaaaacaagctgtatattcaaaacagcaaattctgggatggactgagaattaatccaatcaccaccattattttgaacaccaatactattgactagtaaatgaggtacaccatgatttaccacaggcttacatatacgaagtgtcttttatgttattaaaacttaaaaaatcattgtaagtataattgactacattatttgaaaacaattaatccatgaatggaatatatgattattctcaattttgagcacacattttccagccactctggattgagagaaatgcaccatttgcgtatactgaatctggcatgatcatatagcgctaggttcatatattgcatgaaaaaacaagccttctccccattacctcttcctatcctggcccatgggaattttaagaacagcctccaacagaataataaattaacatattcataaaaagaatagatgaggtgttccctagctcctgaatttttttaagttgaccaataatttttcaaattatctaaggaatgagcaacatccttctaaaatactgagttttctgggatctgaccaacatcaaaagaaacacacagttgcaccaatccctgagcagttagcatgacttcggtctgaaatgggaggacacaccatacttaaattgacccactgcaaatggttcccctccactcagccatttgctattaaaagaaccaagctgttctgaagataagcaggaagaggatattcaaaacgtgtaggcgggatattttcacagagcttctctaaattccaaatacctgaacaaactgaaccaaattaaaaactcaagtttttaacctgagttaataaaaaacaatgttcacttcctttttcaactactcatgaatatataaaaacttaaatgaaataaaaatctataacaaaacttttggtaaggttgcttacaaatgttttcaaaacaccatgataccagaagtttaaatttccatttttagatttttttttctccagctcaggcttaacaaagatatacctgtttagttgcttttttaaaaaatctatttttatcccatataaattagtaagcagaccaagcatgattattgttttgaaatcagtgttttcggtagacagcacacccttattgaattataaggcatgtactgagtatatcctatatgctatcaccaaggaggttcaaaagagttatgactataaaccatagccctatgcctaaggactaacaactaggacaggaaagacatgtatatataaaacaattatactcttctatgaggggtagagtcaaaagagaagaaggaaaattattgacaaatgcagccagcaaggaccaaaaagaaggacactcaggagggaagagaatgagcaaaggcctgaagatctgaataaacatggtccatttataggaccttaaggaggtcaactggactggatcagagggcttagagacacgataagaattaaaactggctaggtagggcagggtcagaggtcccctgtcctgacacctttggtttacagataaggaagctaggctcaaagtggtgaatgagtcaacaaattctttaagtgcttcctatacaccatcttctctactaggcactgagatgcagaggtgaataataaaatgtcagtgacctcagggagtccacactggggacagacagacaaaaaatacatcaactattaagttgatcatttcagattctgatcatttctatgaagtaaaaaatgcaataaaaactgaactagggatggattaaggaaactgctcaaacttgggtcacaggtggcctgtccaaagaagggacatttgagttgagacttgaacaatgacaaggagccatgcaggggatatgcaggtaaaaagcactgccagcaggaaaagcagtaagtgcaaagacagggacaaaaacaagctcagcaagtttaaggaacagaatgaaggccattatgactggaacctatctgggaatggggtgtgtagaggaaaatgagcccagagaagcagagccctatgggacatggtgaatagcttggattttattctaaaggttaggagaatgcatctattagataatttttagcaagggagggtattatataatttatatttaataggctactctggggagtgtggaggcagggaagcctagtaagagcttttgcagcctacaaggacagatgctggtggcttggactgaaactatagcagagcagagagtaagaagacataacattcagcacttattttggagagagagccagaagtacttactggattaaatgtgagtctgggaggaaggagaggaatccaggatgaattctggaattatggcctgagcaacaaacatggttgatttagtgaaacatggttctgtttggtgaaatggaaaggtttggtggaggagcacagctgtaggcagggggacactgatagttctcttttgcctatttcaactttgatatgtccattggacagccaagtgcatggatttaggaggaatacaagttgaaaattcatgatagatccattaatgaaaataaaactttgaaaattatttagcatattgatgatattctaaaccatgctgggatatctgctagaaagagaatttagataaagaagataggaggatttagatagaaccctaagggagtccaacacttaggggcagcctagcaaataagactgacagggaaagatgggagaaagtgtagtgtcatggaagctgggaggatcaagcatttcattaaacaagacagagtggtcaactgttcaaaacgttgtaaagagttgagaagatgacgacgaagaatgatcactggctttggtaagatatatgagaggtgaggaacttaagacagttagtaaagataaatttgaggagttttggtgaacagtaatgtttccagggtcacaaagcaagttaaagccaagcaatttaaaacaggtctctggattccacttcctgtgctatttttgtggctctaagctacctgtcatcctatggataataaagaccctctgaagaactttgagcaggaaagaggggtgctaaaagagagttattgtaaaattaatctgatagcagcgtatgagatcaattcaagacagaagcttccatagtagacaggtgcagtgatgagagcctgcattagtagacagcaaaaatggagaggaataggccatagggacagctccaaagaatgcacaaggccagggaaagttagaatgattcccattgagtgccactaatcccaagaatcattcaacaagataggagaaaataaagtgatgaaatgcaaaagggctaagtacttttgaaaaattctattataggatatgtcacacaatgcctgtatttaaaaataagacataggtcaggagtggtggctcacatctgtaatcccagcactttgggaggccgagggaggtgggttgcttgagcccaagagtttaaggccagcctgggcaacgtggccaaatcccatcttcacacacacacacacacacacacacaaacacaaaatgcaaacattagttgagcgtggtggcatgggcctatagtcgcagctactcaggaggctgaagtgagaggatcacttgagcccagggggttgagattgcagtaagctgagatcgcaccactgcactccagggggtgcaacagagtgacaccctgtctcaaataaaaacattaaagtaaataaaggtaaaaataaggcataacagtttctacaaaagtatcaactttgtatatttttgcccttttctttattatcatatattatcacttttaccattgttaatgctttgaacaacatataaactagtcttattggccatcttcaccatgtagtccaacctgtgcactaacaagctcatgaagtacacatatatctagttagttttaatcaagaatgccctctttaattattcaagttttattaggtgactgctaagtaactaaggccaagtgaagaaaatatggccacaatataagaaaatatggccacaatataaatcagtatttccaatgaataccacaatacaaatttttatttaattccccagaaagtaaataatgtaatatcacagttcagaactgaaattccttttccagaacatttccattcaacactatttaggatttacacatcttgttcccgccctaaaatggtttactaccaaagtccaaattgtatctcattccaatgtattgtgcatcattctacacctttggttaaattagagaaagtaaagagaaaaaaaaaatccaaagtttggcagttgagcccttcatactcctaaactatatctttactgaccttttaattccaacatgtgaaaggcactagaaaaattaggagacttcctgagatcacagcctcctgagaaactatgctattgtccccaaaagaaatacactggtacaagggagtgaggtaccatgaggtacaatgaggattataacatgggcttgtaaaaggtatttcaactattctttagcttttgtgattagaaagatgtattgcttgatcgtggaaatgcaagtgaaagaatgcaaaggcaaaatttccaaacaagtgctgggattgtgtgtttctgtgtgtgtgtatgtgtgtgtgtgtcttaacatggagcccaaaaggtgatgcagcactcttccaatatattatttaactaatcctcatgaacatatttccatcactgatttttataggagtggaggcaatcttgatattctcggcaattgtcaggcatatttctgatatcatttaaacttctgatgcagtaaattgtctccaaaaaactctgtcaaaatccacatgacattggcttcagcacaatgagaaaatgatggaaacagagtgtactctaaaatcacgttaacacagactcattaatcactgcatagctaacaaatgttcccaatttcaacatgtatttcaaagcacagctctacacccttctgtatacataattttccaaacgattcacagctaaatggcaacgaatttatacatccattaagataacaactgagaatacattttgaaacaagtattcagacctagagtttctgtgggtgtgaattcatgaattcaaagcctatttctcgccttactggtgacagcaactgaagcaggaagggatggtgccggcagtggtcaaaagctgtccataaccccatgtgaagtcagtggcaaccgtctccaagttccatatgagacaagcaggcactgaggatgacatcagggaagtacagagtgttttctgtgcctccccagatgtcctggcaggagacaggcttttcccaatctaagggaaaaccagccaggaaatgtgtctcagttgacagccccagatcacaacttctgagtggtgataaaaagtgactgtagggacactgagaggcctctctgcaatcctgctgggactgaaggcacctcgcctcatcatcctaattacagaaatcctaaggttagaatggagatggggctccaaggtgaggacatggtatggggcaaaggaccttggacttgaactcagaagacttgatatctatctctggctctgccactcatgaactgtgtggccctggatatgtcatctaacatgtctgatcctctattatgttatttataaacttagaaaaagagaaatatatatcctcactatcatacggcttttgtaagaattcaatgagattatgtgtgtaagagtcattggtaaattacgaaagccggcaaaaatggcgatttctcactttatggaggggcacatcctttatactgtaggcaatgggtactcagtgaagcttttagatcttcacagtaacctattaaacgtgatgttttaagaagatgagccttgtagtggaataaggaactgaccacaaacagagtaatttgagtcaggagcaccagctaagaggctgtagtagaccaggcatgatgaagtagaatctttctatggtagtggcacttacactatccagcagggagcttttgaggaagaacatggatgttgaatgttgagcacagcgtcaataataaattagagatgattattctctgagctcccgttataataaactccatcctccaacctcttgagccctccactagcactgcaaattcaaccccattatcctcttgacctgctccttctcctctatctcaaactcagatccccacttgctaatgcaagacccccttctctccttggttttcacttcttcacagctgctggagtggctctttgctctcatgttgactttgggtccctgattctcaaccatcccaggccatctgacttcagctgtctgagcagctgcagatcacacagtcagatacttcattaacaccctccccaggcttccacagtctcttctccaggcagccttccagcctccttctgaccctcccatgcccgtctccaaacatggctcacccacaggctgcgttctgtttccctggtttaaactgcaatcccagcaaaagtcactcaatagtgccacatgggccatgatctctgacttccaatgaattctttgaggaccaagactatgtcttgttcatattgtatctacagggactagcatagaacctggcatatagaataccctcaattgaacaccaatttcagtgaatgaaattgataatttggaaactctataattcatctctcctataatggtgcttttcttggcgtccacctaccccctcactactcctcttagtcatctttattagattctattattcattcgtccccaaagcaggaatatttcccaggattctaaactcagctctcatattctctctttgctctctctccagcagagaacagttcccaccagcaaacacagtagaatgtcaagacatttcagatattcaccctcactaggacccaaattcaatgctcctgccaacaaccccataacttgcaccctcccccagatggtgaagccacaccaaaaaaattgactccaatgagaaggaacaaaggtcagagaggaattggaccctcccagtggagacagctgagcctcaagtgggactgacaggcaagcctttgccaccagacacagtcaccagcgtgtcctacattgatgacaaagaagcctctcttctcagggatcattacttgcctttaaaagtccagattctctgaggcctgggagctttatacctttaaaggcattcggtgtcctctctttgagacagtcttccatatccaagagaaaggtttgcttcagcacttcattacaaacggggaaagctgccctacacctctgagatcctagtccaaacctgtccatttggcctgcgtggctcagactctctttgatcaagtccccaggcaaagttcggcctacaactgggctcttcctagattccctccatccatcaatgccttggcacaatttgaggccacaatcacaactgcaggttcctcacaccctcatctcgacagaacagttatataaaataaaatgtgtcttctccccagcagttctggtctcagttactggcatttccattccttgaaccactggggttcagacgtaaggcatctttaacatctctagtactcagtttggatcaagcatgaaatgtcattttttttccccatactagactcaagtttcttgaggaaataagtttttatcttatgctttatggttaaaatgcatagatcctctttcatggttttactgtatgtttctgaaccttcttaagcttgttccctcaggagggaaataaattctttattggactatgccatgtggccttatgaatacctctccactcatataaaactaacctaaataacagaaggaaacaattttggatatggccttatccagttcacacgagtcaggctgtgattttatggaaaattaggcacttgtgggcaattagttgtttaaatatctataaatcatcatgtcaataatttttaaatgtccagttaaaaatttaaaagtttggaaagagaattttttaagactaattctgtagcaagtgaattaattccaagaaaatgaatgtagacaactagagcaaccagatttgagacacagtaagaatggccctacacatgttattagagtacattcctgtgcatcctttagttctgaggcaatcagatagtgtcatctaactttagtgaagttagaagaatgcctttaataaaaagtcttggacctgagttctgtcatctgtattcgaaaatatggtctctgaggtcctgctttcagctatcaggatagttagacctcacagatctccttctctcttagaaaatgtatattcttccaagtaaaaagagtagaataaaatatttccactaaaatgcacttatctctacatactatgcctcctcagagatctgtgtctctcgctgagttcccagtctcatgctctatgaaagtccttcctaaaagccaccattcaacatgagcttctagtcctgctgactcaaatgatgacatcttgttatagaaatctgagtgcctcacagtggatctacacatcagttactgatggccactgccaacctctgtcacaggaagattaagataacacagttaaagctgtaaacactgccctaattatcagagtttgctaccattatcagggctgcaggaggactctacccagagtcatcacgctctctcctgacatcatatatacgaggtcagagcctttcagctcctaagccccagcagacaagctccagtgagcagagcttatccttaagccactgtcaatacaatgtgtaattttgagtataaagcccatccatttattaggccttatattcttcatctataaggtgactacagtgaagtatgaaacattttaaaacttggataatcactaagaagaattcctaaagctaaagagtccttcaataccgataactcactgattacatagaaaagaagtagaagaggcagagggcagtagctcatgcctgtaatcccagcatgctgggaggccaaggtgagaggatcacttgaggccaggagtttgagatcagcctggccaacacagtgagatcctgtttccacaaaaaataaataaataaatagccgggagtggtagtgagcacctgtagtcctagctacttaggaggctgaggcaggaggatcatttgagctcaggaagtcaaggctacaatgagttatgatcatgccactgcactccagcctgggtgacaaagcaagactctgtctataaaaaacagaaagggggggaggggaggggagggaaaagaaagaaagaatcatatattccctctcagaatgagctttagcaatgggtcattccattgttctgacagtgtcaattaggaatcttcctaattttgagggtttctctttatcgtttacataacgctggcgtaatgtacctttaagaaggtaaaattcagtgtcacattacctcaatgttttaggttggtttttggtgttagcttcactctcctaaaccctgcaacacaataggaagcttagtgaaaggaccacatattaaccaggaaactccatcacctgcactgaccaaagctgataaactaaccacccatactacattcaaatagtctgatcatctataagtaataaaagtgtctccatagaaaccaagtatacagggaaatctgcttacagtacaggatctgcttgaacaaaaagacttcacttcaagccaagattttgctctaacttaggttcacacatcatcatacacggatagcattcgatatcacacctttggaatttcacagtcctgaagattacaaaaagctctgcacatggagagagaaaggggggaaaagctttgggagaaaagatttgcatatgtagttacaaaaataccaaagcagattccatgctaagctctgccaaaaagagaacaattactgttgcccatcagcacgcagccttgaaattatattctcttctccaagcagaagcagtcatcagattatcaaaatgaggttatcctgactcaattcaaatagttcttatatggaataagcacagtgcaatcaacagacaagcagctatttccttcccacacaaactataatcttttgtgaaatatatttttaatgaagaatacataaccctcctacatgtttacttctgccctcacactcctacacataaaagtgcaaatacattttaaagaaagggagaagaattttatagcttctaataacatcccttacaacgtagggcaaagaacagtagcatctgaactaaccctcaaatgaaactttttcatatagtgtgatgcttatgaaagtaaagctagtctccagcagctcctcaggaaaagtacaatgaaatcgacataaacaatggatctcaccaatattttaataatttctttctaattagatgcattgtgaaggcttaattcattcaactactaataactcaaaactcacagagctctgagctttatcttttgcaaatttcaaattataaatttcttgtcatgagtcattctgctactcaagaagcaagttttcaaaaggaaggtttttcttttttgtaggtaacatttatagtgacagtcatttttctttctcctttaatcccttgaattttaaatgtctaaaattgaaataatatgacttgatgggtgaaacatttttaccattaggttagctgatttgaaatgaggctataaaaataattatgaatgttcatgcccacttaacagaattgtaaaacagataaaagttttaaaatctctttttccactagggcttttttatcctacacacaatatctgtttgagggtactggatcttggaatgcatctcataatttggttcctaggagggaaaccattaagaaattaattacagtgacaagcagccttggtgatctcttacattaagggaatatgcctttgttctggaaaaaaaaaaggaataaaacttggtaagccaaatcaataagtgtctttaaaaaaatagccttagaagatcagaaaatcaattttgcctaaatgtgtgaatgatgtaatcctattacactaaaaggagtgttttaattttgcctaattgtcatttaaaaaaaaaagaacaaaataatcgctgaaaaggtagactaaacaaacatcgacaaaccagtgtcgtttcattcacacctagaatgatgtcgtttcattcacatcagaagagaaccttgtctccttaactcagcaaaagctcaagaattacttttgcaaacaaagtagcatagggtaaggatagagacaggaagagaaagaagaggaagagaaagaaaaggaggagttaggaagacagactagcaaaaaagtttgggagatggacaccgttatccaaaagcaaatgtagctgctgatgctagtgactaaatctcactacatccagttcaggaaccttattcacacgtgtgtaagaaagaggtggggaaaaagcaagacaatgagaaaacatttttgtgcattcagttataatgcattttcacacacatacacaaatgcactgctctgctcctcaaagcatgctgataagaggtgcacgttaactttcaaaatcacctccagatagatacccaagcatatagagattaaaaacgacactaaattcctacatagcactaggaatgctggcacacctttaaattcaaaatctctgtttttatacaggattgtaatagtccagttgctcatggaccaatctaactgatttggaaaacaaaatcttaactaattgaagaaaactcagtgccttctccagtcaaccccatggagttactctgcgcagcccatggcaaggttctgactgccagcttctttaggtccaggaaatgcacctttccccacacacagccatggaggagggctaagaaacaaactgagccagaattgctgctgttcacaaaaggaattccccctcccttcccctccttctccctcccctttcttctctcgtccctcccccatcatcgctggagaataatatcactctgctacctgccttgagcaacaccgtgagcccctgtcttcaagcattcagggaatttaacagcctggaaattcctgttgtccattcgctgaggtcacagataaagctaaacaacaagccgtggttcccatcaatcataagtcactcactgatagaatgtatggtaggagacctgatggaagcgagtcaccagagaaaatacccactgatgacgcatatccaggcataaaaatagttacagggccctcaaagggattattcaacagcctacatttagactttcttacaagagacctgaagtcaacgtgctgcagttaagtggctggagagttgaagtttaagcttcctcaacagacataaccacagaaagctgttttaaataagctcccacaataacaagctgtttagtaaattttaacacaactttataagccgtaaacagtaccaccaactatcttataaaatgccgcctaatcttctattttattcactttctccttcaaataatgatttctcttctttaactcgtagtccccaagcagtaatatttaatcagtccaaagaaatacagccttacttgctttccaaataaactttaggaaaacaacacaaattgctttctgcatctatatctttataaaacatgcttttaagtaaagcttaattacaaatttcaccaaaaatcctgacattttgcccactgtatttgcagttatctttttcatgaattggtttgatcctttacagaaataattaccacatgtattacatatacctactaaatatggtatcttatacaaagtaggcattattattgtttgacaaatgagtgagtgaatggatgaatcaatgaaatgttatgtgcaagtattttaattgagcaaatgacaagtaagatgttaactaagacaaattctggtttttttaaattttatgaggagggaaataactttttatatgtataaccattttaatagttttcaaatcatctgttctcttttcctcccactcaaacatatgcatagctaccctgcaagcaggtcgttcacagaactttcatatcagaaaatgctggattttcgcacatttttatatttaaatatctaaaaatgttccctttccagtttgccttaagcaaatgtgctgacacaatgaacaatgaaggcaactggctatgacagaacccaaaattctgcctcagaacttgaacacttccgacttgcaacaccctatttgttagtcttattacaaatcctttcctaattgtggacaggtttccattgttacccagttaattattagccatagaaatttatctatgatagaatttatctcagtgcttaatgttattaactatcttgcccacacaaatggcaaaaaacctgttaacaacactgttctaacttttgacaaaacatgtttagggctttactctggagggcagctctccagtgaacaagtagttaacaaaatgacatttctcttcctgtcctggtaggttctacatcactttcctcaagaatgataacactgctacaaatacaggtgcaacatatttttagtactaagatttcacaaagcattcacgtttctctcctgtgcatatgtgtcaacagtatgtggcctagtttaaagaacctaaatggaaatgttcactggtgccctctagttgatcattgctaaagcaattttgaggaagtacacgtgtacctccatcatcccactcataaatattgtaaagttcccaatcaacattcagccattaattcctgacataaaatgtgaaataaaaaatgaaatttagaaactgctttatttcataaggtttcattatgcatttttttggaaaatgaacaataaagaaaaactttgagaaacagaaaaaaaaacctaaaagataagatgagacatattcctatttgccaaagaagaaagaatgtattaatacttaatattaactcagaaaccaaaaatgtttcactaattttacaaaaggatagttcaaaatcagccaaggcaccctgaaatgatcatgtttcaccctgctacatacatttgacagctttcagtcatggtggtctatgctggtcaagtctgaactgaggatcctcagataattttaaaacaataccaatatccaaaggagacactattccaaattgcactgacatattaactatcaattcagagatcaccgattgaatcccataaaaggttatttccatcagcactcttagttttagtaattccaggcctgttaaatttactatcaacagaacaattgttttttgttaagagaaaatgaaacttccttaccctagattagaaactatgctatcattacagttatttaaatctgtgagatcatttcctgcattgtctcctccaatgaagaagttaaacaaatcaccgtttaaaatttaaaaatgcaaaaatacatttcagagagtatgtgcgtttatctttctgaaatatcaaacaatgtaatcacctggtcactaaatttaggaccagattatttaattatctggaaagaactggggggaaggggaggatatagcaaagggcgatgcagcaaaaaaaaaaaaaaattgctttttcaaattaatctttctagaaacaatatttaaattcattcccctatgtcactagtaaaataccatgacaataaatcattttacatgttttaactatattcaaaaaatgggaaaatacatccctagttcactatcctacgcccagtcaaggacagataactcacatttagactataaagttagttttctcctttagtctcagtattatgatgggattctgttttgttttgttttgttgtattgttctttttgagacgctcactgtgttgcccaggctgcagtgcaatggtgtgaccacaactcactgggaccacaggtgcatgccatgtaaagatggggtctcaccacattgccagggctgatttcaaactcctggactcaagcaatcctcccaccttggcctctgaaaatgctgggtttatcaatatcagccacagtgtccagccacagattctgctttatttttaattaaaaaaaattacatccttacatctcctcattgtttaatagtgacattttttcatttagtaaataagattgcttccaaaatatttcatgggcttatgctcattgaagtcattatcttcattgttttcccaccctgcaatgcacctgcaagagtgcatgcacacacatacatattcaacctttccctcatgcctgatctcctttgatgaggtcaaacattcaaagaacccaaggtatattcaagagagtcatccttaactcctccttaaacctcagctcccatgtctaatcaccaagccatgacaattttaccaagttacctctcttccttgtctgtcttctctctaattccactgtcgtgaccttagttttaccctttaacccagtgcttctttcagggaaataaaataactatcctcagttctccctcttctcccaaactatgctctacatgaccaaaaatgagttgtagaaaacataactctgactatactgctcattccatcaaaacccttcaatggctcctagttgtatcatacaaagtcttgtatcagagattacactatcataatttttcatttatgtgttcgaactttctatttgattttgagctccttaaggtcagagactatgttatacttattactgcatctccagctctcagcagagtacctggcacttttgttgaactaaagtggactgaatgacaggacactgcattgacattttaaactcctgatgtggccatgcatggtggctcacatctgtaattccagcattttgagagactggcaggaggatctcttgagtccaggagatggagaccagcctgggcaacaaagcaagaccctgtctctacaaaatattagctgggtgtggtggcatgcacctgtagccctagctacttgggaagcagaggcggtaagatcacttaaggaatttgagattatagtgagctgtgatgatgccactgcaccccagccggagcaacagagcaagtccctgtctcaaaataaacaaacaaagaaacaaataaacaaaactcctgatgtggtctaactagactagataaaaagaaggtatggcagagcaattctctctgaaatcaaagaaaactgaattcaacaatagtcttatcaaatcttaggcaattacataacctctctgaaccttaggttcccaagatacaaaatggtgttatggcaaatggaataacatacactgtgtgcctcctacaatagctggcacctattgagaaggtgctcaataaatggcagctattattatgtttagtgatttctgctgtgcaattatacatacatttatcagacatcaaaatgacctattttggtgctgtccactagacaggtatctatatatctatactgtctaacactgtagccgctggccataaatggctcttgacacttgaaatgtggctagtataactgagaaactgatttttcaattttaattaatttaaatttagataacctcatgagtctgggtggctacagcactggacagcacagaccaaattagccctgacatcaatggagcaccctttaagtgtctatcatttcccctttccccaaaatcagtcttgtttacaaggattcaagtgccagtgttaattagggtctatctatgtcttcatttttgttaattcaacattgcctgctctgttaaagaaatcagacctaaatgcctatatttttcactccctttgcaaattagctctaacactagtagaaggggctctacatcagtaaaacaatccattctatttaagaaatttatccatgaaagtgtgagaagatcagataacagagttccatagagaatcttcctcaaataagctcctccaaaactttgtatctttacaaagttaacgcaattcagcttttattgcgtgtacttcttcacatattcgtgcacttgctctgcattccttctaacactctaaattcattgaaggtagaaacgatcttgcttcatttccctgtacacattttgaaagaattactgccaaagaaatgaatgaagaatacagtccacagaatggaatccccagcacaacacagagagatggatcagagtggcaagtgcacaggatctggaccaaaagagcttgcttcaaatctcagctctgccattaacattctatgaggtttggaaaaatcacctgacctcctatctgtcaaataatgataatactaactgcaactcctaaatatcctattaatataataatctaatgagataaatcagacatataaatattagtgcaaatagtgtaactgagaaagtaatacaaaaaacacttaaatctctatcttgtatattactacagaaaataatgtcccataaatatgaaaaacaccaggtatctgtcttgacaatctgtataaatgtctagagggaaagatcaattttaaaataattataaggatgattacacttccatttgtaaactgtaatattagtcattaccggtggtgtagtttttatctgacatcaaggtcatagaatgctgaaatatgcttttgtatatatggcctgttctccttaattatacctgtgctgtaaagatagggtctgcagttttcaaaagtatttggtaaaaatagttcacttttgttgtttgcttttcagttcacaaagcactttcacttacatgcttaaagttctcttcgggacaactccaagataggttgaggattttagtatttccactttgcagaaaagtaaactaataacaacatcagtaagtaaaaccatcagattaataactcgaagtctagaactcctgttcttgtactcaaggaatttcctactgtttctcatttccaaaggagaacccagattgtgttcatgtattcccacatcaagaattttagcaaaatactaggtattacactgtacatctatctcatcatacatatgtatgtttatatataatttaatattaatattaatatataatttaataattttaaaaagtgttctcacccacactcacttagcagatccttacagatagggtatgccaggtaggacaatcaccatttatagataaggaaactgggttttggaaagatctcaactcttgactgtgtctttgcagggttatggagatgaatgatctgtgcacctgggctatggatcgagatctactatcacccagttgagtaacttcaaataagtcacccaacctccctgggccttgccctcctgtgtaaaatgagagactttgagtcactcacagataccacctagcttttaaaactcttattctgcaattcagctaattcggcaacatcgctgagacacggcccccgatggtctaagtccttgctggttctttgtcctctctcaaacactgtaatccctcttaacaatatctgtttctccacaatcgaaaaactggacttcattaaggagttcattctgtttgtttgtttatctttatagagccttaggccctgtttatgtcccatttattctttgatcttttagctatgtccagccagtaaaaacattccctagaagaaaggctagctgacacatgcaggcacaggggtcccagggaaaggggtgtgccctcacctggcctggcctcactgcgctgcctactgcactttcactttggggataggagatgcttgtctgtgttgatgggttttgatatcttttacatttttattttttaaagaaatagtacaaaacccaagggtgataggaaagacaggctcttgcacccaggtccaggaacagggtcacaacagattttaaacaatttaagtggcccaactaagaacatttccaccataaagaaggggcaagtccaaaagaagtcatgtctaagggcacctggctaaaagtagggactcatgtgcacaaatccacacataccctctgctggcatggataaagctcttcctacatcccggcggaggtgccagagaaataagcaacctgaccccccaagagtctttggagcctggcagtaacctgagctgctctaggttatttttgctgatggctagtggttcttaaagggactgtgttctaagtacacatgtccagacacaggatgcaaattaatgataagacagaagtgattggtctatcttcattaaacaaagtctataaatgcttataatagataaacgagaagacatgtgagcaaatattttaatgacctttcaaagggatcaatcatatatcctgtgatataacatcaatggcttaatacaaggcaatactgaataacacacaattctgttggtgtaaaatgtgaagacagcaggcattcccccaaggctctgtccttagtgcaagcctcctacgtaagggaatggggagtcaagattacagatggaaatgacttccaggactgagctctacagttatcatcccacttaaatgctcgctacaactctcagaagtataatcattccatcgtaccaaaaaggaaagtggagctcggcgaggcttcgtaacatagagcaaaagttacatgacggatgggtgcaagccccttccaataatgtctatgggaaaggtgaagattccgaaagcaaatatcccactcaataaatcattctcatgaaacaattagtcctttcattctctatcccacatccctatattggccaggcaggaactggaaagtgggacctggagtcacaaacacccaggtttgtaaaccttttccaccacaaacttgctgggtgacgttgggcaaggtggatacactccctgagcctcagtgggaataacagtagtatctacatgatcaggttgtttagagagtaaatgaggtcatcatatgtgtaatatatttggaatggtgcctagcacgaagaaaccccacagtaaaacaattgctcttatcagttgcattagtattcctaatgcggcaagtgtgcaattcaatttcccttgaaaaatttgataatctataatcataagaaaaatcacgtaacagctaattatcaagcaggtactgtacagatactatctctggtgatcacaattttgccaggcaagtgatctgactcccctttgcagatgagggaactgaaatttacaaaggtttagtatcttgcccaaattacaactagcaagtgacaggacagcgactttaatttaggtctgacttcaaagcccatactcctttctctcaatcaagaaatagccagagaaatggcatgaagagcagtgggaacaaccctctattctatccagttctattctacaacttgttaactctgccctaaagtcagtgtgtaacctcttaacctgtttcacctgcatttttcggggggagggaagcctaatctctgcagcatgttatccatccattattggtttataggtaattctacagagaatgataaagttctctgtaaacctatttaaaatatattattctaagggttcatttctgagccatggctcttcagaaatccacaagccccatattacataatcatgataaagccacacaaatgcgtaaaagcttatagttcataaagcatcttcacaaacattcgctcacttaatcatcctaacaactgagcaaggtagctatgtgcctgtttctcagatgctgaaactgaggcacaagttaagtctattgcttatagttatataatcaataaatagtagagttgccattttaatagctgggttttatgatgtcatatctgtgttccatccattgtattaagtccagctcaggaaaaatatcagcatctttctagtgtgatctgctacaatctataatatatcaagggacgatatattattagcctctccttctgtctttcaggtactatcttttacttgtgttgtaaaatatagttttaattaatttcaacattatttcctaacatagcataatacctactcaagaaaaccatgtcaacaggttaacttcccaaagtttgactgttcaagagcacaggggccatatcttactcatcattttatagcctggagtaccttatggcacttaaaagtagatgatccataaattaaactgaataaagctcaagacaactgtaactttataaaattatatgtccctattttacataataatttttaaaaactttaaggtacttttaacagtgaacttgacaacagaagttatgtttcaagatcacatttattgagtgtccagcgtgtcttgcagtgctccaagtgctttacatttactactttattcctggaaaacaattctatgggtaggcactaatttttttttattttacagatgaggaaactaaatcaagttaacttggacaagggcatagagctagttagtggtagagcagtcatttgaacgcagggtctccggcatccacagcatgtgttcagaaccactccactacactgtccccactgataatatgccagacactgtcctcagaccttaattcatcttcacaacaacgctgggaccagtagaaaatcatcttggaaattgaaagtcgccttgataattcactggcacgaattggtattcaggagaaaaattaagtaaaccaatttaattgtttataacagtcctgctccatgaccaaaaatatcacaagtagcacatccatcacattacaattttaaaagttgttgggaaaataaaacttagagctacattttaactttaacacttgaactttaaatttatagccagttacctcttcttgaacagtatcttgatatgttttctgtgcagtcttgtacacttcacattgttttctgttttgtcttacagttgtgattctatctagcatccactgaaattttggttttttttaaacaataaaaatctggtagaaatgtttttttcaggacttaaatttttgtctcttttcttgccttcatcttattttctcatctttttttccttcctggtcaaatgatgtaggatggtatgtatagcaatcttccaaaactagatgcttaagagtaggttcctcaaagttgagtctatgggcaatccacatcattatctccagggctggggctccaaatctacattttttcagcaagttgccaaggtgaattctctacatactgggataaatcataagattttcagtctgctgattcctgtaagtggttcttccattgaagcctttttcatttagcagtgtgtatgtgctagttttataaaaacataaacttcactctctagacttcagctgagagtgtcacacaatatggggcattttatgtgctaaatttaaaccaaagattttaacacactgtattatttatttcaatgtgtagcagccaggaaacacaactagagaatagagagtggatcaaaccaggcctccaaagataatgaatggcttaggaaatgcacccaacctgtttcatttgagtttaccgaagcaatagatttttatttttggtgtttcattttcatataaaacctgaccatttgcatccctcaattaaccttcattattaaaaactaccttattgaaccaattaatggccgatgttagagaaaaacattcaaataaaacttcatcagaagttttcatttaatagaaattatttaattactaacaatgcaagagataagctaaaacttagaatgtgaccttttttgagatgtcacttgctgaaatgtttgattattgtccataaaacctgacaggaagttcagattactatatgtgggtctctaagagaggctaatatagtcaattgtgtcacatcacctaccttcctaatcttcacacttagtgtttgttcttcaaccttatggagacacccagttcctcaattccagcagttcaccatcttcctcctcctcctgctctgggtttctttcactattgtctctgaattccactgtgaaccactttgccctttgtcttgccagcatcccaactcatctgataccttgtccttcatacccatcctaaaaaacactcaatttggttcactggtttttcggtccctatgtaatctagaggggctgagaaaaagcaccaatttcacaggctgggctacttctgtggagccctctgaatgtcggcctctcattccaggatgctctgctcagcactctctgccatttccttcagagacaattccaagtgttccccatttttgtcaatattatccagtttttccagataaataaatttgcctttcacttcacaaaaaagaaaaaacaataaaataatgaatttttcaaagaaaattatgtttaatgcacagtttctacccataaacttagtagtatacctccttctgccccaatcagtcctttctggtgctcaaagcactctagctgctccaggattctgctcaattatcatctttcctctatatcatctacatttccctctccaatggctctacttggtcagcacatataaacaggttcacaatgatgcagaaatgctttctgggtcttacctcttattctatcatctcactcctcctacacacagccaagctttcttgaggtacagagtatgactatattgttctcttctctacctccacaaacatagttccagataggccctcaataataattctcattgtttcaatattgatgctgaaaatagagaaagcccaatagaaaggtggaaacatagttcagcagccactttataaaaagagaatatacaacagccaaaaaaaataggaaaaggggctcaactttgttaaccaccagagaaataaaaattaaaactataaggtacaccactacatagccatcagaatggccaaaatgcaaaagatgaaaatactacagcaggttgaggacagttaggaccctcatgcatgttagaaggggcacaaattggcatacctgctttaaaaaggcacgcggtaataactactaaagtggaattcatgcaagccccatgatgtagcgactccacccctagggctgcatctgcagagatgtaccataatattcatagaagcactatttgtaagagccaaagccaaaagtaatccaaattcatcaatggtagaacgaagagattatagcacattcataggatggaattcaatacagtaatgagaatggatgattgttacacatgaacaaatctcactgacataccatggagtgaaataagtcagacacacacacatgacgcagagcatatgattccatatacataaaggacaaaagcaggcaaaagtaatagatatggtgttaacagttacagcagttacccttgggttctaacataactggaaaagggcaagagatgtgctctcagaatgctgataatgttcaaatggtgaaaatccatcaaactgtctacatccttttctgtatatatattatattacacaattttaaaatctggatatactgattcatccttgagccacctcttattcaaaacactcttgacctccttctctgtctcactctatagatgctaagatcctgaggccagggactaatccttgtctatctcggcttccctacttcctatacagagcttagtacacacctgctctcaacaaatgattctggatgagtgaacgagcatggcacctcagccccactgattttggtctcttttatgctcttgatgctgaagtctgcattttcagcctcttccctgggctccaggtcttgatctctgcctatagacactgcagtgataacaacctaccctttatttggaactggctttgagtctggagctttacctatcacaaacagcctgcatgttactaattattaccctcactttacagaccaggaaatcaaggatcccagaggtttacctaagaatgcacaggtgataaactggagaagtaaaattgaaactcaggtctttcttatcccaaagccaaggatctttccacagaccacacatgaccacagatacaataaatctaaaatgtaggtcacacaggccgcgcgcagtggctcacacctgtaatcccaacattttgggaggccgaggcgggcaaatcacctgaggtcaggagttcaagaccagcctggccaacatggcaaaaccccatctctactaaaaataaaaaaattagccaggtgtggtggtgcacgcctgtcatcccagctactcaggaggctgaggcaggagaatcacttgatctcaggaggtggaggttgcagtgaggtcacactactgcactccagcctgggcgacagagtgaaactccatctcaataaataaatgaattaaaattaaaattaaaaaatgaaatgtaggtcactacttttctcaaaggcctgctcatcttccttatcctgagcaatatcatcactacccactttgtcacccaagctgcagtcctgggaattgccttcaatttccctcacccttcacactgactcagccactaagtactgtgtgctaagtttgacagtccatcctgtgctcactattctaaatatcgcagcattaattcaggctttcattgttttttcgcttgaatattactgtaattgtctgcacaccatgtctcccaaatccgggcttggcttcctctgtatcattcttgtgaggctgcctgagagatatttgtaaaatgctaatcggaatatgtcccctgtcttgcctgcaggacagagttcaaacatagcagcatggcataccctccttgacctggtcgtggccaagctctccagatccttcctttgtgactctactcctcctcccactttgtaatcctgccatgtgaagatttactgctcacaaatgcatctctctatttccaggtctctggatccttttttgctaaggctttatcttcctggaatgccctttcccatgctgtcaaccaggcaaattcccacccatcctgcaagaggcagctcaagcacttagtcctctgtcaagcctctcaagtaaagctgctgcattgctttcatgtcacagctaagctttgtgcatccttctcttacagccctttcataatgtattgcagtttttttacagactgcagccttcacttctagaccattagctccttggggacacatgcctgctctttattgcatgctcaggcccacacgcaatagtcaacaatacttgaacaagtgaattagtaaatgaaaccaattgtatgtgtacacataatcttagttgcaaataatttattttaaaagcaaatcccaagagaatgaaccaggcagaaacaatgaggcaagaatagatcatttatctttgtaaactctacgagagtgcagctcaaagtgtaaggctgaaaacaacatttagctgttgtgtaagtgtctgcaggaacatagcatcctcctctcccaggcctctcatcaataatcttctcctaccaccaccgcagccatctctgatcctgggcaggggttaagtacagaggtgaaaggaaaagggtgaagatctgtatttaatagcctatttcctggatccctagtctctgaacctagtggagagaatcactgatactcaacctcaagtttttggtgaaataaaaatggtctaaaccttaatagagatgattcttagtggagagaaatctattaaggtctaaaccttaataaaccttaatataaggtctaaaccttaatataatgttaacaataaatcttaataaaaggtctaaaccttaatagagatgattctcaggatagagcagaatattccatgtatctcctggattggctaaagtggaacagagcaaaaataaacgtttttcagattgtgctctcatttctaagatgcaggacaggaacgtgggcaaatcaatagtcaagtggtgatgctgtcacttttgaatgaagaaactaaacaaaggactggggaaattgacaaagatgagtatggctgcaaagcacagtgagagaagaaacttgacgtctgagagttgagtgaggggctgagaaactgtaggcaggaatacccacttcaccaatcactccacgccacctcaccaccctgggccacacggtatttaagtacaaggcaggacatcagatgacctaccgaaagtactccttgcacagagaagaaagctgactacggctcttgccagcgcctactctacatgaaggctgcaattaaacagctctccctggaataagactgtggaaagaagcagccaagtgcccccctgagacacacagaaaagcaataactatgttgacattccaagaagagagagggagaagagcatttttcttgcagtctcattctttaattgcctcttctggcttcctttctggagagagaagggaggtgggtgatggcggctggatcatgtaaaagaccagagtgcagctgatgtgaacttctatcaggcctccttgcacaaagaccttattataatacacacataaaaatgcgtgggcaagtcttggagggttgaggtttttccccccaaactcactcccagccccgtgctttgaatgcagttgtgtatacacaccctctgacagaataggttcttcgtgttgccatggagctgaaacctctgtagtttagatggaaggatcacagtgcttttatacttctaacagcagaggtaagaatcactgcataatattaactccacttttatttcagattttccgttgctcatcttcgtattctgcgtgaactctatttatatttttttactccttataaaattacctcatagaagctgctagcaaactgattcttttctttgtaaatcaatatgtcaaaacttgagtgcatacatgatgtgtgagttttccccactcctgccctttttaacagagaaaatttgtgaccttatcacatctaggggagtttatgagaaatgcaaagtacaaatcaattcatagctaataaatatgctgtgaaacacataaaacgtcgcataaccagtaagtattttctctgatatgataaacctaaagattatttatattctgattactatttttcaaataggtttcaagaatcaaaatcatatctagaacgcttttgcaaacatagatatgcttctgcaagttcctctcagatcttgtttcaaaacttagctactaccctattgtttggaaatcaaataaaataatcaaatgaaagaaaaacaaagtaatttcctagcacaacctcaatgtctatgctgcccctccttttcagattttgtacctcctaagaaatcagtgatttgacttctgcaaaatcaaatgcaaaggagttaaataaaacaattttgatttcctacctggaaatatgcttttggtcctatcacacattctcataatcttgagcctcaatgtctcaggtaaattcgccaatctgccgacaagaagttttgtattatgacttctcctcccacagtgcatgcattacaacttgactacgaaaatgaccttcgtcttaaccagaacagcaaaactgaatctatcggtttgaaaaaatgagagtgcaaacatgcggaggaggaagaggcaaaacaggtggataaaatgttgcactaagctacacacaatattagtgctagagtgctctgcaaaatgaaatcttaagaattagaaaatagtttatgaggaataaaatagtgatggcactagatgataacccaaataataaaataaatatccatgagtccacaccaaagtcaatcaatcaatcaataaaatatgtagatatttcctcccttcaaagataaagcttaattcttctccccttaggtgtgggctgacttccaaagaatagaatacagagagagaaaaagcagtaactttacaatggaaaaacctggcagagtctaccataaccaagtgatcaaagttaatattaccagtgataaggcatgttgatgtgacacaattcctaacataatgtgatgagatgggaacctcgcctggtggtattctgcccccaaaacccataagcccagactacaaaattcctggcccatactcttccaaaatgtcaattccatctgaaacaagtagactgtgccatggtactatcatattgtatcttgtgtcatattaaatatttttaaagtgagtagctaattaataccaaataaacttctcaggcaaaccaaaccattctttaaaacagttaacaaccactcaaatagaatagcctttttaagatagtaatattgtttagataggaatttttcttcttctcttttgatgctttcagaacacctcagtatgacatcttcaaatggtgtacacttcagttttttctttgctaaagacagtgtgtatatttccactatgactagcaacaatggtgcttgtattgattgttctggcagctatttaaataggcttgttctctccctatctcaatggcctcacaatgctgatactacaatgctcaggaacttctgagcaccctagccagatgccccttactgcttgtggacaggcattccccagcctcttggctgggtgacagcaaccacagcagcccacaagacgggtggagaaccaatgagtaaaatgataaacatttgtgatgaaacaggatgttggagacaggggggtgaggagacaaaatatctcaacgctgaactactaacgctactttggaactcctaacagtgttcccttgttgtaaaactaggagcagtaaaccgatatttttctctggtgttttctcctttattataattaatttcagaattactgctaaacaacacaccattacccaggcacagaacttaagactgagctaactgaaccacaagcactatacccccataaatattgtaaatgttcattggagacacttaaacaattatgtgaaaataaaatgttttctggacacagaacacaacattttcaatagttcagcccttgctgttgattgaatgtacactttaaaccaccatttcccttcttatctatgccagttagtaagcataaatttaagaaactctgaaataaacatagtacttcacttatacagtgtcctggacttggacttcactttgatggactctcagtatgtaagtaaatatctcttaagttgaaattctattgaaactattccctgatttctgtacttggagtacaatcattttgttttaattgctatgtattgaagaatccacaaaatattaatgttataactatgttataatactaatgcattatgcattcctgctcgaccccataaattaatgtaccagtaccatatatgcatatataccagtacaaaattgcagaaaaaaaatgactccggtggttcccattaattcacacactaattctgatatcaaggttaacaaaacaaaacaaaaaggtgaaatcaccactatggtggtgctctcttggactcctttttaaagagtgttatcaacaaggatgtcttcttagagtctacgatactcatttctctcatccatttcattcttgctttattgctaatgattgcaccaaaacaaagcaaatgattgcaccaaagcaaaaaaaaaaaaattccatcttagtagcaatttgatactttaaataaatctctgaaaaccttttccaccagaagtgtcctaacagtgacagatcattttgcactatatacacagagatggaacacagctatgcactgaggaatatggagggggcaggaagtgactgagatgcagcaagctcacttacctcagactaaacacaaaacttcatagcaatattaaacccaaatttccagtcatttttagacttaaaaacccaattcagcctgtctgaatttcaactcgtatttggcaagtacctccaaatgaaaaagtgggaaattacaaagatgaatttgaggacacacattctacttttgttccccacttgtcacacttatcctccccaaatattatttacccatctgttttatacatttacctttaaaaatcatttccggaaaaattagtaattaacattttgaaaacaatgctagagtaaaaaggttacagtgtcacatatactttcctttaacaatgtaaattacatagttccttgtaaagctgttgttcatgttgaacaacaggacctcaaacttgaaaaggcaaaattaagcctatgagaaaacacagtaggtgcagtatcagaggtgaatgtgacatttcattccaagcactattgcacacacacaactgataaatttcctaccagtacactcaagtctaaatcataattcaatatggatattagtccatactctttctgaatgaaaataaggcaacccaatgaaactgatgacatgatcaaaaaaagataaacagccctttttaccctttaaaagaacaaaggaacataagaatatttctattaatactgatattttaaagcataacaccataacctatattactcagcaagatcagtttattatccatttgttttcatttatcccgaagatcattcttagtctttctacttgtatcagttcaatttgttatcctcacactattattatcagttaagtaaccctgggtaaactgtggttttcatatctattgacctgggataacacaggctgatatgtcattagcataagcttgtcctaacaagtatgactcctctccttttaagatttgttaaaaccgacttaattatattttcttaactatcttgatgatttgggttgcccacttactttataatattttggatattacaatttatctttttaaactaagggaaaacaacctttcattcactttttaaatccttcctccattgtatgaaatattggaagacatattgaattcccatctctaaataagagttaagaaagatactgctcaaccatctaccaataaactattaccagataacttaggttattttaaaataattataagatcaattaaaccaatataaagaaaatcttgaaatgcactataaattccaaaagtgcatcctgtttacacaataagatctgagcctcagaaaaagaaaaccaacaaggcatgatttaggtaatcaatacgggggcccactaaaatgatttctgcaaacgaccggtgagttgagctcacatttaaaaatgtactattacttacattttaaaagcaagacactggaaagtagtgttacaaatgctcaaaagctcatggaaaaaaataatttccaaacatggagtgtttttcaagtgtttaataaatataagtatttttgtttttaaaacctgaggttaaatacaattcttaatttactagccagattcactgtactcagaaattcctgcatatagttttcatttactgtctaatttatcaatctataaatctacatttaatctgaaaaaattatatgacataatagaccctttaactattaatggttcaaactgttaattccccccaccatggtcatggttttagaatatacaagtccgtaagaatccaagccacttgacagtagaccaagaagcaacataaaaaatgataatcagtccgggcgtggtggctcacgcctataatcctagccctttgggaggccgaggcgggggcggaccactggaagtcaggagttcgagaccaacctggccaacgtggcaaaaccccatctctactaaaaacacaaaaattagctgggcgtggtggcacatgcctgtaatcccagctacttgggaggctgaggcaggagaactgctttaacccgggaggtggaggttgcagtaagctgagatggcaccattgcactccagcctagttgacagagtgagactctgtctcaaaaaaaaattaataataacaataatcagagaacaacactatctttatcactgtaatttttaaataactttgaaggcattcatgaaaaactaaccagaaacagataatctagattaggtaaagctaatatcatttaaatgtgcaaaataacaaaacgagaattaaatcacattgagaaatagtagaaccaagtagatataaggtaacaagaattaatatttaaaatatataaaaagctcatagaaacttacttttcaaaaaataactaagaaataaattagaaaagatatgccaagtcaatccagacaaagaaatgtaacaaataaagaaacctctttaattattattaaaatgcaaaccaaaacaacaatgcagtcaaaatttttactttggcacaatcatgataaaaatgggaagcaatttgaaaatgaggaccatgtatgataaaaaatattcattccctttgaaaaacaaccccaaaagaaaaaaaaatgaatattcagcaataaggggatttttagaaaattgtcaccattaaattagatcaaaaatatgcagccattaaaatcagaatatggtaatatgcaaaatgaaagtgtttataaaaatgattttgaaagtaaggattgtatcaatatcatgattataactatttcaagtgtatgaatgtgggcaaagatcaaagaatatacaaggaaaaattctaaaaatcaagttgatacattataaaagcctataagatagttatgcatcttttctttattggtgatataatattgcttttgtgataaattaaaaacttgacaaaaacaaataaattacagcaagctagtcagctccaaaattaaatctcccaaatgcatcaaccagtacctaccataaaacaatgactgttccacaggagagttcaccaatggccagatctctgtaaccaaagcaagacctacatcttacatgaaatgaaactgtgaatggtccgtagcatattcatactctttaagctattaatccatgcccaagtgcttaaaaagtttactatctagcatatgatgttggagattgttcatttctatccttgtgattgtactacatccattatttctatgggagttcagtatacactaccaaatcacattgtttgaatacaggcaattctcaacttacaaccacctgacgaaaaccaaaaataaaaccagctgctgctttccccgggttgtcgccttctagcactaccagtagtcttactgttacccctagagagtctcagctgttgtgaagaaatctaaaactttttagagaatttgggggaagaaagggtcaaagcaataaaacagtaccagatagtgaatatacacaaagcacacaaagccattgcttaccctgagtcgtactcagtaaaggtttgatgaatgaatgaataaatttccttttcacctctgtaatttgagccccactactttgcctctaccctactccagcagcctgttaacaagcctccttttggggctctcgattcatggagctggagctcaagaagggagtgaaaccccataaacaaacagctgtgatcaacaggctgtccactgggcaattcaacagagaggacctgcgctcaggaccaatccaaaaacgtctgttcttgtgacctcccctagagcatcggtatgatgtatactccaattgtactttgatggccttaaaggagcagaaccactttaaacatatctaaagtctaataacttttcgatttatttcaccccatgtatttctaactaatctttcatcttctgaaatttcaagccactccattactcaaaaatcttcctcagctctctcttaccaactgaattacagaaaatcaaagaaactcaaagtttgagaggtctgaaaggacttttagcacaacaacctaaagaacagggcaaaacaacttcactctttcattcaagttccatcacaacatggtccaggccttcctacttatgattctcagatcctaaccttgtatatttcccatctcctgactttcactcatgccaccatttatatcatactctatttgaatggtgccctcacgattttacaaaatccaactcttgggcagccatatgtggtgttcctactttcacttgtaacatatgtccatcttccaacccatcgctgcttctaaagatgttaaccaatcctcaaggtccacattttccagaaaaacctttcctggttcatgcaattggtctttttctctgaactttcatttcatctggtttatgcctgttttttgcatattctgtcttttccagtaaaatgagttagtcatgcttgccattaacaatattagattgcattctctctgagaacatgatgtagggttcacatttatttctatatagtttctagcccattgccaaaatcagaacaggtactcaaataattgttggctgggacctttgattggtaagaaaatacagatgactttggaactagaaaaatttaaaggagtgatttagactggaatggactatagcaatcaaagaccaagaactaaatttggataacttggtgccttcaggttgactgggttgagaagggtgctaagtggtaggatgtcactgtcaaaaacatacttttccctatttcaaaattttgccttagaccaaatatgtacctatggaaaaagacttcctctcatcttttcctccactctgtaagataccacctctcaaaaaaaaaaaaaaaaaaaaaaattctgaattctacacaacgaattaaaaacacagttttgaaacaaagtacaaaggaaccaagcataatttaacctgttttgtagaatatcaaaaataactttccttttttaattaacaatagtctattaaagggcagattttagggatacaaatctgaaacacttgaagagcaggtgtatcattttagaggtatctaaacgttattgtctctactatatggagcctgtgtgtctgcctaacacataacatgcattttcttaattagaatgcatgctgaaatacctattttaataaatatatcatgacccaaggaaatcattatgatctattaaagaacaattaactataaaagcattagctatacagaaagagatagcttcaaattggtatacacagatttctactatctatagacaaaaatctatctgaacatttttcaagaccttaaaagatgctgtgtttacatagcaatggtatagtatacattggcagatgattcaaaatattttagtatatatctacatatatgagtatttataatctgaaaattaaatcccatgattttaagacaatttaaatataaactaggcaggggagagtgcagcagtgttagagaggaggtcactgaggaatgaatgaatatatattaagcatgtttaataaggctttatacaccaacattttttgagattacatatatctaaaatgcaaaaaaaccaactgcctctgtttttaatcagaaatatctcagggtcattatcataaacatagatcaccatagcaaacctactcatttatttatttccatttactaggaaaatacttagggagcctcttctatgagtcaagtacaacattaagtcctggagataacagtatcatatggggcaggcatggtctcagccctagtagaacttagattctgagtagaaagatcaaaaaatagctactgtaaattgggggaaacacagtaacagcttctgaagctactgagatgcttacatttgcttacccctgcactcttgtttcctccagtggcctatattttgatctttaagatcttgcttctgatttttatagtttatctatttccttcttcactttcaggctgtcagtgattacatttgcagtcaacatgccatcctttaccagtgacaatgtttgacttccatatactgctcctaatctctagccaatcagatcatcaagcctattaaaactaagcctaaaataaggacaaacaagctctgagtgaaggctgaataggtattttctaccattgcagtttgataaaatcatttcatgcattatccgtttctttctgatgagatatttctattacccaactgaccatgccacccatttaagaagataatttaaagaaatgttttaccaacaaaatttcccactcttctctcattctcttctaaaataaacaaaacaggccaggcatggtggcttgcgcctgtaatcccagcactttgggaggctgaggcaggcagatcacgaggtcaagagattgagaccatcctggccaacatggtgaaaccccatctctactaaaaaacacaaaaattagctgggtgtggtggcgcatgcctgtagtcccagctatatgagaggctgaggcaggagaattgtttgaacccggcaggcagaggttgcagtgagccaagattgtgccactgcaatccagcctggtgacacagcgagactacgtctcaaaaaataaaaataaagataaacaaaacaaaacaacaacaacaacaacaaacctacacttctgcttagaagcaagatccctactgccagaaaagtcttctttaagtacagtccatagaaatggtatcttaatatataaaccactgtttctcaaagagtagttctcagatcaccggcagcagaattacctaatttacctcttaacattaaggttccctgtgcctcacctcagacctagtgaatcacatgcgtagagcatgggggcctgaattttttaacgctccttgaaagaccatcgtgcatgatacagcttgaatccactgatctaaataaccaaagagtacacattgaaaatgtcagtctgagccctaaagactcaagtcctctattttactaccagtctgcaaaatttaatgaatgccaccctctgcaatgcactggataaaattaagtttaaaaagttcaagacaataaagtttaaaggtcacctctacccagagagtttccactttaatatggaagacaaagcacaaacacattaaaaaaaaaaaaaaaaaaaaacttaaaaataagcacaaacaacatttcaggggagcccagtgaatagaggacaaacgtgctgagaggggcagagcctaggactgaacagaatacagttgggattcagaaaggaagaattctaaaacaagtttggggcagaatttaaacatagcaattttcaagtgggtctctaaaaaggtgtgatgattgccatagggcatttaagatcaaggagaaaatatgtataatcatatctcttggtaccatagtcaacacagaaagagaagtgtcctgcaggcttattaaaaagatgagatattggtttgggaaaacctccctgaaaagaaggttttataaacatatattatcttttgaggcagacagaggaggtattgttatccccagatttacagacgaggagactaagaatcatctgagacccttttttgcagggttcttattataggacaaagctggtcctttccttccatcagggactctttgctcagcctgacactgctcccaggagaaggatcattaattcactgtctcagaaatgagacaacaagccattcaaaaacatatttctccctctgtccagttcaagaaacaatcaggggaaatgtgtgtgagtgtttgtgtgtctgtgatgcgtatgtgtgcatgatatgtgtgcatgcatgtagatctatgcatgagtgtgtgtgtcgagggtatcactgactaatttaactgaccgctcatcatttcataattaatgagttactgtattttagtgtctaatggatgtttcagtgctagtacttatggctaatgatactgaaaagcaaaagccaatcaaagtctctgactttgtgatttgatttgtgatcaagataattatctgaaatctccatactgggttagtgacagcaggtttcctctggctgtgctatccagtatggtaggcactagccatatgtggctgcttaggtttaaatataaaattagcattaaataaaatttaaaaattagttcctcagctgcacggccacatttcaagtaccccaaagccacttgtgtttagtggctaccatattggccaatgcagttcaattggagagcactgctccagagtgtcagtctttctgaaaagacaacttcaggcctcagtgtatacaaccattgttatttacatctagttccaaacacatgctaataacagtgatcgaacttttgtccctcccactaaggcttctcaagcccctctagtagaattcatatatttctcctcagaaatcccttcccccttctcctcatcacacctctcttctcgtggctgttttcatcctggcttgatagctacgtgcacatccatctcctctacagtcagcttctcaaggccagtgggtcatgttcagttaccagtaatggtccatggccttttaggaaccgcgtcgcacagcaccaggtgagtggtgggcaagcgagcattactgcctgagctccacctcctatcagagcagcggtagcattagattctcataggagcgtgaaaccgactgtgaaccgcgcatgcgagggatctaggttgcatgctccttatgacaatctaatgtctgatgatctgaggtggaactgtttcatccggaaaccatccaccatccccacaccatggaaaaattctcctccatgaaactggttcctggtgccaaaaaggttggagactgtgagtttaaagaatggtaaggttttgtgatcattcctacgaggtagatgcttaggtggaattattgcttgtgctgcacatttataaggagaagaaaaaatcaaatgattttagaagtgggtatgaaaatgtacttagcagacataaatcagaaaagcactgggctgtattggaggtattgttatccccaatttacagacgaggagactaagactgtcatcagccagcacacagaggatggccccttaccacagcagggagacaaaaccaggactcatggtgacctatgggaaccgaactgcttagcttaggatgagcttgtcaaaaagttgtatcaattcatttcttactcatgctgttacaacatcttcaaaaactcaagccttgggatgctaatgagaacttctactttcactctgacgacttctgaaacacgaaaaacgtacatttccttcatgctatcatttggatagtttcaaagtacctgaagtatgaacaatatctgattttttcaataaaccagtttgagggggaaaacccatggatcagggcacactggctgtccccatgaagacagaaaatactaaaaaggattgaagagttatcacactggtacttcactgctcactgctttcttttgccagcttcaatgccatacttaactaagtatctaattgccatacttaactaagtttctaggcactttcccacaagccttggaagaaagaggtgtctacagggccaccatagaccagaggaaaggtaaaacacgggaaatgaaaccaagtaacgtggtgagagcacaactgatgacaatcacagagagcacagtcgactgcagggggtgctgaatgtggccttcagaggaagtgaaacttagaacagggccaaagatgcatcactttccacaagaaaagtcacccactcttgccccatcctcacctccacgccatctcgtggctcaccattgtggcatttcttcatcgtcaacattccagattgataaaaagtagtaaattaaagactggcccagcaaagtccctgatcagccggatcaccagcagcaagttgcacgtttgcacgtgtctctcccaccacagtgtaccgcaaaactcagtcaggttagagccctgaaatattatcaggctctcagtatatgaaaaaaaaaaaagtgcctgagatgtgcttggagattgcagtcatagtactggggatgggctctggcagcagccccttgaagcagaacctgagctaacactgcgtatccgtaggtaaccgtgggcaagcaactgacccttcttggtgcccccattttctcacatgtcagccacagttatcatgtgccatcaaatttaagtggtctaccaattctaagacataagcttttttttcatattttaacatttttgaaatcagaatgtgtcttactatggatggcatctttcaaaaaaaattggaatctttgttttcctttcttagaggtacatcaaatgccatcttacaaccgatgataccttagagtctatgaaatttggagcctactttataaagtatcgataaagattaaattagttaatttaggtcaagtatttagaatagcggttggtcttgagtaagctgctcagtaattattagtcactattaaatttatgactctgaaaatgggcagagtcataacagacaatcaacacatttttactcataaactgtgtgttaaaatgatggctgatgcagaagtgttgcagggagaggttaaatgactattcaaaacctgatgtatccccagcccttggtgcatagtagttggtacataataaataattgttaactaaatcaattgaatgcacaacccagccttactcatgccaaaagtctcttcatcaaacataaatatctaatattctttccatacaaagggaaaccagcaagaacatggttcttttatgctaagtgacaaagagcagattcctactttttgaaggctttgaatatttttccagatgaagacttcatgcaggttttcttctccggtaatgccctttctacctcaactttccacaaatttaaatcctgagccccttcttttaaggcccaattcaaatttcatctcctctaagaactgtttttccccactatttctcccccatttaatcttctttctattcctactccttacatttacctcagctaccattaaacacttaatttgaacctcactggacacaataatattaaaatattgtgtaagaatgggaactgggtcatgattgtcactgcttcccctggagagccttacgcaagagggaaatctgcttgaatcctcttgttatgtgtggaattgtggccccccaaaaagaaacattgaagttctaacttccatacctcagaatgcagccttgtttggaaataaggtccttgcagatgtaattagttaggatgacatcacactgtagtagggtgggccccttatccaacatgacagaaatggcgaacactacatgaagactgaggcagagactacagtaatgaggagcccaggaacaactaggattgcaaaccatggccagaggctgggagagaggcacagaacagatttcccctcacagccctcagaagagctaaccctgctgacaccttggcttcacacttgcagcctccagaactgtgagacaatagatgtcttttgttttcagccacccagcatgtgggactttatcacagcagccctggcaaaatctctattgcacctctcctcacatagatgctatgacactggactctcttttattatggacctctagccagcctttcttaatcttggtggcatcactcccttgaatcaggcctgtaaaagttagggtttctccagagttagccccacactctcttttcgtctctgttctctttacaccctctcatccactacaactcagacaccatctatacattaaggacacccacttccatctccagaccaccccttcctccagactcctatgatcaactgactacttggcatctccatttagataattcaaagccgctttaaactcaacaaatccaaaaacaaaagtcaccactttcttaaacctggctttccccttagtgagccccatcccaataaattgtgcctctgcccattcaggcatgcagaccacacacttaggactcattctaggctacgtcctctccttcactctctacaggtactatcaagccctatctatttctcctcctggaaatctctcaaatctcaccaatctttctctggtctccacctctacctctttaattcactgtagtggattagtctagtgtagtcatctactccctggtttactgcagtaatctcttgactagttctagatccaatcttgccaccctccaatttgttcaccatgcaaagctcaactacatagtccaagtaaatttcaaaatgcaaatctaatcctttcatccccatgtctgaacaacttctatgggtttccattcaagttgggatgaagaccaaaatcctaaactgagtttataagaccctgtgtggaccaagccctgtgcagctcccttgttcttggtgctccagccacagcagtgttcctttacgcctttgattagaaccatgatcccactgatcacaggtcctgtgccctagctgttccctccacctggagaatccaccaaccccttcacttatttaatgctccccattagtcaatttgggctcaagacatccgtttctcagaaaaatctttccctgacttcatcaaagagatgaagctctcctgttctcctctctcctggcaccttaaaagcataatttataattataagagtaggaaagaagttatcaactaatttataattctacagctgtatgattgtcagattaatatggattagggtcctccaatgaggactgaaactctttgttcctgctgtatccccagctctcagatcagcatccagcacctaacagctactcaataagtatttgttaaataatcaacagtaagcaaatatcctttacatattgaaagaaactactgttttaattgtataccatattatgatggaaattatttctctagaaagatacatacagtatttaattttcctaaggcttctactgtagcataatggacatactataaatgtgacaggctggtttactgtatgttaactatattttaaatgcacttcttctaatattgtactgttaataattatgctgccataagcaattattaacttatgtcactcatccaaaatttcaaaggtgattagttgataacttctttgctactcttattccaatagtccaaaaacaagtaaataaaattttactaacagtttcgtatgtgatgtactgttggttttatcactaattctctcttctccaggatcatcaacctacttgatatgaaaaacagaatacatgaataatgaaaacaaaggttatatcactccaaccctattaaacaattttcctcaaaattttctgagtgcagatcttggtacagctctgcatagggacagtgacagccaccgcagcagaagcaacaggtatgaatgacatccacgtgacactacatgcgctgcaagtggcaacaattctgagtgcatgtggattccaaataacaaattttattctcattaacagtgatgataaaaaatataacacatatttctaaatgatgggaaaacattagtatttcctaacttatttcattaaataagaatcttataaacaacttccaatcacacatgtactcaactaccaccaaccttgatacagaggagtccaaagtaaagacagcaaagctaatccatatcccaaataatcatatctgagtattagacacagaaattctgctcttatcagataaagaaagtagcttcacacaccttctcaaaatcataatatgcttctgtaattttttttttttgagatagagtcttgctctgttgcccaggctacagcgcagtggagcaaccttggctcactgcaagctccgcctcctgggttcaagcagttctcctgcttcagcctctcgagtagctgggattacaggcatgcaccaccacgcctggctgatttttgcatttttagtagacaggttttgccatgttggccaggctggtttcaaacttctgacctcaagcaatccacccaccttggcctcccaaagtgctgggattatagacgtgagccatcatgcccggagcgtctgtaattttaacaagaacaatgtgagccatgaaatgaaactacaacagtctctctacttcagtctcaatacctttttccttaaaccctttcctctttgcctccctatttatttttccctatttattttatttacttttatttatttatcaatagagaccgggtttcgccattttggccaggctggtctcaaagtcctgacctcaggtgatccgcctgcctcggcctcccaaagtgctgagattaaaggcctgagccatcgctcacagccctatttatttttttctattaaacgaactcaagagttaaaattacaacagcacccagagagttgccacgaatgtggatgcggcattcttctagctgcatcctcctgggtcttccaccctaaagctttaacagaccgcgtgcctcctaacgacagcatctggatgttctgccctggctttgcgacgctgcaggcctgtggctgtttcagaattgtctccccaagattcatgcccatgagatcatgccaagctgacctcttcagaacgtgataccctgaagcacagctgtaaaaatagagcactccataacaacttcttattcaccaataaaaaacataatgttctttcacttttagggaattaacatgttcatgtaattttttgaagacaaggtgaaataaatgaagaaaagagccttaagttatataaatgtattttctcatgacaaaacaatgtaaaaacaaacacaggttccagtaatttagaaaaagtgatgtcataaaagccatgtaaccaagtctgaagtctcaaatcattcccactataattttttaaatattaacacctgtagttaacacattcatgtttctttataatacataattccctacctattattttacttttaagtcatgcaatttagattgttttattcttaaaatacattcctctgctttgatttttatgtctttattaacttcaagttacccatctgtccatttctctaccaaatttaatgacattttcatttactcacactggctttcttaattccagtatattttcagtgtgttcttattttacagttacaaaaacacaagcagaaagaagcctcaaaaattatacagacctttgaggcaagtcacctcaactttcttttttaatgaaacagattgaaatgaaagtaaaattagaaaacaatactgttaaatgccctttatgtgaaatatacaaaatattctctgctctcttcctgatagttgttttcttcgccagtttcagagctttatagtttaatattgactcataattgtgctttaaaaattaaaaagcaaatcctattatattcttattggataggtaaggaatgtattttaccagctgcagctcacatcaggaaccgtctataaatgtcttctatgcaaatctagatccacagtaacaggctcaaatgcaagccatttttttcagaatcacatttcttttaaggaaacacatgtcacaatgcagtttataatatgggtaagtttatcattattctactcaaagacccacttttataattattctcttacttgccttctacaaataaagtccatgttcaaacctattaagctttgggaaataagatgtaatatacattatctatgcaaaaataataaaatggcattttaaaatactgataagtttattgagttaaaaattgataccctgacatggatcttactctgttcctttcacatttagtgtgctattctctagtaatgttaataagttgtaaataaatgtaagcaaactctacattggtcactgatgtgaaagagcaaagaattagtcctcaaaggaggcagaaatgttaacctattcaaaggatgtaacaacagaagttgaaaaacactttgttctgtataaaaacagagcttcctaagtatatttttatgtcattagacataaactctttaaaagtatttctacagtaggaaagttggttctatcaaatttaattattctgttcactgtaaagacacaatagttggatctttctataagcctaacaaacatttcctctaccactcattttatctccaaaggtaagaattacagtcccattttgtgtaactgctacatgaggtcacagagttatagctaaaaagaaagtcacaaatgtaaggataatatcccttctatcatattctgctacttatttgtcactcaattatctttgtatctccgaagtcctggcttccaaaggttcggcatgcagagctgaccttggtctagtcctccgtcacatgtgagtggctcacggcttcactttgagccctacccatggtgtccactcttgtactatccagatcacaggtatgtattaaagacctcctctctgacaaccaagaccccatgattcttattggatagcaggagggagaactcatttggaaattccctaatttccaggaaatcaattcctgaatacatcctgtgcttcaagaatttagaaactgggttatcacataggtaacagaagaataaacttctctgaagaaaataaaagggatgaggtacctaccaccaacaaggagataaaaaattttatactcagattgactagtctggattaaaaatttattaatccagctgggcatggtagctcacgcctgtaatcctagcactttgggaagctgaggcaggaggatcacttgagcccaggagttccagatcagcctaagcaacatagggagaacccatttctacaaaaaatttaaaaaattagctgggaatcggagcacatgcctgtagtcccagctacttgggagactgaggtaggaggatcctgtgagcccaggaggtagaggctgtagtgagctattatcatgccactgcaatccacagtgagtgacagagggagatcctgtctcaatatacatatataaatccatctcttttccccaatttattcattcattcacccattcattcagcaaaagtatacagagctacagtaaggaagcaggtcatgaaaaaggaaagtctgggatttgaattaggactgccggagcttaaatgcaagctccaaaacatactagcagtgtgacaagatatttaacttctctgcccttccaatgttttcatctataaaataagaagacaaacagccctgcctcaaaaaaataaaaagtttaaaatatgaggataggctgcgcaaggtggctcatgcctgcaatcccagcactttgggaggcaggcagattgcttgaggccaggagttcgagaccagcctggccaacatggcgaaacctgtctctattaaatatacaaaaattagccaggcgtggtggcacacgcccgtaatcccagctactggggaggctgaggcacgagaatcgcttgaacccaggaggcagaggttgcagtgagccgagattgtgccactgcactccagccttggtcatacaatgagactcttcctcaaaagaaaagaggataacacatgtaaaaggcctagaaaagtgtctgatgttcagttttttttaattatcattatgaactaaaaatcccatcagattctgaagttacagtgataaaataaggctctattgccctatccctactgaggattacaatctaagtcaggccatgtattaatctcaaaccagtagttaatcctaatctgaaataactagggagaaaaaggattgtcaaacttcttttggaaatctaggacttaatcctcctttagtcagaaactttgggatctaatttaaatgccttctccacacttccaaaaaatcaaagcttaaatagtcaatcaccctaaatagcaaatgacagatcaaactacatgctggcaatttcctaattattaatcacttttcagttcttatcttactttaactctccatagcatatggtattgatgcttaaagtctctttggggaaactcaacttcgttggcgtctaagacgtgaccctttcttcatttccctcctctctgtctagtccacatcctcaggatctggcctcatcttacatctctatcccatttttcacaatctcccacttgtcctttaaacttcagccatactaagctctttaaaattccccaaactcgctatgcattctcaaactctcaccaagctgctctcagtgtctattgatccttccaaaggcagctgagggaatgttccatttcacctcttctgcaaggagggtttagggctccctccaggcccttcttttcaccctctgcttccccctacttttgcccttattccaatatcctaattcttgaattgcaagtcagttccttcacttgactatgatgtctttggggatagcaacacaagctctcaattcgcatttaataaatataaataaccacataagtatacttctaaaattttaaaatagtaagatccagagtggcctgaacttcatttattgagtgcttactacaggccaggttctttacatatattagtacacttaagcctcataaggtctgttttaagaggtatcctggttttacaggtgagcaaactggaggctaaggggataaacgtaacttgccaaaagtcatacaactagaaagtaactgagacagtactcaaacccaggcaggccagctctgaaacccacagttctggtcccactctatactgactgcctcttttccagtcgtaagtctgattaagcaacagaactggctctcaataagaattatgacatgtacatccctagagagcctcaaaaacagatttttttaaaagactgtcttgtcccctcctattattttgcaggtatgagcatgtaaatacatagtatttatatgaacatgtattcatgtaaacacatagtactctccagaaaacaaacatgttttaatataaatcctgcccaacatctaacaaactattatcaataaatcagtaattagtaaataattataccactaataagagataaatatttcatagttaaatatttaggccaggcgcggtggctcatgcctggtaatcccagcactttgggaggccaaggcgggtggatcacgaggtcaggagttcaagaccagcctggccaagatggtgaaactctgtctctactaaaaatacaaaaattagccaggcatggtgtgggagcctgtaatcccagctactcgggaggctgaggtagggaattgcttgaatccgggaggcggaggttgcagtgagctgagatcgtgccactgtactccagcctgggcaacagagcaagactccgtctcaaaaaaaaaaaaatcatagttaaatatttaatagtgaacaataagataagcatgaaccaaaatataacagatgacatttaaaaataagatagttaatgctacctattacatttcccatgatgttagctacagtctcctatgttccaaccaagaggatatattgaacactttggagaagattttctttttcaaaaccattcatatttgattccaaataatattccaattcagctgatatattggatggatcccaaacacaccatctgttttttattcagttgtaccttagcaaggcagagaaatgaagaccccttgctcaaaaattaatttcaagacagtgacagcagatcatttaaccaaactcagggcccttctgagcttggagccctgtacaaatgcacaggtcacatgcccacaaagccagccctgtggagcccctagattctatgtcaggcacagtaccaggcaggaggtacagcaacggcttttaatccataatcccgatgtccagaaaggctcaaatgtagcatcaaagatcctgttaggcaataaataatcaaatatgaaataggtttaagaactcaaagaatctttggatctcaaaccgctaggtaaaggccgagggttaagtgctagttaaaatgattcaaattcaagtgggcctctcttcagctttgctaaatgtcttcttttataaatcaataggtcaatgagctttttaaaaaatgactctcattagatgcaaaaggaggactgcagatgattagaatagtaaataaagcaccaggattgcagtatcatgtttctttcagtggttttttaatttaataaatgtttattgtgcatctgctatatgtttacatttcattaaaaatcaaataatatctcacttttttaaacctcttaccaaaaagagaattctaaaattatgaccgaagactacaaaatagcatctgaaatatgagagatagcagtatcatctttatttcctcattcagcacccgtgctctgagcaactactccgggtcaggcaccgttctaggcattaggcattcagagaggaaaagacaaactctgcctttatttatgtagttcattggaaaaggcatacagtagacaaccaattctttcaaaaaatactgtttaagatatttcaaattgtaattccaagatacaatggaagattgcatttattctaggattttcctccaagaaacataaacttctcagttaagaggaaaaacatcttctcctactgaccctaaacagaactatagttttggtcactgcaaaggcacaaaatttttctgcagtacaaaaggtggaatatatgcccaaaagtagatatatttgtaattcatgtgttaatcaaatcacatatgcttagactataattacagacaaggtactgggtttggattaatgttataaaaattcagaatctatgcagtccataaggacttttcacactccatttttcataaaatagtatgttaatctcctggtgattatgagattcaactaataagtctaaggatcctacttagcacctccaacatgatgctgcatcaaaactggggattattgttcatacaaatctggagtaactggtccctataatactactactaaatactttcatagtacctttgcggccacatcttttgaggccacatagttgggtcctctgccttctgtctatttactctctctgttttaaatcttatagagagtaaacagatagaatgcaggagacccaatatgtggcctcaaaggatgaaactaacatgcactttagaagttctccttgttctaccacacaaacgttccatacaattttattgtgaaggaaaaaagggaatgagaatcaatatttttagaaagtaatcttgcattaacatagtgctttctagttttatgaaactttgtcactcacataaccttgtttgtccccaaattgtttaactgtaagagtgtactataatggattctgctctcctaacataataccaaggagccacaaccttccctctattcttaatctccaattttattttcttaagtgggccactaagtatatctgtaccaacatttttgtgcatttcataacccataactttgccaccataacaacttgaactaagctcagataggaaataggatcgttgtgttatattttgtcaaggaaaaagggaaaagctaccccaaaaagacaaatttcaaaaatctaaagctattattccagatgtactcaaataaccttaaatttccttattgcataagtaagctgaaagtttcccaagaaaaatgacatcgtactatatgcacatctcataatcctatggggacttcttttaaatgagaacatttaggcaacactactgaaagcatacataagtcagcggttagcttcatgactcagtttaacttaaacatgtaaacatagtgtatgttccaatttggaatgatttttgaggtttactagaaactactaaataatattttcatttagtaagtcctttctctgtcaactctttgatgtaagaaaccttagcagacctcccagtgaactttagcattttggctgtgtgtccaaaagaacaatctaccattacaaagcctattcatgagtcaaccagggacgtaatcacaatcacgactgctcagctgatacgactcttctttatcatacctgcaagtatggaagacacgtaagattcaagttactaaattatagattattagtactaaacatcgattcttaaatatagttctaaagatgattcatgcaaatttaaactttttttaaatttaacagcttgggttaacttgcttgtgttcaactttttacgtctacctctagcaaaataatattattataaaaacagtaaaagtccatctaataatttcagtataataaatccagggctttgacactgtcttcaaattcacaagatcattagtattcttttaaaccaaattaatcatattccctaaataacaacagctaaaatcatgaacactgagatcattttcttgtaatgattctgtctggaagtgtattaacggcatgatgtttgtgctttgcactaaacattcatatctttgtttccacaacaaagtaaaaaggtggcagttagagggagagttaaacaaggtttcctgtgagggctttgtgaaaagaaagagcgtatattctatccgggcaatgacaaacggactcaggcctcctgaggtcagcgctcctgggcaccatcaggccccacttcgggagcccccggtgctccgggcccacctgactgggcgtcctctgagtcagggaggtgccagtgctgtggtccccgcgagcccaactgtcccctgacccccgggcttttccgcaccgtggagtcccccgacacgctggggccagtgaacccgggccggggcgcgcgttctccctcccggaccagctcccggcgctgggcccgcggccgagaaactaggtctgggccggccctgcggcggccgccgggcgcggcgagccccactttctcccggcaggaaggggggaggccgagagcatttcctgttgtgcagctgagccctgcggagacgtcattgcattcatgctccctcgggtgtcagcggacggggggccaaagttcaagccgcgtccagggcaggcagcgcgcggcggcgcggcggcgcggggcgggcggccagggctcccctctcccgctggcgctcccggcgcctccgtccccggccggcccagcgctgctaccggaggccagccctggggctccgcggggaagagctgctcttcctcccggaggaaaccgagctcgcaagcccagcgctcccagccgcagactgcaggctgccctcctccaccgcctggatttcccacggggaggaaaaggcgtgcgtttccaggtgtttggaggacgcactggccgggcgcactttcctcagcgtaattttgaacgcagtttccctaaagatgactcttttttccactaggattatttccaagtcatcaaaagtgaaaaatcacgtaagtgttgttgcagttgttttcccctcgttttctatctcctttccaattgtgaattccgtaaataactgtcagacataaaacaggaaaaggaacatttcttcactgcagagctccagtaaggtgaaagtaggcaagaaggccccctgagacgtttctaaaagcatattctatatgttttcattatgaaaacacccactgcactccttttatttattaggaccttaagttatcctatctcaactaatacttttaacaatcagaatctcttaagaatctttcaatcttatacttatccactttaatagccaacaaaacctttagccagagtgttttaaaatggaaattacctgttcatgtttcttaaagatttttaaagtctccttctaaatttccagccttccatttagtttcaagccataaaccagattataacaatgtgtaattgtagagaagctgtggcttacggttaataacgattaaaaataaggccataaggtattttatgatcattttgaaataaaaaattgaaatagtttaatttcagcttgtgcagtttgagacagatcgtcaactacaaaacaaattgtagattctgttctcatggtgaacaaacattacagatgttttactgtgtcaacatctctaacatttgaactaagcaatgtttcacatcaggacatgaattaaaacaatgtaaactatggacctggggtgaccatgatgtgtcgatgtaggttcttggattataacaaatgtaccactctagcgcaagacttcgatagtggaggaggctgtgtgtatgtggggacaggaagtacatgggaaatctctgtaccttccgctggattttgctgagaagctaaaactaccctaaaaatataaactctatttttaaacatatgtttagggttttatgagtatcctgatacttaaaatgtgcattgcattgtaacctatgaattgacaagaaattaatcttaagaattggcacagaaatcatctcgatgttttcatgaagttcatcctcggttctactgcttcttgataaacaagtttcatgtttagaaggttactgaaatttttttatatggtaaaggcacatcaaagactttaccatttaatatatattagttgtcctatccagtcatgtactatttaaggcaatattaaaggtaacttagatttccccacttacagtgatgcaaagcccttcaataatattctgttgtcttatttcctaaacatctgaataatacaactttatcacatgatatcttaaatttgcatagtatattagagtttgctatttgcttcacatatatatatttctatcccgattttttcaagaaataggctcagagaactgaaatctccactcagttcaggactagcatagctagtctttcaatcttgctgaaaagcaatcgcaaactcttctcattttcaaactccttattcctaactgcaaccacttctttacttcccagtggccagtgcccctgagtgtgagtgctgagaggggcctgcaaaaaatctaatcacatccaactgctttatttacttggcttcccaaactgtatcaaatgattcttgactgtaaatgtgattccactgtatccaatcctaggaaatactgtagtggatatctgtttcctgaatgatcttacaccaactttttttggggtgtcttttctccttcatatcaattgttcttttatccattaaatctctgcagcaattcttgtgtttttgatttgaacatacttatacttgttccttcaaatcatctgccaatggtatacaattagcactccccaagctgcatgtgactccccaaatactgcctaagctcagtgaagattttattcaaaattcatgctctctggtctatacctagttgctgatgatggcacttggaaaggacaaagagggaagacttaaaaatgttttattttataatcctgattacaggctaaataaaatcagtattaccataaatttagtatagactgaggatataaagatcagtatgagaacggtaagataaattaacttatgaataaatacacaattgaaaatataaaccagaacaaaaaaaaaggagttcttcaggttcctggtgctattttcaaatgcacctcttttacaccatgaaagagaagaaataactgtgaggataaaaggaagttttgcaggataatgtattttacactttctctttagaaaaaaattaaagtgctccacttttgttacttaaagtacatcatgaagtgcgcaattccaacctaagaagatatattatttcatacaatgaaaaggattaagacttgaagtttcccaaactaaccattttaaaactcattgtttcattcaggattggtttcatttaaatgtgtagttagaatatgagagaaacagtaagttgttaccataatgtttggctctccatgcttctgagatccaagttctctaactcaagagtctccacattttcatagactttgaaaagtctttgatatggccagactgtatctgacaggctgacttgtttcacaaactggcctcctctctaaaaatattcagaagggcatactaaattttcactcttctctaacaataatcaaattgagtaatatccttctcaaatgagctttcaccagtcatttgttgtttttccagaaaactgactcccaagatatgtgatgacaaaatcaagactctcttctttctgaggtccacatcctatttccatgacacactaaacgactgtgttgttcctctacagccagtactttcccaaatcaaagcccagctcaaattaaatagctgaaatgaaaggaagggagctcactgagtgaacagatatatataggaatgaagagagaagtgaatcatgcacacatactcatgaacatataagaatgaatgaaccattcatgaaaaacctacctacctacttgcttgcttcacaatctttggttcctatagaacccttttctactgtggtatctccaagctcagtggctttatttttcttacaaactacccataaaactataaccttctctttattaagtggccttcagcacaaattactaatgcctcaatcccttcaaggctagctaactaaacaaagtacagcccctgtaactgagacagtcccaagacctgcaggtggttccaggactattcattcacttctctggacaataacaagatgtatcatcacctcgtacctttcgggctgtaggtaaaagtcaatatattctcagatggaaatatatttacatagtactcaagtgtttgagagcacatctccttgttcagcctccatctatattaaatacttcagaataggccctcaatgaaatctaagtaatagttaagtactcagatggcctataatcaagcatgttattgaaacagcagtgtccccacatgaattcaagtaaaacaaaattattttttattacaatatagtattttcctattctctcctagtcactcacaaagtcctctgtacttctccagaaccaaaagtgtgactagagctaaatctaaaatgtatttatttccataatgattaaaagaaaagttccaaaatcaaagtacccactcaggaaacaataacttctattttggcaacagataattattaaatctcaactctcttctaatatatcacttctgcatataggtctacttgttctatcaaatatgtgaccatttaaatattccttctttactattcattatgtggaataagtcatctgtgcaggaaaattaagagagttttctcataggcactaaaggcagtctagagctcaagtaggaatttttttaattgttattaagatgcaacaaaactttattgtatgcgtttaaactacttgtaagactgctatctatatagtgccttacagtatgctatatagatagcagtcttacaagtagtttaaatgcatacaagtacttccaaatattctgtatccccatttttaatcaacagaaaaatataaattgacgaaaaggttaatttatactaaaatgacaatcatttgagctcagcctagtatcagtatggcatgtcatttatattgccaaaaagtaggaggtagaaaaggtatgtgtaactggcacaggtgtgaatataacaatacatccatcagcaatacacttactttagcttcatgattaaagtcactatccttgagattgctggctttctaggacacagacagtatataaaaataatatgccaattcaaagcaaacatgtcttctatgcaaaatacatatactccttgctacttataaatgcagttgaattttctgcatagaaattttcacatacttatcttttatctgttcgtttcatttcattaaattgtgtatgtagttacagaactgttcaattcagggaccaaattctcaatggggtaaattacatctaccattatctatcgttttaagtccaaaccccttaagctggaatatgagtccttagaccatatatccctatcttcctaactttctcaccaacatttacttaatacatattttatgcttccctcaaatgaaatgcttctctgaaaatactcttgacactttcccatattggtgtgtgtgcccaggtaaagcatttccttttgctatctcctgagtcctcggccagggttgatgttgcgccttctcagtacttcacgtgtgcctctctcatggtacttaacctgcttcttttaattaccgcttcacttacatcattcttttcctcagtatggtagattataaagtcctgatgatgagaatagtgactcttctttatattttatgttctacttacatttatattctatctatatttatactctacttcatattcccatatatcttgcacataccagaatctcaagaattatatttgttaaaatcaatttgcattacattattatacattccaactctgttctagttatactacataaaaagtctcagcaagcatggctagtccttttctgtaaaacgtttctaagccagttggtaagaggctgtcttctggaaagtaaatggtaataagcaatttatttttgaggagttattaaaaaaaactcagcctggagtaaatttcagacatgaacaatctgatccctgggaaattaataaaataaaaatgaaaacaacatcctatgaggtctagttgaaagaactgggaatatttagcctggagaaaagaatacttaaggtgaacaagattgctatctttaaataattgtaggattgtcatgcaagacaatgagtaaacttgttctagatagctggagagggctcaactgctggtaactagaaatgtccaagaacggaataggcctccctaagaaataaaaaggtgtttaagtagaatctgaatgcaagcagtccttggtaatttgtcctaagtgatttcttgctcagttagagattaaatgatgcctccaatagttttatctaatcctgaaattctgtaagaaactttacattgcagagtgtcctgtcaccagttgacaaaccaaaactgaaacatcagatcctacacctaagaaaattaatcagcatatttaaactagacactttaagagatgccctaaataaggcatcattgcagtaacacaaattgtatcacaatgaaaggaagaagtaaaatttctcacaaaaagctcaactgggaccgatgatgcagcctgctcaaaaccaaaagctgacctatcagaaagaaagcaatgggaacaggttgcactaaataaggaagcagtcatttgcatgttccaaaagaacctcagaatttcatttcttcatgcctgccccactcactgcctcgtttatttagaaatacttacatgtcaaatacaaataagaatagtagcctgatgtatacaactgtgtggcatactgtaaaactttgaaatgaaatttaaaccaaattggtttggctcaaaggaaattaaaaatgttagatatactgtttggcattgtttgatttttaaagctataagaaggcttagtataataatagcaggcttcaaagcaatgggaattttgtgattaatttcaaaatgtcttctgtttgcttcatactgctctcatcctacagccgacaagaatataggaaaagaaggactatcaggataatatcttcacaatataaattattgggattatttgtgaagatgtaaaatttttccagatggctattaatacccatcaggaccattttcagacatcattaggtttcacattagcaaactcccaccaaacatagccaaaaaccaactgatgactgaaaagacttggactttgtccattagaaaatttaatttccacactcagtgtctaattatttgttatattctatactgtcagattattattttaaaaggtcatttagaatattctcagccacttgacccattttaaaatttacacttgattgaagttgggcaccaagtttatcatgaatagtactaaggtcatttgaaaaagtaaacagattacaaatccaaaaacaaatgtctttagagccctttccttttgtttgaatgtgggtataactctctgaatactttgtgacacaagtgcattagtgacctacacaaaatttaaatccatcaggagatattataacaagctgtggaactgctgaccattatctttctgaaaacaattacataggcctgtaataaattgcatcaatatcagtcaattatctcaacaacactttactaacccttgtcaccaatgtattgctgtatatcagatttttttcaacaattgaattattctcaaaacttagtgttgcttcacacactaaaaatagccactctaattctcttgtgttaccctgctgtattcccaggaggtaggggagtgctataaacaatgcttcatttttacagatgaagaaataatgaaatataacagaggtacagcctcttggcctgaatccttttgaaaatcaataataaggcaagcaatcaactagtggggtcagagtttcaagtcatccattctggtgttctctagagctccagtgtaggctctaatgagcacagcctcacaagagcagaaaagatatctgaaatcctcattttacccaaaaaggctacatctctatatctctcccaacataaactttgacacatgactactgacaagaaaataaattgaatgtttataaccctggatttttcccttgcttagagaaagcgaatttattaaaatgtaagcatcagcagaagaaagaaaaataagtttgataactattccatggataattagaagctgaacttcccatgatctatccataaagtactggaccagccatcaagaccatcccaagggacattgctgagttgcaaaaacagaggctttcaccacttgctttgcatgaaaggaaaccgtttcaccccagcctttcctcctccatttgtcttggcctacatggggcaagggtgtgtagtggtggaaaggaatacactccctctttcacacctaattgatccaaacaggcacaccaagaaacaatgcttcctcaaactccacaatcatgagcaacagccaccttcacacagcgtccttcttagagcaccctgaacagaatatggtcaaagaaagctgtcctagatggaagaatcacagttcagctataagctcccctatccaactgtagggagaaacataattcaaaaaggccctatctgttcactcgctgcaaaaacaaatgggaagtttagagcctgggaagcccgcaactatgggtttaagagatgtttgggattgctggatggacacatggaggcacttgtttcctggggaacattaaaatcaaatgtgccaagaagcacttaagagtgcacagacaggctgggtgcagtggctcatgcctgtaatccccgcactttgggaggctaaggcggggtggatgacttgagcctaggagttggagatcagcctgggcaacatggcaaaaccctgtctccacaaaaagtgcaaaaattagctcagtatggtggcaggtgcctgtagtcccagctacttgggaggctgaggtgggaggatcgtttgagcccggtagtcggaggttgcagtggaggcccagatcgcaccactgcactccagtgggggcaacagagtgagaccctgtctcaaaataataataaagtaaaggtgcacagactgatgaactctggctattggcacaaagactagacaggacttgagctcctggaggatctccttcatctggttctcatggcccccatcttatagtgtggcaggtgtttttccttaccatttggaccgtaagcttcttgagaattatgactttaaacatccaccaaatatcaactgtatgcccagcacatgtcatacactgtattgagcacacttttgtgaaagtgaaaccatcctaatccactagaaattttatagcaaaaattatcagttaaaagatgaataattcacttaaacaagattaaaaatataaactctgaatataatttaactacttcactttggcaagcttataaatgcatttaacaataggatgtgtcacaaaaattagccgcgcatggtggtgccagcctgcagtcccagctactcaggggactgaggcgggagatcatttgagcccaggaggtcgaggttgcagtgaaccgtgatcgcgccactgcactccagcctgggtgacagaccgagaacttgtctcaagaagaaaaaaaaaggatgtgtcatttgtaaaccatttttttcttgcccataataaaacagccagcacttaattctctctctctctctctttttttttgagatggagtctcactctgtcagacaggctggagtgcggtggggcgatctcggctcactgcaacctctacgtcccgggttcaggcgattctcctgtctctgcctcccaagtagctgggactacaggcacgtgccaccacaccaggctaatttttgaattttagtagagatggggtttcatcatattggccatgctgatctcgaactcctgaccttgtgatccacccacctcagcgtcccaaaatgctgggattacagccgtgagccaccgcccgaccaccagcacctaattctactaattctacaggtatgaagggccataatgctgaaccataaaaatgaatttttaaaaaatctagtgctataatatttaggtgtcaaaaactaccttactatgaaatatatgtacatacacacatacacatatatataaaataaatggggtatttcattagtgatttaataagtcttacgatgtttctttgttatttgggttaagagagaccactataaaagcagagatcctgtaaacactgaaaagtaatgcagtgactgaattagccataaaaagtttctaaattagtctactagaatgtaaactccatgaaggcaaggaatttttttttttttttttactatttttgtctattgatggatctccagtgtctagaacagccctttcccagagcaggtgcttaataaatctctgttgaattaataaatttttttagaattaaagtcaacagtcctgtgaacacccaagttgagtctcttaagtaggcccaaggccccacgagtaatcactggtcctctggctcttgcacagaagttcgagtggggtaaggggtaattcaggccccaaaagctatttttagagcaaaaacttcagaatgattttccacaaagaaccagagaatttagttcacttcattggcatagcactggctgagctcagtgagaaacaccccagattttaattgatatttccatttgttaactgttaaatgtgaaaccatgtcattctaacattgtttcttaaaccatttcagtcaagagtttaatggaccatttgaaaatatttaatattttactgtcacaacaatttgaattgtcctatgtttttcttatagtctaataccttgttaataataacccatagctaccaggtattaaacgtttactatgtgctcattgagatgggtacaaacattctcataaaaatttcccaatgactcttgaatgggtattatcctcattttgtaacctcagggaggttaagtaacatacccaaattcccccaggtggtggtggagctggaatttgccctattctgtctgacttcaaatcgaggttcttaatcccgtgggctacctgtttatccatatactactaaggggaaacattgtgctaagtgataaatatggttggccttttttaaatatttgaaataattttgatgtgtaaacaattgcttatactgcgtgaaatggtaaaaagacaaagcattttcggagccaaagaaccctgagttggaatcctgcttcaccaatgactagcaaagcatccccacaaaaacctttccgaatggaagtttctttaagtatacacatcaagataaaaaactaaatcttctcaggttggttgtgagggctaagtgacgtaatgtggagagagagcctgggatggagcctggcacaggtgagtgctctttaagcctaaattgccttccttctaacggatttgctaaattggcactgtgctgatttttttaagtgtttagttcatccttgtaataccataattacagaatataatgacattgcattctctacaactacaaagtagaatttataaactgatagaatatgagctggaagaagctttaggagccatctgttccaatctcttccatttccaaatgaggtccaaagagcttcgatgacttgtttccaagttttcacagaaagttaattgcaaagacaggactagatcttgcgtccctcccacccccactcctgctatacccttcgcttttgcttcacattacacaggcatggcaacgcatgtaattttctaacaattaagcagtataaaataacctcaatttaattgcatccaattaacaagccaaattagcgtttcatatgtacactattaaactagttgtctgccttccaaaagaaataaaacactgtttcaaataaatctagcgttttggtgaacaaagctacttacagtttaaatcacctttcctataatcttctttatatggaattagacattaatctccattttaaaagaaatattttctgcaactatcaggatgagaattcacgctgtatttaagtagcaaaattttctctctcacagaacacctatggttttctatgatttgtatatgtgtgtatgcacacgtgcaaacctgtacacatatgcacgctgtcagatccctaatcaaatacaaacgaaggtgtgtccacatttacctactgccctagtttcaaaagtcccaccttttccctaggcttctgaactcaagtgaatctgccacagtgcaaataataagagcttcgatgatctgctttttttcttcttgcagagaaaatgaaaccattaaataaatctttgccaaacaaagcactgcatttcaaatacactgcactacactatctgtccagtattgtaatgatttagatacagctgggtatcaattaaaaagcagtattccagttaaccacgaaatgaatcagtggcccattccttatacatgtatccctaaaaatataattaccttgtaattttaactataaacatgtctgcaagttggtgtttgatggtcaactttcactactaatatttataaatatattccgtagtaaaaaaaattttatattaggttaaaataataatgcactacttaaaatgttcaaattgacaacctgtcatacacatttggcaatgtttaacaaaatattttaatcacttttgttacttacttttagggtacttttaaacacatcaattaacagagtaaaagaattcatattatcattcagtaggggcaactttcattacttctctttaggatattttggcaatctaactgtctccttgccaccgagatattcatcccatataccctcataagctttctgaaacacacactttatagcatcacctctctgctcaaaaaccttcagtgatgtccagctttctctgcaggtctttgaggcaccacaagatctggagctacgtacctttccaggctcccaactcttcctctgccctggtactatccctgtcccctcccatcccaggtcagagtatgaggagctcctgactcccttctttactcagtgaaattctacttaacattcaagatcctcagtaaaaaaaagaatcacctcctctcataagaaccctctaatctttccagttggaaaaaatcctgcttccatttatactctactcccaattgtaagttttaataaagtttactataagccatgtctcttctagattgtaaaatgtttgaagttggaaatcatcatccttttatctctgttgctcattctgactcttgatctgactgcagagcccaagcttggaactactacataaaatagactctttttgtcacctaaattgaatctcctacattatataaattataaaacagaaaaaaaagtaatcaaatgatgcagtggaaaaaataaaggaaagtgattttcactaacctctgtttctactcttttgcttcatattttcatatcacacagacccctaatcacatggaaagtaagaaatcagaactaaatttctccaaagatcctgatacttgcaatcatgaggagaaattattgggatacttgaatgtctcagccctttgctagttgtttgaaaatatatagatctagctcatgcagggctccaaagattaattggttacttcacacagcgaccttgtaaagacttctgaattggtagttatttattaattgaatcaatgatgctggctatttttgttaactggagcaccaaataagtatttttagaacttaaattatttgttattaaaaaaatctgcaaataataatagttaatttacaggtaagtccttcaaactgaagtcattacatatagagtcattaaaaattccaggtgctccaaaacaattgatgtggaagcactgagaagagacaggcgttatgcacaaggttcttccaatttcaaggtcctacccctcaaaattgcctctccaaggatcaacctgtaacatgatcatttggagggtcatgatgtgtcctgatttgccaaaggcagtcctcacatatgtcaggttggataatcattcctgtggtcaaccttccttcaaggccctgcattacctttctcttatcagccccactggcttgtttttaactcctggaaggagctcctttagtggttcgggtcattatttataccctgcgtgtctagcacaaggcctaatctacaggaaatacttgttgaatgactgagagagtgaattgcattgaccagcaataacagggcaccagtcgtagtactctgaatagaggattaagattatatgtgagtgacaagtcaaaaaggttggccctgggtacttcctgaacttacttccatcactctgtgacccagaagtagcaggtgagaccccctctgctttctgccgagaatcaccctcaggcacataaacatcatgttcatctcttcctctctccaaagcactttctcaaatagatgtaaacaattagatcccaaattttaaggaggttggaaatctaaagttatagacacttgtagaaaaatcacgtcatagaaaatacctcaaatgatgagtaatgggagtgtatgttaagatagcacaaattcggcctagaacaatagtgacccaaatatcaggcagttctgattctattctaaatgcagtcacgaagccagtttaggcctgtgtctatctaatgtcgatattcacggtccatctcagagaagccaaagattgcacagactaagaaacctgtgttatcctctttcccacgacgattttggagttgtgacacaataataaaatgctaaaatgttttcccaaattagttagtggcatctcatagctacaaatactggcttactcaacctctttttcataagcattgccataaatatcatacagaaagcaatgcttttgattgtgaccaaataccaggaacaaagagaaaatactacttctcatacaattactttaaaataaacatgatcttattttcataaagttttcctatttccctttaatcctctgtgttcatcccaaacactgtaaatcctacaggtttcacagtacagccctcacttgaatattcactaaagtttagctccatactaataaaggatctgcctgtatggttaaagcaaatccatacactctggatgggtttgaagttccttatgaaaccttaatttcattaagttgagttagcaaacttcctctgctcctttttataatatcactttaaaagttgtaacagttaaataccaagttttagccaaaaatatgaattcatgatgaattcacatataaatccatgaactggaagcatatcattgaaattttcaggtagatatttaaactgtgaaccgtttctccacctacagaactaatgtatagaccaacagagagttccgctgatgctgatcacataccaaaatatgaaaacggtgtttatttttaacaaataggagatgagcagcctgtctgatccacagccatatatccgattgaccttagccacttttcccttctgataataattacatgtcagttattaaattactttacatcctcatggattatagtttcactcatgccaactaacattttctatcattctttaaaattacttttcctatgtgaagctttcaaattgactttagctaattactgataataatttaaaaactgaaacccaacccaaatagtgtacttgttataattcaaaagctgaaacccaatacagtgtacaacacagagttatttgttattgctgctgttaaaatgagccctgctttgaaaaaaaaaaatggcaaattctggaataagatttttcattttaaattaaatcagcataaaagagtcaaacagatcttctgaatagtgacaaagtgccaaaagttcaagcagacacatgcaccattactccacaaggaacgtctccctatatactgtcctctgttttgttttcatggtaacaagaacattcacaaacacatctcatgcaaaggagcctgatcaatcaaaatattctgctgcttaatctttcaatgtaatcaaagagaattattttcctatgtgataatatacacatagtaaatttttcacattccatgttaaataggaatatagaaatgttttatgtactttagtggtattttaccaaacacctctacaaggatctaaccagttaaaaatcagttagatcttacatttgtaagatcattaatataccaccattcccaaaattgtccccgaatcagtcacacatcaatttactcttgaatacccttgtataaatataagccatctctaataaagttagccacataaaatacagtcactgtaacaaaaatacagatgcaaataagcaaattttgttttatacccgacctatgctcgacgcaagaaattgtctcaatgttcaaaagattcatcattgtaatacatttctgtatataagaaatatactgcatatttcaaacctagtggtcaaagggattatgacacttgaaacaaacacactatcattaagtaaatactggtaaatccctttcagctcacaatgcaaatgtacagttgtcatttggtactatgactccttagggttccacagggaattttctcttaataatgaaaatgatacccactttagtcacagaaaggacatttctgttctgataaaccatttggcctatatcctaaaaatcaaacccaatctactcattccacagtctacttcgttaaaattctgcttctggcactcttataaggtgaaaaagcaatgagacatttgctacatatgtagcaaacatatgggatctatatgtgcaaatatttaaaataacttggtttgctcaagggcaaatatcaccaaatattactatatcactggaggaaacgtttctaataaagttaaatggcctttttctaggaggacagatcattgcaaatttaattaaaatggatcttattaatatttcaagtaatgtctgggcttgattatgcactacaaaagaaacaactgtattgaggagaaaaatcaatagcccttgactagggctctgggtatgctagaaaaacacagatctcttgtgaattattgaggtccagctttagggttgggggcgagtaccaatattcatttggaggtaaattgagttatttttaaaatggcagaaaaggaaggagaaaaatcagctcaaattttccattataatgaaagtacaggaaacaagcctttctatattcattttaggcctaaataactctgcagagaataagggttttgcaatgtcagttgcacacacaacttcctgtgtgaatgctaagccattacaggtgtcctaaggcctccagtgaaacctattatcaagagattcctctggtctcctcgaagtcatccccagcgccccccatccgccgcccacacattattgcttctctcctccaagtgtcttgattaaggaccctctctcttctccgcactcccgaggttaaagtgcccccgttcccttggtgtagctagttacaagctttcccgttagggaagactagtgcctgcagtcctttttagttagatgcttttaagtcagagatgagaggagccacttgaagaaaccctccttcccttcttcctttcccccactgggaaccaagtccctgaaggacaacacccagggacgcttcctgaccttctatcccctcacccaatttgggcttggagggttggggtcgcattttctcatgtcctctgctgcactggatgtgttatgtaagagggacagaacgcgggaggcacatgcgtataaagcgcaccgatctgtgataacagctggggtagcagagcggatctggagtccaccccccccccccaccaaatacgacagaccccacacatgcacatcagcaccccctcccccacacacccacacacacacacacacacgcacacacccagagcaatgttttcctgtctcacccctaccagtaccagaggcacagaatggaaaggcggggggtgggggtgaaaggaggtgaaagaggaggaggagcagcagcagcacatctgctttgatagcagccggcagtgccgccgcggcagagagcccctcgttaacccccttcctgtggctgcaccacgtcatggaacattcccggaacgggccaacgttccacccacttcagggaacagacataaaggcgcagacccagttccccacagtgcacagcccaaacacacatgtcccttcccgatcccccgccagacggacagacaaacacgcatgcaaaccgcccccacccgtctccacgcgcccgggtccagccggcagcggccagagccgctctgcagccggtgcacccgcaaggcgagggcgcctccgcctgaaccttccatcgagacagtcccctccttcctcgcttccttccttcgctccttccttccttccttccttgcccgggaggtaaagggagtcactgaaatgcccagagccagcgccttcgctgcgctcgctcggccgcaggccggcggcccgggcctcgcgccgccagcccgcccggccgcctgcgccgcgcgccgcggccccctcccccgctacctgacaacgggccgccgccggccgccgcagccgcagcggtggccgggccgtgcgcgccggtgcacgtcgctcattagtaagcaggcacattcctgcctccagc

SEQ ID NO: 1743 - DNA, 412343 bp, Homo sapiens
tatgttgggattttcaaatttattccaacatgctaattcttttttttttaaaaaatatcctcaggctgaacactcagccagagctgtaataaaggcaattattatacttgtaaaaacttctcattcacagtacagatgtaatttacaacaaaggtcacacacatcaatactgagcatttttccttttgtacgtcagactctgtgctttagacctgcgtggatttttgttttttttttttgtttgtttctgttttgttttttcttttgcactgatatataccataccaacattgcaagatgcaagtgtggaaactggagtttaaataaaattacaggcaaaactaccccatcccagtgcggttgctgtacatatctacagtacaatttttggaatgtattgccatttaagaacatagaaactttctacagacaatttcacatacagaatacgtacaccttttagaaaaaaaggcaaatatttatcttacagagagcattgtattttacatttgcctgcacgtttcttttttctgtttcttttctttctttctttttttacatactagatttattaaagtgaccataagtgccgaagcggttttctaatggaaagcagactggattcacaacacagaagcagaattggtggaacaggctttcgggaactttcttcccctggtcacacggcagatcggtccccaaggacaggtgctcagccaggacttttgctttaagaaggatttgtctggagaaaggactagagagaaatccagctcagatgtattgctcattcctcttcagaaggactgggtgggaatggagcaggggctagaggaatctggaagctaattcttttaggctttttccaacagagggaagcagagggacttctgggtctggaagttggagcttacggaggcgacagtgcaggcagctggctgctgtcgggctcctggagggttgcaggggttgagcccagagtgagagccacaggtgcgggcgggagcagagaggagtggggttactacccaggatggccctgagattgccaagggtgaaaggcatcgtggagcgcaggcctggggggcaaggactcaccaaccaaaggcaaggtttggctctgaaacctcgaccagttggttcctcccccactgcccacacccaaggaccaggactagtctgtaccgaggaatggccaccccgcgcatttcaacagagcacgtagcaggcatctgtgccaagtcagccactgcctcctctgctgcttccctcaacaggcacaataacatcacaggcaaacaggaagcttggaagtgactgggagcagggcagaaggcccagaggagggcgtgcatggggcgagcgtctttctccaaatcatgaaggtgtacctgtgggctgggggctctgtgcgcagaggagcgggactagagtccggaggagggggttagagctgtgcccagtgacatatacccaggctggtggcattggttctgtccctctgggcacggcatcaatgtggaggcagccctttggtgagattctatttgtgcatttacccccatcatttagaaatagtctccagtgactcctggcccctgtggcttctctgcctgagcctgacgggcccggtgactgccgggcctctgccctgccggctgcactgttcattgctaggctgcccagggaggaaaccttgggtgggtaggctgtttgagtacagggagaaaaatgcccaggagagctggaaggcagggtggggtggagtggtgtggggccccccaccaatgtcaggggctagtccaccagagcccccggtctgctgctttgtaggtctggggcaggaagagcttgcccaggcagatttctaacctgggctgaagcaatgccctttatgcagctcccagacctcagcccttgaagtctccaatccgtgggcagtcccatgggttagggctgaaaggcaaggatgagaaaagccctggcctcctgggacttggaggagtcactttctgtcaggccactgtccagcaatatggacagtgtggtccaggctgggcttgctgcttctcttggggaggatgagagccctagtctctgagggaagcagccaggagctgctggctaaccctgattccccagaaccctggagcacagtggactcccagggagccctgccttctgtctcatttttgtcttagctctgaggcaaaggagaatgagtgaacaaggtggtctggctgcaggctggactgtggctggtttgtctgtctagtagggaccaagcagggaaaggccacgaattggaagaggcaagtacagccccgcacagggaactcacagaagggtcttaaccctccccacctactgtgtcctgtacccaagcagcttcaatagctcaagagccctggggcaggcacttgattcacacagcctggctgaggactggggattagccagagaggtccctgctctgtatagggtggcatcaaacccagccttcacgggcctcaaccgtagtccctgtgctgccctcccttgtagaaagtaaagaaaatcagttctgaaacactgggaaaaagctcacctctcccagttggggcgaacacgctagagttcaagttccatagttcaatttgggatttaaatttctggtcctattatttttcttacaaagtagagttttgccccaggaaatgcagggcagcttcttgaaagtagagatgtgggtaaggaagaggcactggctcacactgattgctttggagaattccaacgagttaggacaattcaaaaatcctctaggtcaaaagaatctgtggtggctgggtgaagtatcaaacaccatcctctctctttttaaaaaagaggtgtaagacagcaaacaggtccaggccgtatccaccagccacagttgtgggtatttccttggggtagtggagacaggggcagggacggggggaaacggtcctgtggcaaagtggtcctgaaacagttccccgcaaacctctgctgtggagaactggaaaaacccagccatgaggggaacaggctcccttgtaccccagggaccaagatgaaacaaaacccaaaacccagtctcaggaacggccgctagggctcgggccctgccacttctgcctttgtgggtggtttggtggttttagaacagaggaggcaacaggagagtgaggcctcggtcaggggcttgggagccagggacggacagtcagggctccttccccagcccagggggccagggtggggtgcagaagggaggtgtctggagtgggggtgcgtgggtggggtggcctgcccacctgtggagtgccaggatgggcccatgactcagactaccagagtatccaggagcccttggggagccagccctcctccttctacctgcacctattattttgtgttgaaatcctaggaaaagtatcattttattttcttgcaaaaaaaaaaaaaaaaaaaaaaaaggaaaagattagtttttctgggcctgcctgctggggcctgggtgggggtcacctgcctgtgtttgtgcccctctgcctggggacactggcctttctgctggcagagaggggtggctacgagctgggcaggggggtgaagtggcaataaacaggaaccttgatcgcatctgtacacaggagtgcttccttttacatttaattctatattgtttgaagtttccttttcctttctccctcagtgtacccctttccctctgccagcctctggggtgggtggctgccaaccacagcggggagggtcaggaggcttcaccatcagcctttccccaaaaccataaactattcacagcctcagactcctcgtgggttgttgttttttttttaaatgtatgtatgtgatttgttttgtttctttttaagcaacaaaaggtgtagaaaaaggcacaggtaactgcatacatgggaaggtacaacagatggggccgtgagagctcctggacggagggacagatggggctgaggaagtgggatgattcgaggaaagtggctggaaacgtctgttgctggacactggaagccagatgctgaagcagttggagagaggctaagcgttggggggaaccctgtcctcaggctgatgtggatgtgccctgggctccccacttcctgagggcttgggggagtcctgcctggtcctgggttccccggagaggttcctcgtccgggctgggaagcgggcagaggcctctgccaggcagcccacagagctgctgcggtccagcggcggggtggcagaaggctcggggttggtcggtgcacgcggggactccaagcgggggctccaggactgcgctgcccggcgtccctggggcggccggggcaaggtgtcgggtggggtgcaggggctgtgcgtgggtgtgggctctgcaggtgccccggtcccatggggtgtccagtcaggaggcctgcccgggcctccgccggtcctctccctctccttggggtagtccccgccctccagctctgaggagagtgtgaatttggagaccttagccacaggcgacacggaggctgacgagctctcagtgggactccagcggcctcgctcctgggcctcccgggcccctgtcaggtcgctgccacccccggagaagccactgacccaggctgcggtgggccctggcagcagggtggggtgggctcctggccgggcctgcaccatctggatcccaccgatgggaatcaagggacatggggcacgggtcaagtgctgggagtgcagaggcaggtggctgaagatgttctcctctgtccgggccaggatgtggccgtggaagtcatggagggcggagaagggtcgggaggagagaggatgagcagggccgggtgagcaggagggacttcgggactcggccttctgctggggtcagaaaacaagacaaggtaaggtgaaggttacatgctgggcacatggggagccgaggcctggaagtgggagggggactcgcccaagatcacagagcgagtccagggtcccggctgagctgagcccagaaccaagttcctgactccctgcccacagatgctgagccagctgccatctctggaatgggccatctccagctcgacagtgaccatgagtatgctcaggccccatggtctccatgcctctagccagcatatctgtcttcaaaggaggggatacttgagcgacgtggggccctgttgtcacccatgagcctggcctctatgtgggtctgctgcctgtcctgttcctaaaatggtcttcacccagcttcactcttggacatgagttcccacctgaggctctttgcccttctgctacctccaggaatttgaatgtgaacccaaaattaaaaatcaaggaaagattcctagatcagtgttcctccaggagtgacagggctgggtcatggcaacacggggacagagaaggtgtcggaagggggtcagctgacaatgatggtgctatcggtggaggggtcatggcagctgaggggacagggatggtgactgtgctcatggggtggcagcagtggtgtgttggtgcaatggtgacagtggtggtgctggccatggggatagtgctgatggttgacaaggatgatattggttgtggtgtctctgagagcactggtgacagtgatattggagatggtgatggttttggttaagttgtgccatctgctcaaagaacacaggcagatggggatggggtgggggatggggaattgcacgagtatttacaacctcatccaaggccacaccccttgcaagtgatatgatatcgtttggatatttgtccccgcccaaatctcgtgttgaattgtaaaccccagtgttagaggtgggcctggtgggaggtgtttgggtcatggggacggatccctcagggcctgatactgtcctccagatagtgatttctcatgagatctggcattttgagcgtgtggcacctttcccccaactctctctcttgcttccactctgccatgtgagatgcctgttcccgctttgccttctgccatgagtaaaagctgcttgaggcctccccagaagccgagcagatgctggcaccacgcttcctgtacagcctgaagaactgtgagcctattcaacctcttttcattataaattacccagtctcaggaatttgtttatagcaatacaagaacggactaatacgtggtagaacccatttcccatgaactccagagtccatgctctgtgcttctgaggctaaaataaagtttaataagccagctgatttagggcagccagcatggtgcatggcacagtaggtgcctaataaatgtttgcgaaattattaataactactgagctggcagagctgtttagttccaggtgtgatacccaggagggtgtgaacttgcaacccctgcacccacaggggagaagcggcccagccaccaggggcaggaactcacccacggggaggcgcaggtctctgggcttctgctgaggagcttgtgaggtagaggcgcgggcgggaagagaacccgtgggtccagccccaagcctgggccatgctcccccgctgaggggctgcccggcccagccaaggcccacttccctggcggcgctgaccgtggtggtgactcggcctgacctggagaccatctcctggtgggcgagtatctggggaggcctgggtcggtggtaccctcgagtttggagagcacatgtgctcgaggggccagttctcttcccagggggcagagggtgagaggagacagctgaagtcttggagacccacaagggagagcgcccatgccccttcctgggtccacgtgcaggccaggtgggcttggggctgaggcctgtggttctcgggccggggagcatcgctggggagatgagtcgtttttggttagcgagtgtttgcgggctagtggtggacggctgcctgcttctttgcttggggaccacggtcttcttggggacacaggcttgtagctcaaggctgagcctgtgtctttctccacagagcccagaggggccggtcccagccaggggaggcccggcatgctctggctggacatggagcagctgctggctgtcaggcgctcagcttccgagaccgagctgcctcgtgtagcctccgtgccagaggcgggggcatctgggggctgagggcccaggatgggtgaggagtctgcccgcagtgcatgtggtgggccaggcgggggcgcctctgaggatggtctggacagctcatcctggctctcctcctcatcctcatcctcgtcttcgtccaggtctgagtctgagtccgagtcctccaggtccgaaaactggtgctcctccacagcctctgaaccctctcgtccttccgagtcctggaacaggtcgtcactggttcctgagggcaaacacagaagacccaaggtcacagttgggccttggccccactgcccacacggctgctcctctctgagccccagtttccttgcctgctgactgggcaaaatagccatcgcaagggcacaagattgttgggacaaccaagaaacgtaacagatatgggagcgctttgtaaataataatgaacaataattcccttatgcctagaatgtgcaatgttcagttctgagagctttaggtatatttattcatttagacctcagagaatcctgtgaagctggtactgttctcatcctcatgttacagatgaggaaactgaggtaagagaaagtaagtaacttgcccatggaagacagcagtagggctgggattgagccatagcaaagaagacagtctttgtttgtttgtttgtttgtttgtttgtttcactagcatctcagtgctggcttcaccatgggcaacttaccaccttgctctgcttggtctccccctttgtcgaatgaatgtgatggtctcacctcaccaggttttctaggaggactaaaatgaaggcctggcacatattgagggcttaaaaataattatagctaccatattaatacattaatgatgaaatctgttattccaggacagggcagtcacactggctggtccagcagcacagagccatccgtggtcagtgtacacacacatctgccacggtgaccaggctcccggtggctggcacaatggcatctggcaggtggcggactctggcctctgtgggcggcttgactaagctggcctcaggctgcagagcaggtccccatcccagccacgctcttatctgaggagccactgcccttttgaagtccaggctgcctctagcctcggggccctcccattgcctgccagccccagctccaccccatagttttcgacctacatgtggctgaatgcccacttttgtccactttggacatctgactgctgcatgttgagtgacttggaagcaattgttcacaagagtaaacaaaaaacaaaattgtgatacttgtttcagatattgttggacatttaggtcacttgcactccttaaacagactataagaataatgacagagttattgaatagagtctaaaagtgggggttagggctctggaatactagcctcctggtctgattcctctgggatgaccccaaccagtcgggtcacctctaacatgtcaggagtctagtttgggcatctctgaaatggacagcaatccggatgctggggagagctccgctaacatctggcctgttcgctggcccatcactagaccattggaacctgtttctggtctgcagagtgaggttgctgacaggtgggttgagctggccagccagccccatcgctcacacatatcagtactgcacccacctgaccaggagggctggcacagaaactgactcaggccgctggggcagctaggctttggctctcaaccatgcccagctgccccggggccagaaagcccggaactagcacttccaagtcactcaatatgcagcagtcagatgtccaaagtggacaaaagtgggcattcagccggatgtaggtcaaaagctatggggtggagctggggctggcaggcaaaaggaggcccctgaggctagaggcagggtgatgagaccagaggaggaatgaaggattaggatgagagcagggctggggatgggggtgaactttgtagttatgccccaggcatttacctcccttgcctaggactttgggaggggcctaattcaacacctgttcacctggccctgcccctcatttacatacagcaaaatccaggcacagatgacccagtgagagctggtggctgagtcagaactaaggtttacagcccttgcattattacgctgacagtttaaaaatgatgtgctgcactaagaagcagggaatggtcgggtttgaatctcagcactaccacttccttgctgtgtgacgttggatactttactttctgtgtgtctggtttcctcatctgtaaactgggtagcaataaaagcactctaggaagctgttcagaggactgtgagggtctggcacacagtaagtacccaataaacttcagctcctgtcatcccatgataccctgtccccccagtctcagcaggcaggtagctggggtgggattgtcagcattttgcagatgaaggtcacaggggtagtgttaggagtgaaggagagtcaggaccagcgtctcctgatgtccagcagggagggctcctaaagatcctctttactaatgtggaagttgagacccagtgggggtaatggcccgtcctgggcactcagtgcatgaatgctggaagccaagagtcccctgcccagctcggggctggccggggcctccacatctgcgttcctgcagggcgctgagggaatgcccctggctgggcggccccgcccctgctgggatccaggccaacgctccacaaatgagagagcttgagcgcgcggcgggcgccgctgggagaggccacacggtggcgctagcgcccagcctggccagcaccatgggcagggccggggcgcctggctccttccaggcagttctcccacgcgccacctcgcgtcccacagacacgaactcctgccgctccccccggcatctgtctcgtcgcgggaagtggaaactccatccttcagtctcttgggccgtaatccttggagtcctccatggctccttttcgttcttccccctctcttctgccccatatggggtcatctgagcctgtgggctctccctccggaacctccccagaatcccgccgcttttccacctcctgagcacacccgtgctccccgcgcccacggcacaggccagaggacgccctgcctctctcctccgctccagggcacccccccatgcccttcagccctcaggctctagctctctctgaaccggctgcccccgcgtccagcgggctccagcacgcgggccaagcgccgtggcccccggggaccccacacctgctgctccctctgcaggagagctcctccctgaccccacgtggctcctgaccccggttcctccgggtgggttctctgctcacaccgccctgtctagcacagcggccctccccacgggccccagccctcacttggctcttctgctttctctttggcttcacaggcagggcccctgctctactccaccatcgttccttgcccagctcccctgccatgccgactgcctgagggcaggagctgttttatttattgcggaacccccagcacccagaacagagccaggcacagagactgtgcccagtaattacttctggaatgaatgcatggatttcgtcctccgaaaagtggctctgagcatcctcgtttgctccactgggaaaatgaggctggggcagggcagggacctcaggggagggctctggcttaggttcaggctcccctggtccagcccaccaggcagtggactggcatgcagccagggtttttgtgtgaccttgggctatttttacctgtctgagctttgacttccctgacttaacatgagtgacacaagtttctgccacctgttttgaggactcaatgagacaacatgtgcatatggcccagtgtatccttgacaagcatagtgaaccccattctagctttgggggggaacagccccaagttcactgtgttctcctctataaaaatgacttattccacctaaaaggaaatatgacttaactcttttttgtaagaccacaaatacatccccaaattggaaaaacaaaaacagaacaagacacacagtgcgtgcatacacactcctctctgtcacactctaagtcctggggctgatttcagggaatcagtatgcttcctgctttgcttggtgctggcgagatggctccagcctccttctgttggagggactgccgtccaccaccaaagcccctctggccacctgcctgactgctgaggctgggcagtgctcagccagacccactggcttcgactcctctgccctgtcttctcagagactgactctaagatgcctcctggggattgaccaccatggccggggtgtgtacggggatggggctgggaggtgacaagcggctgtcaggtctggtttgggcttttttgaaactctcctagctccaaaaggcccatgtgtcaggcccatgccagagtgtgtaggcaggagtgtgggtgtggagcttcggagagtatgtgtcccacagtgtcactatgaggggttggctgggataattcagggcatgcatttagaacccgcctgacacatagtgggcactcaatcaacgttggctgtaagttctcttgtgtgcatttattcagtaaacattcactgagcacccatgggtgccaggcgctccacctgcatggcagatggtaatgcatgatagctagggctgcagagcatatcctatcagcatgtggggaggtggctcgatcattcagggaatttaacctttgtctgatacttgggagaactgaaggtgaagctattggagggagagaggggaggagggggaatggggcaaagcagacagaaaggaagcagggaaggcaagcaggaaaggtggaggaggatagggaaagcggacaaggggaaaggggacggagaaggttggcaattgttaccttcttcggcttccagctcctccagcacccctgtctcttggcactttttgctgtgggccttcgacttcatgtgcttagtcagattccctagaaagaaacgagaatacttaggctctgctatggggcaggaggccagggcggacccagggctcatggaggtagcacctggccggcaggccatggtttctcaggccagtcaaggccctgccagctgcagggctgggcaggagctggggtatccctctgccccggtgctcaggcccagaagtgtagccacagctgctgttcagggcagtgcacagcagctaggtggggtgggcgagggctgtgaggggacagacagtataatgaggaagtgagatgctggttaaaaaacaaacaaaaaagaaattaaaagacaactcaagtgcaataggtttttttttttttttttgcttctgatttaagtctggccctagtagctggtgacactcatcaggcaggactattggccatctcaagtgtgggatgacgtgggaggctcccattgaccggcatgacgggtgaggactgagcatgcccttctggctgaggacacctctagggcagctcacagggcagaattctaaagtgtaggtagagaaaccagggcaaatttaatattaggcatggcgagagggcagaaggtgagagtagggaagtctactagccagggactcaggagccacaaggctgggggcccaagcttggtttccatagagaagtcccatttctgggccttcagtttccccaggccaatctacagtgcagacacaggaccagggtggttcagggaaggcctgggcaaggcctctgtcctgctccatgcctacaaagccctcagaggggaggctgactttgccccaagttgtaggtccagcccacaagctgaagagtggaggcagcagctctgtggaatcagggaacagtagcaacagcttcagttccccaacaggtgcacaacatttcacaggccacacagctctgtggacaggagcgttctaggaaggacaggcagagcatcccagcctgccccagaagaacacaggccagatgcctcaggatattcctttgggcccagcagctactcccaaaccgtgatgtgctcactgttgccctggggatggctatatttccatatggtcattaacatcataagtcataagttccctgagtcaggtgctctgtcccattagtctaatgaattggtaagtttgaatggatggatggaggagagaagaatggaaagagctaagcctcctggagtggatgaatagagcgattggtgcgtggatagataaagtggataaaggaaatataaagagaatgaagaacaggaagaggatagacagaaggatggaacgctagatgagcagataaggagatgaataggcagacggaggataggtgagtagatgaaaacaaatggaaggatagatggagaatgggtcaataaacagatgagatgatggagagctggatgggaggacagagacgtggatgaatggaagaatggaagaatggctggttggatggatgaatggatacatgcactattacatgcatgagagtacagacagaaggatgaaagaatgggaagttggatgggtgggaggacaaatgggagaatggtaggaacagataggatgagcagataaatgaacaggaaaacaattagatgagatggatggataggtgaccagggagagggcccatggatgaactgaagggtgcttcttaatcattcctagaattagaagaaatatttagggttttgctaagaggttaatgggggacccttaagctgggattccctgaggtgtccaagtcaagggcagcagggatgggaggggagctgtttcctttcctctttcttcaccttggtcctagttcatgactctatccttcccaatttgggttttcctcctacaaccggaaataaatctggatgtcctactcctggccatagtgggagcaaagccataaatttcagagtcatcttgtagccagagggtcctcagaggtccctatccaaccttgtggacttcggccctcattgtcatgagaaggcaaagccagagtaggacagtcaagaggtgggaaaaggcagctggggtcttccgcggatcagagatacccactgtcctaaggtcgtggagccaggcccaccctaccctgactaccccaggccacagggcactgtggacactgctcattctggctattacctcacttgttgcacctgttctgcctggaaggtttaggtctctaatgaaccaagctagacgctgggcacacaatgggtgtacaatagccatgtatgggaaatgcccttgtcatcgcaggaggaaaatgttggaaggagcttcaaagtccatgtaattcaacccccgccaggctgaggttctccctgcttctgatctgactctgggcccaggtgctgatggcaccattagacaagatcactggctgtcttggatgctggcagggctgcttgaaccaacacagtgaatcaagtggtccacagtcacagtgctggttggtgccgagttccatctagacccaggtctcaagactcggggggcctttcccactccatgtggaggcagaatggaacctagatggaacctggcagccttgggtttgactgtgggctctgccacttgccagctgtgggctcttgggcaagttcctcaaccttctgagccctggtttctgcaaccgtgaagtaatacctacctcgtggggatgcgggaggacttgatgaggtgacacaagtagagtggcagcagagtgtgcctggcagagaacagacccctgtccccatgtgagtcactctattgagcagcccaggggctctgccacgcaccatgctgggtgtggaggaagagatgctaagatgatgcttttggtgaaatggttttacctttctcaggagaaggcaccagggagccccccataggcctccctctcctctgcccccgccacgggggtgcagggaggagtcaggatcggaggtgactttgcgggtccaggagtggacactggatgggcagccctgagtgctgtccgggtccctctgtgacttcccctctccaggcctgtctcctcctctgtgaaaggggaaggtggggcacacggctgcaggcacagcctgaacaccacttccctgttgagggccagggcctcagcttgtcaggcagagccacagcttctcacagtcatcccagaccccaccaaagcctgacaggcctggaatgaagaggaaaggcaagtgagaggtaaagtgatgggtgtcgggaagaggcggaacctccgataaaagggcatccaccaacaaccctgcctgcctcatttggctttgatcaaccgctctgtccctgcccctgccgctggcagacctgaggccatctctgtcccctgaggcgatcggtgcaagggcctggacatggcacagccatccgctggcctctgggaaccatctgagaagaggaaatgggacccccagccaccacagggccacccacaggcctccccagccccacctactgacgcattccttagccagtttccagaggcctgagctgctgccacgacgtctgacacaagagacgagacacacacggcagacagagacagacaggaaggcaggaggggctccccaggccctggtgtagccgggtggtagggtcgggagggctgcctggggcaggcctggaggtggcccaatggggaggcacacagccccggagacaaggggcctgtgttgtctgagctgatggctgacggggcccagcactccacaaagacacctggccccagaaacagacaggagctccagcgccctgctctcccttcacccccatactgcagagagagttaacagggagacttccctgcttccattgccaccatcccaacctggccttccctctattagtcaaacagtttcagattccaccatttcccatctgctcccttcgttggttctggaaggttctagtcttctagaagcccctgtgaacagttgaggaagagctcagggcactgcttgatcactggttgagagcacggcctcacagccctggccttcaggacagcaggggcagccttacctcgggggatgctctacacccctggaaatggggagggcctacagcccctctgttcagattacgccctctggaccctccaaagccctccagggccctggctctgtgctggctcagagagacccaggaagggactgcagacaggctcagtgtggcttccaatgaaggcatctcctagaaagtacgggctcctgctagggacccaaggcaaagggaattgagtgggccccctgtgggaaactgcttgggctggaaacttccagtctcacgcggcagagtgatggtttcctgaggcgatgggcagcccaggctgcgtgtggggcacaggtgtgctctgcatggccctgggctggcagtgtggtcccctggacacaggccactccaagtgcagctttttgccacccactccagggaagggagggaactaactgctcacagaaaggaagatgatggggtgatgccctggagctcggggcccgtgttctagttacagctccagcattaacagttattctgttttctgggatcactttcttcaccttcaaggggacttgggtgataagttttccacttttagagttgacgaccgtccattgaattgtcagtcagttatccccgtcttgctcttccataaaatctcgactggctgcagaaggccagaggaagtgcggttggagggcgtgtcagggacagcccatgtccagggcgacgcatgctgggcagggctgcagggatggaagacaccttcgaagcacccatggggtgggtggggagtcctgggccaatgtgccctctctgggcaacctttgggacattgtttatgagacaccaagagagaagaggatgggggaaaggcagtgggagggcaggcacctctgtttaaaccaaaaccttgacaggaaaatttgagctcaacttgcagatgatggcgaggggacagaggagggcaggggttcagttaatggggtgaggagaccagaaatgggaacacagtcagagaagaggccactctcccaggggatgtgataaactggcccctgacctggtatagagagaacggaaggggccaagcagcaagagcacggaggaagtgaagaagggtagggaccctgctgggccccctccagagcagctgcccagcctcgcttgctgggagcaactttgccaacagaagaaaggtcaacaggtggcacagctgaaggatgcccttgagtttcaccccctgagaaaccgtggggctcccagaagcccccaacttgctcaaaggagaagacaggaccctgatgtccaaaccctgacccaggaatctatcaagctccagaggctgaagacactggggtgccgagagccctgggtctccctccaaggcgcttcagtctgcagtgagcaagctgccaggaccttccctgcctatcctgcagtaggagagtgcaatccaagaatctcatggactcagctcctttgtccacaccaggggcctggcctgggtggctgtggcaggccaggccatgcccatcacccatcacagctctctgggatgcatgcctttcacagcaggcccctcctttcaccagtgactgccagagcctatcctgaccctgatgtggggtgtggctggggcaggggtgacagggctgtcagtctgggagtggggggctggccctgtgctgagaggtgcagagaagctgggtggagcaggggcatggtgggagtggagaggtgggtggaggtcggcgcgctctggcaggagaagagagcatgcgagtgtgttaagcagctgggagtggaatggatttccaaatgcaagagtggcagtgacgagcatggatgctggagtgtctcagatcagtggataaacggctcaggagacatgcagaagggaggggagatgagagaagatgcaaaaccatgaacggtgagcaagagtgccgcaccaggctgggcaggccagggccgggtggccacaggtgcaggggctgtgtgtgtgttccaggaggatggctgggggcagccatggggagccacaggccagtctggagccagctgctctgccactgggcaccaagctgggtgggaacccaggaaatggggctgctccaggccccctgcaaagaggtctgggcacctgaactctgtgctgggactcccagaggggagctccctgcagcgggcaggggcagtgccccagctgactctctcttacctttggttttaaaagcaaagtgacagtgcttgcacacatagggccggacgtcagtgtgggtgcggatgtgtttcttcagcatgctgggcttcttgcagcgaattccacactcctcacaaacatatttccctcggccgcggcctcgcacatatacatactcttcgtttgatttgtacctatgagcaacaggcgtcatagtaaagggaaaaaaaaggagaagaggcaggttcccacctcagaagacgcacgcgcttcctagattcatccagcccgttacagacgcaaggaatggaggccacggaaccagagaggaccacgagagtgggaggaactgagtcaccctggtgatccactgcggacccctgcgcccctccccctcagacggggggttgcactattcttcctcctccagagcagcagacactggcgcttcccactgaggggatgtggagctgcagggtgccagacagcctccttggcacagccagcccagctacagcttcgcccacaaagaacagccaccgcaggccaccagagtcccagagagggaatgatgataataaaacagcagcagcagctcgggcagccgccattcaccaagtgctcactctgccaggcactttacccaaatcaaagcacaaccacctcaccatggagagcctgtgagaccccgagatttagagacagtgagagacttgtccaagatcccatagccagaaggggccagaatcaggctttgaacctgcctgccccaaagcctgtccagtctgccaggaagccgccttgatattcatgggaggagaaggaacagggaccaccattgcttccctggcttcagagtttggaatgaggagtcctgagctctccccctcacctgcacgtcagcctgcaagctctgcaggatgcagggtcccagccacctgccacatcgcttggggttctatctggaagtgccaccagctttcagaagctgcgcctgaagcacgaatcagaatgctcttatttccacttagaaggaaacccacgagtcccacatgcgcaacaggatcacgatgaagctgtcttgttggtctaatgctatacatgtgcaagtctcagatgcggtggggagggtggcagggggcgcgccaggagaggggaccctggcataattccaggagaagagccttctgactcctgaagcctgagaggccactggcacggcacgtggaggaggcgtggcttctcaacctgtggggcgcaccttccaacgccagccagagttgccctcacatactcacgccgcaccacctgcccctgcctggttccagcacagaggggcaggaggtggctgggaggaggtgagcaagggacagcgtgtcggggcgggggggctccaccctgctccaatggggccatcagcttacagctgaaaggacttgggaaggaagggcttggaagaggggacttgagggagagagcccgctggcagcaacagaaccaccaccaccacacccccaccctcacactcgccctcacacatgctcacacccacacactcaccctcacacgctcaccctcacacacactcaccctcacacgctcaccctcatactaaaacatgctcacaccccacactcaccctcacactcaccctcacacgctcgccctcacactcacacatgcccacacccccacactcaccctcacactcaccctcatacgctcaccctcacacacatgctcacacccccacactcaccttcacactcaccttcacactccacacccctgccgtcacacttgccctcacacatgcttacacccccacactcaccctcaccctcacacaccctcacacatacacccccacactcacacccttacacctgctcccacccccaccttcaccctcacacacaccctcacacccccacactcacactccccctcatacctgctcgcacccccacactcaccctcacgcacactcaccctcacacacaccctcacacactcaccctaaaacgtgctcacatccccacactcaccctcacactcaccctaacacacaccctcacacgctcaccctcacacatacacccccccacactccctcacacccgttcacacactcaccctaacacgctcacacacagcctcacaagctcactctcacactaaaacatgctcatatctccacacacaccctcacatgctcaccctcacacatgctcacaccccactcatcctcacactcaccttcacactccacacccctgcactcacactcgcttacacccccacactcaccccccaccctcacacaccctcttcctcacacacaccctcacatgctcatcctcacacacacccacacacccacactcaccctcacacaccctcttcctcacacacaccctcacacaccctcacatgctcatcctctcacacacccacacacccactcaccttcactcccactcccacacatgctcaccctcacacactcaccctcacacactcacctcacacacacacaccctcacatgctcaccctcacacaccctcacatacaccctcacaccctcacacttcacacccctgcactcacacacacatcccaccttcacactcaccttcacactccacacccctgcactcacactcgcactcacactccacaccctgccctcacactcaccttcactcacactccacaccccaccctcaccctcacacccctgtcctcacactcaccttcatactcacacaccaccctcacacacactcacacacccccgccctcacatgctcaccctcacgtatacacccccacaccctcacactctttcacactccacactcaagcactcacactcattcgcatactctactccccaccctcacactcgcactccacatccccaccctcacacacccgttctcacacattcacacatcccaccctcatgctcaccctcacacacccccaccctcacatgctcaccctcacacatgcaccctacaccctcgcattcaccttcacactccacactcctgcactcacactcgttctcacactctacaccctaccctcccactcaacttcacattcacaatccacttccccaccctcaccctcacacccctgtcgtcacacattcacactcacaccccaccctcatgctcaccctcacacacacacccctgccctcacatggtcaccctcacacatgcaccccacacccttgcattcaccttcacactccacactcccgcactcacactccacaccccgccctcacactcaccttcacattcacactccacacccccctcacttaccttcacactcatacccttgccctcacaccttcacactcacaccccaccctcacacccttaccctcaccttcatactccacacccctacactcacacttgccctcacactccacatccccaccctcaccttcacacacccctgccctcacaccttcacactccaccctcacaccctcacacactcaccctcacacccctccaccctcacacaccctcacatacacccccacactcaccctcacactcaccttcacactccacacccccacactcacactcgccctcacactccacaccccgcccttacactcaccttcacacagtccacacgcccaccctcaccttcacacacccttgccctcacaccctcagactcacatcccaccctcacacacaccccaccctcaccttcacacactccacacccccaccctcactcaccttcacactcacacccctgccctcacattcaccctgactcacaccccaccctcacacaccccaccctcacacaccccaccctcacacaccccaccctcacacaccctcacactcacaccccaccctcacactcaccttcacacactccacacccccatcctcaccttcacactcacacccctgccctcacgttcaccctcagactcacagcccaccctcacactcatcctcacacaccctcacatactccatcctcacactcaccttcacacactccacacccccaccctcacactcaccttcacactccacaccttgccttcacactttcacacacccctgcccttacactcaccttcacacactccacacttccaccctcacaccttcactccacaccccgccctcacaccttcgcacacccccgccctcacactcaccttcatgctcacattccacacccccaccctcacactcaccttcacacttcacatccctgccctcacactcacaccactgacctcacactctccctcacacatgctcacacccccaccctcaccctcacactcacacacatcctcaccccacaccctcacacatgctcacacccccacacgccctcacacaactcaccctcacacacaccctcaccctcacacatgctcacaccccaccctcacactcacatgcttacacccatacactcacaccctcaccctcacacatgctcacacccccactcacacttaccttcacactcacacatgctcacaccccccactgacacaccctcaccatcacacatgctcacacctccccacaccctcacattcacacatgctgacacccccacactcacacgctcaccctcacatgctcaccctccacacacatgctcataccccacaccctcacacacaccctcacacatgctcacaccccacaccctcacactccccccaaactcacaccccatactcacatactccacaccccatcctcacacttatgctgacacccctaccctcacacacccgactctcctccccccacaccccaccctcacacatacgtccccaccttcatacacatacatacactcacatcactcaccccacaccccccacaccctcacacaccccacactcacgcccctacacactcccacaaccacacttgcatctccacttgaatactcatataccccatatttacacatacacacgccaccctcacaaccatccacacacacccccagactcacttccacatccccacacactcatacatacacataaccccacaatcacacaccccacacacccccacattcacagtcacccccacagtcacacttacatcctcacactcccactgatgcatactcccacaatcaaacccacacaccaacaccccccaccacacggacatgcaccccccaccctaacacgctcacagtcacacacgctcacacccatgcacacacaccacacacttagactcatttgcacactcagaccacactcacgctcatacactctcctggcacactcaccctcacctcacacatggactgctgtccaccagtacaggtggaccctgtttttttgtcacctcagatttggccaactgatgccgccaaggagtctaaaactgccccttctccaccatggctgccctgaccagccagttttggccgtgtccccagtgggggtcacctttccacgggatccaggacacgcgccaccttgcgtccgagaggacgaactgaaggccgtggcggcggtacgcagaaatgactcggttctcttaggaagggcactctgtggccaagcacgaggcatctgcctcgatgtgacagcggctcaccctcacgtagcagatctccaagaccaaaaccagttgctcacacctggatcttaattcccatgtccctccatgcccctgggacctggtggccagggaagatggctgagatggggccccctttcccagctagaagaagacagagtgaggacagcttggtctcccctttgcactggaagccccgcaacctcctggacactagccttcacctggccttgcttgtcgggtccatggcacttgctcccctcccgccaccacctgcaatggtgtccttcagcctaatggtgtccttcagcctagccttcaccctgctgatccccacacaggcccacagccactctgacgtctactgggcctgtgtgccagccaacctagaagcaggtgccagggtccatctgccccagctgctctccgaccccttcatttcctcctccacatcaagcttaaatggtacatggtctttccaaatggagagagagagataggaaggggagggagagagaggactctgagccttcaaggttggtgccttgacttggggcggggtgtacacaaccacgtgcagcaccttgtcacatcagggagggagtgtagcctgctggggaacacgagggaggagcctgggttgggtgaggccagggatgacaggagagatggaggacaggagagatggagaatgggagagaagggaggacaggagcgaagggaggacaggagagatggaggatgggagagaagggaggacaggagcaaagggaggacaggagagatggaggacaggagagaagggaggacaggagcgaagggaggacaggagagatggaggactggagagatagaggacaggagagaagggagaacaggagagatggaggacaggggagatggaggacaggagagatggaggacaggggagatggaggacaggagagatggaggacaggggagattgaggacatgagacatagaggacaggggagatggaggacaggagagatggaagacaggggcgatagaggacaggggagatggaggacaggagagatggaggacaggggagatggaagacaggggagatggaggacatgagagatagaggacaggggagatggaggacaggagagatggaagacaggggcgatagaggacaggagagatggaggacaggggagatggaggacaggagagatggaagacaggggagatggaggacaggagagatggaggacaggggagatggaggacaggagagatggaagacgggagatggaggacaggagagatggaggacaggggagacggaggacatgagagatagaggacaggggagatggaggacaggagagatggaagacaggggcgatagaggacaggagagatggaggacaggggagatggaggacaggagagatggaagacaggggagacggaggacaggagagatggaggacaggggagatggaggacaggagagatggaagacgggagatggaggacaggagagatggaggacaggggagatggaggacaggggagatggaggacatgagaggtagaggacaggggagatggaggacaggagaaatggaagacaggggcgatagaggacaggagagatggaggacaggggagatggaggacaggagagatggaagacaggggagatagaggacaggagagatggaggacaggggagatggaggacaggagagatggaagacgggagagagaggacaggagagatggaggacaggggagatggaggcaggagagatggaagacatgagagatagaggacaggggagatggaggacaagagagatgaaggacggggagatggaggacaggagagatggaggacaggggagatggaggacaggagagaagggaggacaggggagatagaggacaggagagatggagcacaggagagaagggaggacagaagagatggaggacaggagagaagggaggacttgggtaggcaccccccggagcaacggcagagtgttgagagcctggagtatttggttgcagagaggagatgaggctggaggaaaggcaggctggatcaccattggccttgaacaccatgctaagtttgggattgataaaagccttaaagagaaatataaagtctctaagagaggatattccctggccatgggaatggcctggaggaggagagaatgaatccaggcccaggctcatgttctagaacagcgatttgagatgccttctgggcataggctccacaggcctcagtggccatttggatggggcaggggtcagaacgaaggagaaaccaagatccagaagtttcaacttggctctagtggcaccacccccgagcttggggggaagtgatggaggactctagtctttaagcattgagtatgagatgcccatgaggaagacatgaagaaacgtccttgtgtcagaaatcagtgggactgagaaggggatatgtagatttgggaggaggatgaccccacaagacagaagagggtagtgccgacggcagagacctgggtggcacccaaattcaagggtgggcagaacaaatggcaccccaaaccctgccctcaaaaagagaaaggtcagagaagcaggaaactgggagagaactgtggcttagccaagaggagagggtttagaggaggaggggcccatggctggacatcccagagagcttgaggaagacggctgctgaggacccaggacttgaaagagggcagtcctggttcaacgacctggaacctgtggctcctctgctcgttgaaggccaggaccgaggcttgtccagctttgaggttcccagagggtccagccagggacaggcctatggcagctgtctatcagtgtggacctccccaagcctgaggtagacctgccgggctctgggtccagctcctcctgcggtgccagagcccaccccacccactgtcctctcccacagcttcccagcagtgtcattgcctccctctcctagccccttccaccaccacagacacaagcccagctctcttcccatcacaaatcaaccagccccaagcctccctgggcccaaatcccgggccagctctgctgtccctctttcctgcacagcccggatctggagagggctgtccacacctcctccccactctatgcttttgagccgctgcagcccagctctgatgaccaactgttcttgccaaggtcacagcttgctccattgaaagtccatttgcctcatcctgtccgccctcttgctggccttctggaggcacctcattccctcctgcttgtgtctcctttgcaagctccttttttgcccaccctttcccatgccgacatggcccctgccagcctccgacctgcactcttctcaccacacaccttccccaggtgaccctccacctgggtgctgatggcccccagccacttctctctcgagttccgatgcctttgctatacatctaactgccttagtatcacctctggtggttttcaggcacctcataccttgcgtgcccagaaccagccttccaagtccctctacctgcagtgtctgctcctgggtccccgttctctctcagcaagcagcacctgcactcgtgtggctggccagcccacaggctgggcttcatccttgatggctccatttccttcatgctccataatcaatccaccaccacaaccatcaatgctacatgcaatgcatgctccaagggtgccacctctctgtccccaccagccctggccaccaccctctctcctataccactgcctcctttcttcacaaaacagccagtaggagctgtccccaaatccatccaggcttaccactccttccagcctagaggtcccacttcatgcttctcccactaccatcggagcgaagccctgcattccttggcaggaaaggcccagggcaccatctgcccttgccacctccccagctcatctccctccaattcccactgatccccccatttcctgctgcactccccctccagccatgccaaaggtcacctggagccttgcatccctgccccagcaccaccccctctcctgtaagaccagctcctccactctaccagaaatttgcaccaaggtcctgtccttcggaggcctgtcccacacccctcctctggacctggggatctcacccacttctgctccagggcacttgtcagactgtgtgtactgcaatggccttttcacaagcacagcccccatcatccctgcgcgggtgaggaccacatctacctcatttgtcaggacatccccagcaggtgcccaatacatattcattagctgcacatcagagagaccagcgaggccttctttcctggggcctgtgatcctcagattctagccttgactttcccactccaggagttcctgagcacaagtttaactcaatgctgggctcccaaaggaggcgggacacaggcagtgcctcagaaccttgatgggcgcatacgctgcccaccttctgagaggagtgactctgctcagagcgggagaggtgggcaggacacttgggtcttggttctgctcttgttggaactcgccaggtgaccttgggcaagtcactttctttccttcggaaatagtcctcataacctgagacacggcagagcacggtcacatggcgggcatcactcgatcctcccatcaaccattttaccatcgtccccattgtatagaaaagggaaccaaggcccagtgggttcattgacatggccaagaccacccagccagcaattttaccacgcagcaccctgttcccgcacatcatctaaacacttttagatgatgccgaccaaggttttgttagcatcttccctctcccagggacctgttacactgcagacaaataagaatggcatcactccccgcccagcccttccagccagcgctggggtggaaccccaggtgttgacagctgtagagaaatgccggggaagagccagggtgggaaaccggaacaccatgatgggggtccctggggatatagtcctgcttgcctggtctgctggcctcttccctcctccacccaaggcagccctttggaggcctacgccacaggctgccctttatcaggggagcaagtgaccaacttccctgcctgttctgaggctgcaagacggtccactgctggtgggtctggcagggctgacttatggagtaatttctcccagtgtctggaagcagctttctgcccatgcctggggtcagggcaggacagaggctatggggaggggtatggcgagaccagggtcttcatggatggatcttttcattcttatgctgtggctctaagactcatggactcaaaggaaaagaaaaagatccttaaacaaccccttgatcaggagggtcttacaatcttcactgaatacagaaggaagcagaaacagagaggttgagtgtcttgcccaaagtcacaaggcagctcaaaagtggtgacgcaaggactggaccccagatctgacttgtgtgccctgaagagcagcacagtatgatctagtgtgatgtcctctcctgcccccggcaacttctcctgcaatccccatggctggtgatactgagctgcctgtgaaccatcagcacatgatatcttgggttgtagcagacccacagcttctgctaagcacaaaggaactcggcacagagcccccaaaggacgtgacacgttcctctgctcaagatgtcaaagaggggttgtggtggaaattgcatggcatttcaggcaaggtgatggaggaggttgttgttcccggactctgaatataacaaaagatggaaagaagctgctctgccatgcagtgggctccccgtcactagcactgtccacctagagaccagatgaataggctatgaggtcttctagtagtaggtagtaggtagaatagcattattctactactcctagctagtgggagggaattcatgacgtctacgtgctcaggacacgtccagcacaccgacagagcggctttgggtggattagcttgtgtatgagtgtcataacattgtaaagtggatatatttagttcacttggatatatttagtttagcatatttgttccagtaaatataagtggctatatttactcctaagaccaagtggaggctcagggcactagagggggatgggctggcaacatgatcaagcaaagcaggggaggcgtaggaggggacgcggtggggactgtggtgacctgggaggcagggcatatccctctctgaaggggcagtggctattcctgtcctgccaaatgtcacatgaagttgttacatcttccagttttttcaatgaaaccacagattcagatttttaaaaaaaaactaaaaatattagcaaactcttacactgggtgccaagcacgattttaaatgctttacatgcattacctcattaaatcacatgacagccctatgtgatggggctgtcatgattcccatttacacaggagaaaacagtcccagagaggttaaataacctgcccaaggtcacacagccagttaatggagtcagaatttgaactcaggtcacctggctacaaggttcatgtgcttaactgctgtgcaattctgttttttaaaaaacactgtgtaagtcaaataaaatacaagaggcggatccagcctggagctaaacttctggctcaaagtaatttccccaaggtcatatagctagtcaataggggcatgtctgaccttcaagcccgtgacttttcactccaccaagctgcattattttctgaaatgaagggatgaactcaatggcctccaagttaccttcttaatctgagattctatgtattaagctattctgcatttatattatgacttttccacctattattcatatttaattagaaaactcttgcatctcttccaagtctggatattttaaaggtttgctgcatttctgattttattatgatctggttgccaaatatgctttcctcccagggggcacacttcttgggtgtagtcagtcatgcaaagcaagaggaagatgtgacgagcaatgcacacactgttgctctgagacccactttggcgggcagcctgtgtccgtgaagtgaggctcagggccagttcccagaggtctggtaccctgggaggtccagccatggtgagctggctggcttgtccgcagtgacacgctgctcttcgagtgaaactcacagaagaatggatgtctgtggaaagagaggaaagtgccaggtggtacagcctgctgagctgtgtctctcttaaaaatattcagtggccaagaggtagtagacacatcccctggtggaaagtaaactggggaggccatgtgggtcatggggaaagttcacactggtttctgggtacaccccagattctccttttgttggggttctgcagaaactacatcatgtcataacgctcaggctgggggccattaggtgcaccctcagggacaggccactgtgccaggaattccacggcacgcaggcacagagcccaccagcacagtctctgttctaaacagcgacgtgagctgcaagcatgtgaatttactcaacagtatttcctaaggtctggtctgagcctggcgctgggccagggccagaaatataaagctaaataaaaccctgaccttggtctcaagtgtgactaacaggcacttaaaagatcgtaaagcaaagagatggaaacagtaatacagacaatgagcaaagtgctacggatgatgagaggaggaaccagtgggggtgggtgtcaggtggcttctgcagaagaaacacctttgtctgagactttttgggtgcacagggtcagacctgagactcctgttttatgagtctccgcctgagtgcagtgtggaggatggtgtgggtggggaggtctggaggccaggagaggctattgtgactgtagagagcccagctggacagaggcgagggcaagaggaaagaggacctagatatgagacagttcagcagtggcccgacagaaataagaggggagagtgggtcaaggatgccttcttatacaccttccagaaggattcttgctgatgaggcaagctcttgtcattttgcaggcttgctacctacagtggcattttcaccatttcctgggttttactattgtgatttttttaatactaggaaaacatcagctcccagtggcagcagctgggaagatggcagcagctcaggggtctaatgcccagcacagctctaagaatagcaaacgcctttattctacagaattggatatgataggtggaggtcctgtggagtgacttctgggtgacgaagagcagaggcctaagagccagcaagcaggcaccaagcctgggctgaagccagcttgggtctgtcaaacacagccgataccccatttctgaccagatagtggggttagggaggcaggcaggaatgggttgaaatgaaatgaaactgtcagaggagtggatgccttcactgcgaacattaggtggagttgctccagccatgagcagccctggcctgcagggttctagaacagtgacttccaatctgtgctccggattcatggggcatgggggtggggaagccgagcagtggggccctgggtcctcctcccccacccacagcagctctggattgcgttggttttcagagtgagtatgtatgtaaactgaactttgtaaaaaggagttatgtgaatgtaaaaacaatttgaaaattactgttagagaacattcatgcttggaagttccttaaaacctctgatgcagagaagcctgctgcatccttggattaggccattttcaggtggatcccgtccacaccctcccacaggtgcatattcctccggcaccaggggactcacagtttcccagcagctcctgcgacttctgggcagctctctcactattaagctgaagttgtcaacctgtgctcacacccatgctctgagctctgggcagtccagctcctccttcacacaagtctccaaaagccatgatgctgctcgagacttctttcctccagtctcagcatttccatgtcctcaaacaattccacatgtgagaaattctccccaaactgtccatcttctcccagaatggcccagagcacagaagccctcaggtggggctggacctagcccaggccgatgcaggaccatggtctcctctttccactattccagcctcactcccttatgtcccagacccagaatggggaagtcactaactagaccctgaagaggcgggagcctgtctggtgctccacaccacacaaatggccagagctgggagggctgaggcctccccagaccacctgacctcacagtgaccaggccctcgctatgtgccacacgctttccgtaggatatctcctttcttcttggttaacatttatgaacacttcttcttctcattattatttttgctaaaaaccgctaaaaaaagtcaaccagggtcataggtgaaacctttcatcacataaaaataaacagctacaatttgttaagtgctgactctgtagtaggcactttttacagaaattatatcgtagaaaccttggtacaattctatgatgacagtgctgagtacgaatagcaggtattgaggcagaaaggccagttggagactggcttagaaaagcctcagtgcccggctctaaaattcagccagcgtcttacaggtggtgaaggagaggaaaggaaaggtgtactgtcagaggtgggacctgcggagctgcagctggaagccccccattggggctgtgcggggcagcagccagagaggacactgaccaaggctctctctagtagcagctgacactatgcgtacaccaggtgcctggccaacgctgggctactacaacctgagacctcggtgttcctggctgcacagaaacacacatatgctgaggtacacattaggtaagaaaaggctgtgaacagttttaaatcctgcaatgagctcaaggtgtcagcaccatgaaggccgtgaaacagtttttgatctatctgaatggggcaaggtagccagggctcatgaaggcagttggttggcatctcttgcagctgtccttacagattaaacctgaagaacactgggttggggcgtgggggaggatacatgctcagaccccagagttactccaatctggaaaggagacggatagagaaggcattctaatttctgcatgacaacaggcaccttcttaccccataccccaagcagatctgttccccaccagttaagattacaggagaaacagggaccaaggaaaacctgtctttggacacctcaggtcatatctgtgaccactgtctcagcctcctgggaggtagctcagccaaaaggcagaaccaggcatggaggaagatccgggctccctttaagaaagagttttctgaccccagggctacaaacttggaaaaaagcaagcctgaatggtagtgagctccccaacaggtctagtattcaagcccagattaaatgacaatgtaagtctggggcaaaatagattctaatggtaggagctgggctggactccaggtccagcgggtttagctggactctaaatggacactgcaaccacactggtgctccagacataaacagccagtaggtgagtgggtgggaaaacaggaaggaagggagggtgtggtcacggctcagaggactgaggtggcctgtctgattaggacgctgcgagtgcagtggttaggcatggggtgttgatgcatcagactgccgagttcaaatcctgcctcctccgaccagctgtgtgatcctgagcaagcacccgcccatggagggtgtgctgatgctgcccagaggagaccagctatggctgtggctgtgggatggttttactattacacctcccagctgttattctcagactgagccacctcttccaatgaaagccctatttctctaatccactctatggaaatgtgactttcccaactcaaagtgggttttccttgcagcgagctatttagggatgcctgttgtgagtccttttgtggaaggaagaatccctttgtgagccccatggctgccctccagtgactggtgagtctgtgtgttgtggccgtgacaggctgtccacatcgcctccctcctgaatccccacagcagatctgcaggcctctcagcagatcaccctgcctggaatgctctccttccctctttctgatgaagctccagttctcccctgagctcagatccaaccccagcttctcagaagcttcccctgaccctgagatgggtcatgctctccaggtccaccttttctatgggcagtagaaaacagagctgggcttaccagacagaactcctgaggcggaaaccagcctctgtcccttattagctgtgtgaccttgggcaggttacttaacctctctgtgcctcagtttcttcatctgtaaaatagggataatgtcctatttcttgacctgtgggtaactgggcacaattccataggtatgttcactctgtaataactcatggttgtatacttatgacttggattgttttttgtatgtatgatctgtttcaattagaaaattactacaaaataatagcatatgctccaagaggtgttgcacattttacttagttaatataggttatgtgcttggaagagtgcctagcaccgagtggggctcaatcagtatttgctgtatctggcactctgccttgatagcactcattacagtcagattcattcttcaatagtggaaggaaaaccaagtgccccagatttcaataggttcagaagcctggagatgtctccctcacccacctcaaaagcgaagctaatggtttcgtgctaagaggctggctcaactgtctagccctggcaatattgggaccagttgatggagtaagaagtcacgatggagtctctctaccatctcctccttctctccagccatggccaggtttgcggaggaatccataacatgctgatggggatacagaagcccttggaagctctccaagatcacagccaaggggaccatgaacttcccaggacccccccgctggaggatgatggaaatgaccacactcatgccaggatggggtccgaggcgcaggaagctcctcacagagaagattcctttgtgcccatctctcctgatgagagtcttgtccccaggaaggtcaatattccgatgaagtagaagaggagcagcatgaggaagaggaagatgatgaaggtgacgaggatgtagaggaaagagaggatgcagacagaaacatcgtcacagagccacagtatcctgcagaggcagaggcagtgcaaggggatgatggcagggaacaaattccagggatgaagacagagccgccaacatggaatgtgaagcatttcagcttccaaactttgacactgaatacagtgctgaagagcaggcttcagttcctcctatgacacatgatccgtatgacacggagcttgaaccactcttccacttttaaaatggctatcagtgggatgcaggatcatggtccagattaacaatacgcagggggcaataaaagcctcaggaaagttaacctaactgttaggtttctatcgggataacggaggcgcaaaatgggtgacatgtttagaagaaactccaagatgaagaataaaggggtttgcttatctgcacttgacaaacatgaagcaggaatcccttggtgagatggtaggctggaccatgcgcactatagatctgtaagtagcccctcacctacccgctgccttaaatgtctgaccactcaaagtgggggccaaattagtgtcctcaccagcagaaagtggggtcgaggagtcaaggcacagccacgagctggcgtgattcagctcctgctcctgcctgctgatcctgtctcatcttcccttcagttcaaagtacttaatggtttgggcagttcttagcatgacagatggacagatggttttcacggaggtaggcagggtgaaaaatgtggttctgaaaagcttccagagcttgtatgtaaagatcagactgtgagagttgtcactgctggcccggctatccctcaggaaagccatttctatgaaaacttgtcagagattaaaggaggtggtaaccagttagcagagaacactttgtctcttcccagtcacatgtgggtaactggctgtgtaacctaggcccaggcccttgccctctctggtctccagccacctcactgactctacaaggcctcatagctccagggggtgagcatagacccctcaacacctgggggctccttatttaggtccttcctggtgtatccatattgagactggggctagaccctcttgagagctgcacagtgaacctgaccacaacccagatgctggaaacgagaaagcaagatcagaatagggaaatgaggtggaggctgctatagacgtggctctttggtctcctccaatgtaagcgcaggggaagtggagatgcttcttcgccgtgttgaaagtttttcgttgactgggatcagcacctcctacaatggtccaatctcctgctcagtctttgtcatgctgttctcctcaggccttcatatcttggagctggtggccttgctgttgttcattccagtcataagggctcctcctggtgctgcaagccataaaggattttacaggtcctgacacagccaccaaagggtcgtctttatcttctgttggagtaggaagcaacacctttattgatcagagcaccatgccacctttatgatcaagatgaagaggaacgtctctccagccccaaggtatgcctgtacctcgtggctaactggaccccacactgctcagccattttctgcatgggatagacagcagcagccgcaagaacacaaacgaacatctgtgatcctctagcactacagtgcattctcctcactccaggacctcctcatccttactagaaaccagtgaggggggttatgtcagtcctctttttcaagtgaggaaatggaggttcagagaggtaaagtcacttgcctgaggtcacacaaccagtgggcaggaaaagaagggcaccaatcccccctctttgaattgattaaacaccctctggctctcatggttgaagatgttgctagtgagagaactattctctagggcatggaataactggacagggagggggatgtctctccacagcaaaccctcaccataggccccagtgaagcaccacgaccacctctaccaccatcactaccatcaccaccaccatcaccgccaccactatcatcgctactaccatcaccaccaccactaccaccactactaccaccaccaccacctctaccaccactgctaccatcaccaccaccactaccacctgtaccaccaccgctaccatcaccaccactaccaccaccatcaccaccactaccactacctctacctccactgctaccatcaccaccaccactaccacctctaccaccaccatcaccaccaccactaccaccaccaccaccaccaccaccaccaccactaccacctctaccaccaccatcaccaccaccactaccacctctaccaccaccatcaccaccaccaccactaccacctctaccatcaccaccaccaccactatcaccgccaccaccatcgctaccatcaccaccaccaccactaccaccaccaccaccaccaataccactaccaccaccatcactaccaccaccaccaacatcaccacctctaccatcgctaccatcaccaccaccaccactaccatcatcaccactaccaccatcaccaccaacaccacctctaccaccatcgctaccattaccaccatcaccaacaccaccaccaccactatcgccaccaccaccatcgctaccatcaccaccaccaccaataccactaccaccactaccaccaccatcactaccaccaccaccatcaccacctctaccaccatcgctaccatcgccaccatcaccactatcaccaccaccatcatcgccaccatcaccaccaccaccactaccaccaccaccaataccactaccaccaataccaccatcgctacaatcaccaccaccaccacctctaccaccattgctaccatcaccaccaccaacaccactaccaccagcatcaccaccactaccaccatcgctaccatcaccaccactaccatcaccaccaccaccatcaccatcactaccatcaccaccaccaccaccaccatcaccatcaccaccaccaccaccatcaccaccactaccatcaccaccaccatcaccaccatcaccaccactaccacccctgccacagccaccaccaccaccatcaccaccatcaccaccaccaccaccaccaccaccaataccactaccatcaccaccatcaccactgccaccaccaccactaccatcaccaccaccaccaccaccaccatcaccaccatcaccaccaccaccaccaccactaccatcctcagcattcactggacattccagtcctggccctagtcacagagaggaacagtaacagggtctcaccagagccttgccatgcagaaagctgacagttggaaaatgcagaaagtagggctcccagttaatggcagtgaggtgtgaaggaaaggacacaggctttgaagccaaacacggctgagtgtgaatcccagctctgctccttacaacctgagtgaccatggcccctctgagtttagtgcttacttctgtgcctggagcatgtaagtccttcagtcaacagtgactgcagatggggtggagggtgggcagcagggcgggtgactacagctggaacaggctcagtccctggggaccacgtgctgcacctcaaccagtggtccccagaggtgaagttgttcgaggtccctcctgagtgtgcaaagtgaggactgtagtggagaaggcggggggctcaagtctcccaggagctgcctctctctaccccaatctgtgctcgaatcagctcccttcatggcctgagagtgggaaattcagggcacagaaaagcaaggagtgctcttctcagcaggctcagagctgacagagaagggttcccgagacagaacagatgcagctgtccagaggacctggcatcattctcagaacagacatgccaggaagtttctaagtgaggagcccccaggtgtggagggacctgtgctcatctcctgaagctgtgaggccttgtagagtcagcaaattggctgatgaccagagcagacaaaggccttgcccaaggtcacacagccattggcagcagagccaagactacaaacctagacttctgcttcttgaagcagggctgatgtaactgggtgtggccttgctacagatgaccactcactccttacatgcctccctgcatcaggcctggtgcccagtaaagaaatggatcaatgcattgtctccagaaagcttgtaggcagctctccagcagcactggcccggcctggatgcagtgtcacttgcaaatactacttaaagcacgtgtagtgcctttcagagaagccatcagccaggaggcagccctgtgactagaatcaagcccagatgcagtcattccaaatgacagaaagagaacagcacttgctcacactgactgcagatctacgcagtgctcatcgggagtggtgggaggtgctgaagtgtcctctagtctcctggcttttcatgacagccctgtgaggtagagagagctgtccctattctgcagatgtggacactgagctaagagaggcacagtgacttgccctcagccacacagctagtaggaggtgacaccatatcacactgaagatcatcctgcccaggcttgcggatttaaacttccatgttttaaagcatctacggattttattaactgtaccttccctgcctgtgggctcaaaagatggccagcagaagaagcatagtttgcctgaagcaaacagaaaatagtaaaagtcaagctaagggaaaataatcagtcggtcttggggtttggaaggatagctgttgacaagcaggcagtggcagggttggggagggccagggaggctccagggaatgggggtgcctggcctgggctttgaagatgaagaaggggaaatggccctgcaggtggaggggatggcaggagcaaaggcacagaggcagggatgcttgggatccaccgagggaatggcttggctggtagagcgaggagcccgaggaggtggcctggggccaaggcagcctccggcactctggagggacctggggaccagcacagactcctgctgggccaggcgttagggccaaccatgtggcagagttatagcaataccaggctttggggatttatttaaaaaagcccacagagcatttataatttacaataattgacaataattttcatgtattcattgccactctcccctcacaaaagtgagatgagtgatgtggcctcttccatttgatggaaaagaagcagatatcctttcctccacactccacggacaccttccacctgaccatgggctcccaggcccctcccaggctgcccactgcttcccctcctctctggccatcccccactccagcctccctagcacccctttcctgcacggtgctaatgctctgtccagcctccgacctttgaccctgccagttcctccagatggaacaatcctccctccccttccatccccatgcctttgttaactgccccaatcctcagacctcagctcgaatgccaggtcctcagaggtgctttctgagccttctgtgaccctcccaatcaatggcctcatgtgcaaagcagtccaggaggtgccagaactgggctgcaggactcagacaagctaatgtgtgtatgtgtgtgttgagcattgacatgtcccaagcaccatgcagtccttagaatgacacatgctgtggtagcgatcactctccccaccctgcagatgagaaagggattcacaggggcattaagtaacttgcccatgaccacatgcctgcgctcttggctcccagccactcctgccttcatcctgtcctgccagcttcctccaggtgctctgcaacctcagctttgtgtgtctgtctgggctccaagctgctcatactgcacttttttaagcaactctttttaaaattgtggtaacaaatacacaacctaaaatgtaccacttgaaccattttgggtttgtttttttttttgagaccgagttttgctcttgttgcccaggctggagtatagtggcccgatatcggctcattgcaacctccacctcccaggttcaagtgattctcctgcctcagcctcctgggtagctggtattacaggtgtgtgccaccatgctggccaattttttgtatttttagtaaagacggggttttaccatgttggccaggctggtctcgaactcctgacctcaggtgatccaccccacctcagcctcccaaagtgctgggattacaggagtgcaccactgcgcccagcccttgaaactttttattttccaactcattattttattttattttattttattatactttaagttctagggtacatgtacactaagtgcaggtttgttacataagtatacatgtgccatgctggtttgctgcacccattaactagtcatttacataaggtaatgctatccctaatgctatccctccccctgccccccaccccccaacaggccccggggtgtgatgttccccatcctgtgtccaatgtgttcattgttcaattcccacctatgagtgagaacatgcggtatttcgttctctgtccttgtgatagtttgctcagaatgatggtttccagctgcatccatgtccccacaaaggacatgaactcatccttttctatgggtacatagtattccatggtgtatatgtgccacattttcttaatccagtctatcattgatgggcatttgagttggttccaagtctttgctattgtgaataatgccacaataaacatatgtgtgcatgtgtctttatagtagcatgatttataatcctttgggtatatacccagtaatgggattcctggatcaaatggtatttctaattctagatctttgaggaattaccacactctcttccacaatggttgaactagtttacacccccaccaacagtgtaaaagtgttcctatttctccacatcctctccagcatctgttgtttcctcactttttaatgatagccattctaactggtgtgagatggtatctcattgtggttttgatttgcatttctctgatgaccagtgatgatgagcattttctcatgtgtctgttggctgcataaatgtcttcttttgagaagtgtctgttcatattgtttgcccactttttgatggggttgtttgtttttttcttgtaaatttgtttaagttctttgtagattctggatgttagccctttgtcagattggtagattgtaaaaattttctccaattttgtaggttgcctgttcactctgatggtagtttcttttgccgtgcagaagctctttagtttaattagatcccatttgtctattttggcttttgttgccattgcttttggtgttttagacatgaagtccttgcccatgcctatgtcctgaatggtattgcctaggttttcttctagggtttttatggttttaagtctaacatttaagtctttaatccatcttgaattaatttttgtataaggtgtaaggaagggatccagtttcagctttctacatagggctagccagttttcccagcaccatttattaaaaaagggaatcctttccccatttcttgtttttgtcatgtttgtcaaagatcagatggttgtagatgtgtggtgttatttctgaggcttctgttctgctccattggtctatatttctgttttagtactagtaccatgctgttttggttaccgtagccttgtagtatactttgaagtcaggtagtgtgatgcctccagctttgttctttttgcttaggattgacttggcagtgcgggcttttttttggttctatatgaactttagttttttccaattctgtgaagaaagtcattggtagcttgatggggatggcattgaatctataaattaccttgggcagtatggccattttcacaatattgattcttcctatccatgagcatgaaatggtcttccatttgtttgtgtcctgttttatttcattgagcagtggtttctttgtaggtctccttgaagaggtccttcacatcccttgtaggttggattcctaggtattttattctctttgtagcaattgtgaatgggagttcactcatgatttggctctctgtttgtctgttattggtgtataggaatgcttgtgatttttgcacattgatgttgtatcctgagactttgctgaagttgcttatcagcttaaggagattttgggctgagatgatggggttttctaaatatacaaccatgtcatctgcaaacagggacaatttgacttcctctttttctaattgaataccctttatttctttctcttgcctgattgccctggccagaacttccaacactatgttgaataggagtggtgagagagggcatccctgtcttgtgccagttttcaaagggaatgcttccagtttttgcctattctgtatgatattggctgtgggtttgtcataaatagctcttattattttgagatatgttccatcaatacctagtttattgagagtttttagcatgaagtgctgttgaattttgttgaaggccttttctgcatctattgagataatcatgtggtttttgtcgatggttctgtttatgtgatggattatatttattgatttgtgtatgttgaaccatccttgcgtcccagggatgaagccacgttgatcgtggtggataagctttttgatgtgctgctggattcagtttgccagtattttattgaggatttttacatcgatgttcatcagggatattggtctaaaattctctttttttttgttgtgtctcttccaggctttggtatcaggatgatgttggtctcatagaatgagttagggaggattccttctttttctattgcttggaatcgtttaagaagcagtggttccagctcctctttgtacctctggtagaattgggctgtgaatccatctggtcctggactgtttttggttggtaggctattaattattgcctcaatttcagagcctgttattggtctcttcagagattcagtttcttcctggtttagtcttgggagggtgtatgtgtccaggaatttatccatttcttctagattttctagtttatttgcatagagatgtttatagtattctctgatggtagtttgtttttctgtgggatcagtggtgatatcccctttatcattttttattgcgtctatttgattcttctcttttttcttctttaggagtcttgctaatggtctatcaattttgttgatcttttaaaaacaccaggtcctggattcattgattttttctgaagagtttttgtgtgtctctatctctttcagttctgctctgatcttagctatttcttgccttctgctagcttttgaatttgtttgctcttgcttctctagttcttttaattgtgatgttagggtgtcgattttagatcttttctgctttctcttgtaggcatttagtgctataaatttccctctacacactgctttaaatgtgtcccagaggtcctggtacattgtgtctttgttctcattggtttcaaataacatctttatttctgccttcatttcgttatttatgcagtagtcattcaggagcaggttgttcaatttccatgtagttgtgcggttttgaatgagtttatttatttatttattttttcattattactatactttaagttttagggtacatgtgcacaacgtgcaggttacttacatatgtatacatgtgccatgctggtgcgttgcacccactaactcgtcatctagcattaggtatatctcccaatgctatccctcccccctccccccaccccacaacagtccccagagtgtgatgttccctttcctgtgtccatgtattctcattgttcaattcccacctatgagtgagaatatgcggtgtttggttttttgttcttgcaatagtttactgagaatgatgatttccaatttcatccatgtccctacaaaggacatgaactcatcattttttatggctgcatagtattccatagtgtatatgtgccacattttcttaatccagtctatcattgttggacatttgggttggttccaagtctttgctattgtgaataatgctacaataaacatacgtgtgcatgtgtctttatagcagcatgatttatagtcctttgggtatatacccagtaatgggatggctgggtcaaatggtatttctagttctagatccctgaactcacaccagttagaatggcaatcattgagtgagtttcttaatgctgagttctaatttgattgcactgtggtctgagaggcagtttgttgtgatttctgttcttttacatttgctgaggagtgctttacttccaactatgtggtcaattttggaataagtgctatgtggtgctgagaagaatgtatatgctgttgatttgggatggagagttctgtagatgtctattaggtccgcttggtgcagacctgagttcacgtcctggatatccttgttaaccttctgtattgttgatctgtctagtattgacagtggggagttaaagtctctcattattattgtgagggagtctaagtctctttgtaggtctctaaggacttgctttatgaatctggttgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcttttttttcgctttccatttacttggtagatcttccttcatccctttattttgagcctatgtgtgtctctgcacatgagattggtctcctgaatacagcacactgatgggtcttgactctttatccaaattgacagtctgtgtcttttaattggggcatttagcccatttacatttaaggttaatattgttatgtgtgaatttgatcctgtcattatgatattagctggttattttgcctgttagttgatgcagtttcttcctagcatcgatggtctttacaatctggcatgtttttgcagtggctggtactggttgttcctttccatgtttagtgcttccttcaggagctcttgtaaggcagtcctggtggtgaaaaaatctctcagcatttgcttgtctgtaaaggattttatttctccttcacttatgaagtttggtttggatatgaaattctgggttgaaaattcttttctttaagaatgttgaatattggcccccactctcttctggcttgtagggtttctgccgagagatccactgttagtctgataggcttccctttgcgggtaacctgacctttctctctggctgcccttaatattttttccttcatttcaagcttggtgaattatcaaattgtgtgtcttggggttgctcttttcaaggagtatctttgtggtgttctctgtatttcctgaatttgaatgttggccctgccttgctaggttggggaagttctcctggataatatcctgaagagtgttttccaacttgtttccattctccctgtcactttcaagtacaccaatcaaatgtagatttggtcttttcacatagtcccatattttttggaggctttgttcatttctttttactcttttttctctaaactgctcttctcacttttttcattaatttgatcttcaatcactgataccctttcttccattggctattgaagcttgtgcatgcgtcacgtagttcttgtgccatggttttcagctccaacaggtcatttaaggtcttctctacactgtttatcctagttagccattcgtctaatcttttttcaaggtttttagcttccttgcgatgggttcgaacattctcctttagctcagagaagtttgttattaccgaccttctgaagcttacttctgtcagcttgtcaaagttattctccatccagcttttttcctttgctggcaaggagctgcgatcctttggaggagaagaggcactctgatctttagaattttcagcttttctactctggcttttccccatctttgttgttttatctacctttggtctttgatgatggtgatgtacagatggggttgtggtgttgatgtcctttttgttgatgttgatgctattcctttctgtttgttagttttccttctaacagtcaggtccctcagctgcaggtctgttggagtttgctggaggtccactccagaccctgtctgcctgggtattaccagcagaggctgcagaacagcaaatattgctgcctgatcctacctctggaagcttcatcccagagggacacccgcctgtatgaggtgatagtcggcccctactgggaggtgtctcccagttaggctacacgggggtcaagaacccacttgaggaggcagtctgtctgttctcggagctcaaacaccatgctgggagaaccactgctctcttcagagctgtcagacagggacgcttaagtctgcagaagtttctgctgccttttgttcagctatgccctgcccccagaggtggaatctacagaggcaacaggccttgctgaactgttgtggactccacccagtttgagcttccccagttgctttgtttacctactcaagcctcagcaatggtggatgcccctccccctgccaggctgctgccttgcaggttgatctcagactgctgcattagcagtgagcaaggctctgtgggcatgggacctgctgagccaggcgcagaatataatgtcctggtgtgccgtttgctaagaccattggaaaagcacaatatttgggcggcagtgttccgattttccacgtacagtctgtcatggcttcccttggctaggaaagggaaatcccctgaccccttgcacttcccgggtgaggcgatgccctgccctgcttcagctcgccctccatgggctgcacccactctccaaccagtcccaatgagatgaaccaggtacctcagttggaaatgcagaaatcacccgtcttctgcgtcgatcacgctgggagctgcagaccacagctgttcctatttggccatcttggaactgccctgaaccatttttaagtgtgcagttcagtggtattaagtacattcacattgttgtgcaaccattaccaccatccagctccacgactgtccagctccagaaaaatttccattttccaaacggaaactttgtatctgttaaacactcactccccatctcctccttcctccaagacctggcatccaccactctcctttctatctatggatacgactagtctatgtaccccatatcagtgaaatcatacagtatctgtcctttttcgtgactggcttagttcacgcagcatggtgtcctcaaggttcatccacgtgtggcaggtatcagaatgtccttccatgttaaggttgagtggtatttcattgcatgactagaacgtattttgtttatctgtttatccatcagtggacactggggttgcttccagcttttgactattgtgaataatgctgctgaacacaggtgtacaaatatctgagttcctgatttcggtattggtggtatgtacttggatgtggaattgctagatcatatggtaattctatgtttgtgatttttgaagaactaccataccgtttttcacagcggctgcaccatttcacgctcccaccagcagcgtacaaaggttccaatttctccacatccttctcaacacttattttccatgtttttgataatagccctcctagagggtgtgaagtagtatctcattgtagtttggacttttatttccctcatgattagtgaggttgaatgtcttttcatgtgatgattggccatttgtatatcttgtttggagaaatgtccattcatgctttttggctatttttaaaattgggtttttggattgaggttgttgttgttgagttgtaggagttctttacatattctggatatcaagcccttatcaaatatatgatttgcaaatattttctcccattcccagggttgccttttcattctgttgatagtgtcctttaatgaataaaagttttaaattttgatgaagtccaaacttatctattttttcttttgttgcctatgcttggtgttgtatccaagaaatcattgccaaatccaatttcatgaagttcttcccttatgttttctcctaagagttttattatagttttagctctcacctttaggtctttgatccattttgagttcatttctgtatatggtgtaaggtatgagtccaacttcaccttttgcatgtggatattctgcttttgcatcattccttggaaagactttctttccccattgaatagccttggcaaccttgctgaaaatcatttgaccatatttgctagggtttatttctgggctctctgttgtattccactgaactatatttctgtcttgtgtcagtaccacactgtttcaattactgtatttttgtagtaagttttgaaatcaggaagtgtgagagctgcaacattgtcctcttgcaagattgttttggtggttcaaggtcccttgctcttcatctgcttgttcactgttatacccccaacacctacaacagttggcacccaattaatatttgatgaatgaaaagtaaactatctatggcatctgtgtcatgtgctaggtattagggaccaagaccaatccgctctggtccctgcctttaaggagtgacaccctgggaggaggtggctggataaactgctggctgaacaaaacagcagtgtgtttgatgacagaatgcacaagttcagagggacacagaggtgggcaggttgactctgatggaggggtgggtatgggtgcggagggagatgagggcagtttcccagagggtgaaaacactgcactgggctttgaagagtttactaggtagaaaatggggtaggggcacctgcacagagggatagagtgtgcaaaggcattggggaatgaaggcgcaggctctggaaggaagcaaccagcctggagtcacctttggggggatggcagggagtggggtggtgaggttgaggagtgatgggcagggaacccaacctgtggggcccagagcctcgtctctctccaggggtggggggcagaggggcagccccagagggcttgacttctcccatctattacagagggtgtgccgggcacccaggtcagctgacccagtggttttggggaagaaagagaataaaggacaaagagtaagatcttgtttcaacggtgaccccagggtttggctttgccactggggagagattcacagccagcgcttggtgaggcatggcgagaacccccacccagcgagggctcctcacttgcactgagaaaacaagccctgcaagcctcacagtggcctcacagtagtgaggtaggcgctgttctctcccagcttacagacgaacaaatggagctacacggaggtggaggaatgtgcccagcgaacagtaagcggcagagctgggattgaactgggcactctggcaactgaggcacctatttctttcctgggcccccatttcctcctaagtgaaaggggagggagtggcctctcaggtgccccacctcctccctgtgagtcctcaggagagggatgatgccccccggcccaggcagcattgggaacattggagcatgccctatgctggacggccagtcctatctgcagagcctgttggagcccagccacctcctcactcctggaccttcctgctctggacctagaacttgattcccatccaggtgtctcatggttagactagcgtaagctacaaccctcaggaaaatcacagagcttagagcctggtcctgagctcgccagctacacagccccagaaacttctgaggggagccctggggagatgaggatttggggaagcctagatgctagatctgctgacattctgaaagtttgtaggagcttgactcctcctctttgtgacagggtagctcctcttccttttgtgtcagcctgcacccctcctggcctgctcttgggggaacatggcccctgaagactccaccctgggattcaggctgaataatgctcacattgcagaggagcttccctcggcctccaggcccttgtcagctgcctccattccttgtcactttccctggggatgcaggggaggtgcccagcctacccttggctctagtctctaaaaactttgtccagccccctggctggccacatttggcccagtctgccaactgcacctgccagctggtcacaaggcctaacccatagcctggcttctccctggctgccgtaggctctttttggctctcatgtgcagccctgtcagctgtcaccacattcttgggagcctgcctgcccagtaagcctgtcccactccatgctgccccactccaagactgctctgtcttctgctggctgctgggccccagcacacacctcccttgactctcttgacagctgggcctgtccatcttgggcctgccagccactcatgtcaacagatgaccccatccatagcacagatccaaaattccgcttggagctttggccccgctgcctcctttggtccaaggcctttcaccacctctcctggcctcagcagactccacttgtccagaagtctgcctggctggctcccaatgccctctgtctcttttaaagtcttccctcaattcctggcttccctggtcccccttcttctgagtcgtgctgtattatcatttaaggtttttatttagaaacatcacaaacatacaggaacatttttatcctgaaccatctgagagcaagttgcaacccaacgtccatttcccctgaattcatcagtgtgtatttcctatagccgaggccaccccaggcctccctggcaggacactttcctcctttgctcaggatctgtctccacggagggatgcccctctcaacctgcttggaatcctctggggctgaatatccctctgcaagggagccgaaggcacattaggtttccaacctgatcccaccaccacaccatctccttgccatcaagacagccatggaaggatggcacatgcttttgtgtacacttatcacatgttgcctcctacttccttcctcctgttggcatatactaagcgggggtcaagatgctggcttccatcattaacatgccatgttaatgcctccctgggctacagtttccttactggcaaatgaggaattacgattaagtgatttctgaggattcttttctaataataacagctgagttttatgaagcacttactatgtgccacgtaccgtgagtacttcataggtagcatcttggttaattctcataccaaccctctaagatataatcacagtactgttatctccatcttacagactgggaaaccaaggcacagagcagttacataacttatgctcaggcagccactcagagattctagattttcatgcaggtggtccagttcagagtttatactctgctgaaaagtaatgggggcagggggtggcactatccggaatttattatttgcctgaagaggcaatcagagaagtaaatattgataattcagaaaaagaggtcaactttctacatgccaagtacattacacacaaatgccatttcacttaatctgcaacaactttgagacacagcactatgattattctcattttctagatgagaagactgagccagagaggttaaacaacttttgtgtgaggcgcagggccaggatttgaacccaggtgtgctgttgtcacctagtgctaaactgggacacatgccgtgctcagagggcaggtcttcaaggatgcaggtcattggctgtgactggcaacggggttgggggcagagtaccaggccctgggcaactgtttcatgcatctgatttcattttatactcccagcactcccgagaagcacctccacccacagagcagggaaagacactcagccacactaagcagggaagatgtggctggagcttcatgcacccttgggatgcggccaggctggaaaacctctggcaccgactcacagaggacctcattgcctcccggggccaggacttcaccccgtggactgcaaggaactgctgaagctgctgggttgggtctcctttcttcatacaccacagcggaggcccctcctccaagagactccaggctgtgggtagagaggtgctttctctctcatccaggcctctgaggccagagcaccctctggagacttggcatctcctttgtgctcctcacctcacctgcaggtgttccagcaagctgatacccagctctgggctctggaaggaaagaattcccagcagatgcctcacctcaaaccagggtacacggccacggtcctgcccaataagaagcatcctgcagcaagctcagatgaggtcctttgaccttcaaggaagatcagcttcctccttatggagacaaggcttgaaggagcctgcatagctccctcacccaggccttttcggtagactctctctgagcagcagctcccaggatttagtgccaagctctgctgtttccagagctggaaagaccctgcacattcacatctggacaagccagagatagttcatccaaaccacatggcaatcattcatttcatggaagagaaactcacaaagagcaattgcagagctagtaatggcagctgggactcaaaccccagtcctccagactctacagcccaagcctcattcttacatcttccaattgcaaatgagaaaactgtgacccagaaagggtcacacaaagtctccagctccacggctcacaccacatgacctccctccctgcagaagacctcatttcaaacaatgcccgaagatggaaaaggtaaaatgttcttgtgatttgcagctaagaaaattcaggtggacccacactgaaccccattctcagacactccatctgtccaacaatccatatgtcactttttttttttttgagacagggtatcactgtcacccaggctggagtgcagtgatgtgatcatggcttactgcaaccttgacctcctgggctcaagcaattctcctgcctcagcctcctgagtagctgggactataggcacacactaccatgcccagctaattttttttttttttttgtagagacaaggctttaccacgttgcccaggctggtctcaaactcctgccatgatctcccaaagtgctgggattacaggtgtgaggcaccatgcctgacccatattcactttgcattttagttttcattgttactgtgcatgggtcaatgcatttacagagttggtgcagacttttctctcttctatgatgtgccgtccacacatggccaccaaagacacacaaagacagcatctctctcctccttgggcagaaagaccaccttagcctgaagaaaatcagaatcacgctagtggaggcaaggaagaaagaagagggaaggaaggaaagaactatgaaggaggaaggaagactccctttgctgaacacttgtatactttctgtatgctggacctgggataaacaagcccatgttatcttactattagttctcaaaaggaccctggaaacgggtgtcattatctctatttagatgaagaaactaaggttcaaagagcaaaggaactggccagtaattactggaagtgaggctagaatttgactctgaatcagttcaaagcccaaagactttctacaacactgtcaggttcccacctgtgcctccaagtcctagaagttcagggaagtgccaataggctcctggggtctgggggtggggctgagagggtgacctttcttgaagagttctttggaagaatgggctgcatggctaaaaaatatttgaataccaccttacaggcagtctttaattaaagatagtgggaaaaactttcttccttttcttttccctttccttcccttccttccttcctctctttctccttcctcccttcccttcccttccttccttccttccttccttctttccttctttccttcttttccttccttccttccttcctttctttctctctctctctctctctctctctctctctccctctctctctctttctttctttctttcttttcttttgggtataataaacctacaaggaagaggggaatgggataggagactaacagtaaacttttggaagctggaaagagatgaatgactggaagagacagaatcccaagcctgcagcagggaaatctgggaaccaatctgatttacatcccaggatccctcaaagcctctgcaggttggggtggagggaaccaaggtaaggacgattggtggaaagtcttgttagaagctgtcagactcccatccccgccccaactccagcagctcaggagactctccccccacccaccccagagaaagcctggaggtttcttctctgcacaagttgaaactgagcccttttgaggggggatgtcaggcacaatgagggcatggcaggggtgccataaagaaatagtgggggtcgggcgcatggcttatgcttgtaatcccagcacttcgggaggctgaagtgagcggatcacttgaagtcaggagtttaagaccagcctggccaacatggcgaaatcccatctctactaaaaatacaaaaattagctgggcatggtggcaggcacctgtaatcccagctactcaggaggctgaggcaggagaatttcttgaacccaggaggcggaggtggcagtgagctgtgatcatgccactgcactccagcctgggcgatagagagactccatctcaaaaaaaataaatagataaaaattaaaaaaaaaaatagtggggaggaagtgaatgcaatgcatacagactggctgcagagacccctccttcttcccctcctccctgactttttcctgcggcttccagaacatgggaagcagaccctttaaccaagagggagactgagtcttcatagggattgattctgctcaagaagaaaggcaccactgttgaagactccccgacgaaacagccccggcagtcagctatggggaactcgccgtcaaagagcctcactcatcacttccaatcatctttgagcccctccactcttaaacatgagaagacaccaaaggctatcagatgtctgagaaacgagaccaaataaacacacaataaaggggcacttgagagaaacagaaaccacgcaggaaaaaaacctaaaaacagaacaagaacaaagccaaaaacaccaagtaacattaataacaactaacgttaatagccttagagagataagatagtagagtctatcaaacaagaacaggatgccattaaagggacattcaagaaaaaaaaattcttgaaaactgaaaatgtgacagtagaaatcaaaaactccaccttgggaggctgaagagggcagatcatgaggtctggagatcgaaaccagcctagctaacatggtgaaaccctgtctctactcaaaatacaaaaaattagcagggcatggtggcgggctcctgtagtcccagctactcgggaggctgaggcaggagaattgcttgaatctaggaggtggaggctgcagtgagccgagatcgtgccactgcactccagcttggcaacagagcaagactccatctcaaacaacaacaacaacaacaacaagaaaaaactcaatagaatggatggagacaaaaatggagggacgtactcagagaatccagcaaaaaggcaaagcaatggaaaatgtgacagagggtatgaaaatcagagaaaacagataggagggccaaggcctgaataacagcagttccagagagagagaagaaacagaggagaggagataatcaaagaactcaagacattttcttaaagcagaagtcccagggtcaccagactgaaagagccactgagtgagaaaactgacccacaccaagacccatcactgtgagacgtcatgttctagggttgtagagaagatcctaagacaggaccctaaagaaggcaacaggactgagaatggacttggagcttttaagagcaacccaggaagttagatggcaatggagcaatgtcttgacaatactgaaggaaaatgatttccaccccagaattctatgatagatttcaatctactgcaaaatagaataaagacatttccagcattttcagatatgtgaaggatcaaagtatttccctctcatgcatcttctctgaagaagaccacactgaaggatggtctctgtaagatgaggatgaaaaccaaggaaaaggaagacccaaggttctggaaagagaagacccaacacaggaggcagagaggacctccgggagtgggtggagggagctcgctggatgagagtgcaccaccatggagaggggagccccggggcagtcaggagccaccagacaactcagcggagcccctgcctcagcaagacaagatgcacagagcgtcaggtgctgctgaacatctccaatgtcttgaggggaaatttgggtgaggcgtgaatctggggttgaattagtaacaaatgtatagaaaacaaagtgcagttaagcacacatacatacaatgattatacacagtgaaaacaggaaaggaaagtaatcatggtttactttatggcttggctgtgaattatttatgatacaacactaatgagaggatagggaggtggccggaggtggaatgcgaatggcaaaggctttggagcctgcagataatgctgaagctgagaagccaagtcatgggcaacccaagcacattatgtagagatatggcaaaccaagacaatctgccaaaagagatgaaaggtactgcttctgggagtggtgaccggtgggtgggtgggggttgggcagagagaaaatgtggggcaaagagaaagagtactgctgtttcccacaacaaaatctatggaaatatttgactctttaaactccagacatgtgtaactttgataaaaactgaaagacacacacacacacacacacacacacacagagagagagagagggcaagcgagcacatatgcctctgttctctaagaagctgctttacccacaggagagagacagagagaagccagcttcctcctgggagcccagcctgattccccaggacagaaacagaggccaggatccaggcagacagtgtccaggaccagaggatgctacatcctcgttgtagctctcaggggactaccaggggctgcccgagacccccctacccaggaacctaaggctgtacccgcttgaaaaaaagtctccttttaaattttaatacgaggcaaagagatcttccctgacagggctcagagctctggaaggctctgggtccagcatactcagacactcagtctgcccaatgatcaatatgtcttttttctttccacttcgcttttcacatttttttttaaccatccatgacttgggtttcacagcacatcatcagttgtctctgatgaccggagtgagtgttccctgggaagtcctttgagtcctcagaggaaatccagaaggccagcacagtcaccctaactagaccaacacaggagatttttcttgaaggatcatctttatggagtaacaacttttccaagagtctaagtgattttctgggtacagaaattttccactctggtttcaaaatagtcattcacaaatgcatggtgggtgaagacctcaagcccataggtggcctggaatagtgaaaagaggcctggaatggggctgagagaatcctccccactgcccacccccaaaccagcatcctctcttcctcctatcatgaccagggaagtgtcttcttctcatcaatgcccctgcaggtccccagggctttgctcctgccccctgccccttctctccttggcatcatcacctgccccttgctagaaggcattccttgcagcaaacacacatgaggacttctcagttcaaacacctgtctgctccagctcacactccctccaggcactgcttccctgatttgtgctgctttcctccacagccagtctcttaggacaacgcttacacaggcacctccactcctcattttggcccataccatcagggttccatcactatggaaacagcgcccatcagtcaccagtcacctgcacagggccctgttgaatgggcacgtgccacatgcctgtcctcaccgggctgagcctccttcctccttgaacattctcttctcttggcatccaggattcacacttggctgggtctcttcctgcttctctggcgattcctcctcaatctcttctgcagcagtgtgtctgtctgccctagaaatgctggtatcctgggatcagtcctggatgcctttttcttttctttcttctccatctcccccaagatggcccatcttggcccatagcactaaattgcatctatacactgacaactctgaagagtgtattcagcctcaggcctctcctctgagggccaggctcatctatccaattgccaaatgtctccctgaacatctccacttggcctggcatctcaaaagtcacatgtccaacaagttttgatctccctgtccccagacctatttttcacttccctcctccatcccttctcaccccataaagggcaccaccatctactcagtggttactacaagaaatacggtagtcagtctcaagtggaggcttctctctcagcctccatagtcatcagaagtcctatagctcctctttccatcttcactgccatgttcctggtctaaaccattgatgtctcacctgggctttcaggatcctgctcttcgtgctgccctgacaaccactactccttcccaaagtctgggttatattccccaggagagagggggcaacaggatttggaggtataaagaaaaagaggaaatagcccagtgtgggctcatgtgatgggggctggacacttcactccccagcccattgggccatgctcagagctgcacatctacatttctggggagaagcctgagaattaaagagagagcaaggtgctgggcctcagggataaggcagggccctgatagcctagacccaccccagaagaagagcagcccctcacccagagctgagaacgtaggacccattttctcggcttctagaacacaaagggctctgctcagagaaggccctggcctgggagctggcccacgagccatccctttctggcattatgtatttcatttttaccttgaacacctgcagagcagaatggtctgcaaggaagagtccttggctcccaaccccagagcctgccccataacagaggccatctgacttcaccttccccagaccaagcctgccttcaggctgatggatgggttctcactggcctggtttcgccttcgttgtgtccttgatccttcctgagacccagagtctcaattctgttcccagattctaagagctgcagagttcagggacctgccctctcacccaaggtctcagtcaatcctgagcacattggaggaagattccttcatttaatagatattccccagcactgcctatgtgccaggcactattctcagcactggggacacagcaatgaacaaaacatagttcctgccctctcacagagcttacagtctggtggaggaaacagaagcacactagtaaatacctggagaaaaataaagcaggaaaggaagaggataagaagtgccatggagtgtgcaaattcatcgtgggtagtgtgggaaggcttcactgaagggtgatggagagaagtgagggggccatgagagtctctggaaaaagagctccaggcagagagcacagcaagtgcaaaggccctggggcagaagcttgtcttacaaagagcagagcttggccaaagcccagggagcagggcgagagccataggcagaggtcagggaggagctggagccggcacatgcaggcccgtgagggcttcgggggacacggcgtaggagcggcagggtgtgtggaccttaacaggatcactcttgttgggctgagaacggaccacagtggggaaggtgggagcaggtgactgtaggacactgtgatcacccaggtgtgagctaccagtggcctgacccagaggttgggaaaaatgggcagattctagatacggtttcagggccaagctgccaggatttgctaatgatgtaagacagagtggctttcggtccaagcatctagaaaaatgaaactgcctatgcagaatgtccatcttgcttaactgaatgagtgactttgccgctctccttcagaagatgcctttccccactgatatggtttggatctgtgtccctgcccaaatctcatgtcaaattgtaatccccagtaatggagatggggcctggtgggaggtgactggatcatgggggcagtgtcttatggtttaacaccatcccctcttcatactgtcgtcactatagtgagttctgagatctggttgtttaaaacttgtgtgacacatccctcccgctcttgctcctgctccagccatgtaagaagcacctgcttccccttcacctcctgccatgattgaaagtttcctgaggcctccccagaagccgagcagatgccaggagcatgcttcctgtatagcctgcagaaccatgagccaattaaacctcttttctttataaatttcccagtcttcagtatttctttatagcaatgcaagaactgactactatacccatctttgaccacttaaaagactttaaagagatataaagcaagtgtgggtaatgggcacagtttgtctacctatgttatacatttcccaacctccacgccaccaaccctcctgtggtatgtggttttgctactgtttaggttcttagagtggcttactgactttattttttacacacctatccaaaaggctccaacttattaccacttatttaattcatagtttaatcaatttgttccccaataaatacacagaggtaacacatattcccaaagacataattctaaatctggagttcacagcaaaatgggactaggcacagcagatgattaggctgaaaatcatgctacacttctgggtttcaaagtccaagaagaaatggatttgtaaaaaaactattagaaaagaaaataatctttagattttttaaaactaacactattctctccaagctactatttcatgaaacacacaggtatgtgtgcacatacacaggcacacacacacacacttcaaaatgtacaaatgcactgtcacaaaaacgtgctgcgtacactgcatgaactcttaagacttggataaaaattaattcagctatagaaatagatgagatagaaaagtacactcgttaaaaatgtaaccccttcaactggaacagtaatgaattaaataaacttttaaaataatttctttaaggaatgtcaaagaggcctgagacacagttctgcagtatgcgctgtgctgtggacaaagggtgggttcactgatgtgcaggtggaccgcctcccagatacgaagttggatgcatgacccggagttcagaggagaagtccttggagatagggatctgagtgtcatcaacctgtagatggtgtatagatcacgttgggactgagtttagaggaagagcacggagcctggggctgggccatgtggagccctaatgttcagagatcaggcgatgatgggactcactgaagatggtgagaaagtgtaaccagtcaaggaagaggaggatcaagaaagaaggtgatagggtttgtctgtgtccccacccaaaatctcatttgaattgtaatccctataatccccatgtgtcaagggagagaccaggtggaggaattgaatcatgggggcagtttcccctataccattctggtgacagtgcatgagttctcatgaaacctgatggtttcataagcgtttggtagttcctcctgcatgcatttttccttcctgccaccttgcgaagaaggtgccttgcttccccttcaccttccaccatgattgtaagtttcctgaggtctccccagccatgtgaatgagtcaattaaacctcttttctttataaattacccagtcttgggcagttctttatagcagtgtgaaaacagactaatacaggcagtgtccaggaaaccaagaggacaaagtcctgcatggacgagcgaaggattgactgtgtcaaatgctgccgatggctcaggaaagaatagaagtgagaactgactactgacttctgcaaggtgagggtcatcattgacttggataagagcagcttctgaggtgtgaggagcccaaaggcccaccttgaataggtctgagagaagccaggaggaaagatacggaggtgagcaacacagtcaccttcttctggagtttttctttaaaggaaacagagaaatctggcaatatggcccttcagccaaagtatttttaaggtggaaaccttaagtctgggtatgcttaaggagcactctcctggcccaggagagtggcaatggctggagtgaggtactggggtaggtgaggtgggatgggagccaatgccctcccataggaggtgcagcagctgagtcctgcagcacgcagggtctggcatggactcctgggatctcaccatctgaacttatcattcccttcggacataagccccaataacacaccacccaactgggcttggtcagccaggtggttcctatcaattccagtctcttcctcttccgtgtaagcccactgggctgaattcccagctttccttgcaataagtgaacttgagttaagacaatatagtcattactctcaaggaacaacataactttgtgtgtgtgaaaacaacactgcttaacaaaaagccattctaaacaaccaaggcaaatgcacaggtgctgggtgagagagccatcacatccctgatgggcactcccaggggctgcctggaaaatgcgggctttgttcaggtgtggaagtgatggggaatgcagagggggccatgtgccaggaaactagtgcaataaacagagactgatgcattgtgtgtgcaaagcattaccccaggacccaagtcaagaagggacttgggaggagacagaaatggatcttagcaccagtgttatgacagaagtaacacaaagaactacagagtgtggagggatttgggaggctcgttagaggagcagggctgagtattggcttttgaaggctgggtaggatttggcaatggcagggcccagcaggcagcaaaaggtgaagggcgacaggaacaggtcagattctgaggccagcactcacaggctgagtttaaactggatcctgtaggtgaggcagccacagacggctctggagaaaagcatgacacaggcagaatcatgtttagtgatgctcagtggcaccaactttggagttctagagatagggtggccagagcagtggcagagggagtaaagagaccacactgagtcactgactacttcatgcagacaccaggattggggtctaactggaaagggggagaaggcgtccaagacaatgttaaggttctgagtgtgaagggctgggtgtgtcatctgagatctggatgtggaaggagatgctgttggtgggaagtggaaggcttggtttgcacatgctaagtgtgaggtgtgaatttcccaggcaaaaatgctcaggaggcatcaaaaccagtgtctgcagttcaggggtgaggtcctggctggagacccagatgtagcaatgtcggcacagagatgaggcctggggctaaggagatgggtgacactaccaagggagaatgctcaaggcaagaggaagtgagtctcactgatcaggtatgggagctgccatcacacctgtagcaggtagactgctgggcagcgtacccttcctctccacttgtctgggtctcgcccaccctctgggcccggccccacccactccgggaagccctctctagctattccatcccccaggcatccttcctttgctgtgagcttctcagctctggccatccccaccttagcagtgggtcttgtgttgccaccttggtgtagtccccaagcaccttgagggcaggatgacagttaacccccatgggacactgcattttctgacacagagcacccaaaaggcactgattaagtagatcctcctccctgatgaattaataaattgatcagtcactgaaatggaggtcaagaaagaaattaaggcaagtttaattagagattaaaagactcatatagcatctactcttttgtgtctggcttactgattcatgatgaactaggtctacatgtatcaacatggatgcacgtcaaaaacactgttgagtaaacataacaagttacagatgtatgttaaaccaatttgaatagtcatgagcactatatctaccaaatatttcaggttctcccaagcacacggtaggaatgcacttctctactcccatggagctaggtgaggccatgtgacttgctttggccatttaaatgtgagcagaagcttctgggtggaaccattgttttcttcttcctctctcagcctctactggcctggatctaaggaacagagctccatagcagatccttctcaaatgtgtacaggagtgaaatacatatgtttgttgtattaaaaaagaaagaaaaaaaaggaagaactgagtctaaggcaaaactgtgggattgcagaggagtgtgcccagtgattctgggtgtgggcactcttggcaatttgggggaacaagaggttgtaaggctggtggaatggaaggtcagcatctctggcctcgtccctgaaatgccagttatgtggcaaccaaaatgccctccccctccttcaccatttccaaacactctgcggggtgatgccagccccaagagaaccatgaatgtagaagaatcaccagaagtgagagtgggaggcatggtcccagcttgagatagccaggctgggggaggaaaggatctgacactataatcagttccatacgtgctcaaattgcatgtgacaagttgaaagggagaggataccttccatatctgacagaacagatgggactgtcccagacagagattgacaaaatggatatactagtagtaaaatgcaccaatgtccattttttgagcagctatgaattatagccttcatatggggtctcacaaggtcctctgaaaatcccacatgttattttcccccttttacaaatgttattctcccccttttacagataaagaaactgagggcgggagagctggggggctagtctcaggcagaacagaggtaagtggggcagagatgacagaactcaaccgagaggattctgaagcagagcaggtgggactaagtgaagacctggaaggaggtggagagggagtaggacccataccagctggaggaagagaagaggacttgtgggtgatgttccccctccttcagccattgcagaccgtgtaggtagagacatccagcagggagctgggcacggagtggctcctgccagctgcctttctggaggctcaggcttcctgaggtctcagagcacctgcctctcagggaagatgcgaacctccccgggcacacacagactgctgctggggcaagctcctgggacaccaggaaacactcagcagccctcagagaccacagagaacctctgaagcaagaaggaagagggccagtcgctgtgagcaggcgcttcatcaatcctgcctctgtgtggcctctaagggatccagtggcatgagaacacagagacacacgagggcgctctaaccaaacagcaggaggacccgcgtccctccccacacggaaagagggttggcattttcaaagacctttggttcagtgttttttcaacgcagctgctattggtattttaggcagtaggtttcaggggcatttgctacccctggcccccttcccatcattgactaccctgctgcccacatttccaagcaccctctctcctgagagcccctgctggtcagtgccaccagaagatgccaactggtggccctggggagggtggcagtctctgttgtcccccaaccttatggaggactcccgtgcctcccacgctgaccctgtgagttaggcgcttgcaggtgctagaggatcagaggcccccagtgacagccatgttggccccagctcatggggactgtcctgcacaggaagcgcattttcctctacgttgttgtccttcagggctgtgcaggaccaggccaccctgatcacaccagggacacagacacaggaccctgagacagaacgccatgggacctgctcacagacacccaaatcccaggaagcaaacatgtggccacacaaaacacagctggcacaaaacttccacaaagcacgtctgaaacacggcacccttccagagcccagacagtccctgaagctgtgagctctgaaacgtttagaccattcgtttcccaaagtcaagcatcaaaggtgaataactatgaatgagattcaaaatattcaccaaccattgagccctgggccccagccagtcaggatagggaccagtggaaacacctggtgcatacagtgtgcagtcagccctgcaaacagcctagtcggctgagcccaagtgccccatgggaaaccagacatgccaagatggccattgggcagtacagagatgacttttggagaatacatgtcaagagagacagaagtctggacatttgctgggatactgggatggcaactccaatgcaggaactagaaacctggccaggatctgagaaaatgaggggctggagaaagacccagacctctccagatcctcaacaaatacccagcatcacccatccccaccaagaagccccacggcattcttaaacagaggggcctgagagtcccaggaaggtgatgtctgctgaaaggcatcgctgggaccacagggcacctgtgggcagagcccttgccaactgagccactgctgcccgtgaacaccaatgggcaccagctcttattccacggaagcagacgatggaaaccaaacatgagtcttaccctccttcgaagattttgatcctcgccggctcccctctctgggaggcaggagcatcctcctccggctcccctctcctctcttcttccttctccactctagctagatctttctggccttccggggaaaccagtgaagggaggtgaacctggcccaccgcaggaatgacaaaatcattgctggttaaaagtgcatcctcagtcacgaatgcaatgctaataatcatgccttacacagtactgcacaagtacacatatgcaatcttcacactcccccatgaagaggtgctattagctccactttacagaattaaggaaactgatccccagagagaattcccttatccaaggccatgccattagttggtgttacagctggaaccctgtctctttcatgttaacctcccataagacctgtgtttgttctctgtcttttacactagtctgggaactcctggggacaggtcctcatcttggtctccttgggcaccccagaaccccatacagggcctgtctcagagaagaggcttaaataatgttgaacacatgaacaaggctccactctgcctttggagatgaactggtccagttcttgtttatagatcagaaagctaaggtcacccagcgagttaagggcagagctgggagcagagcacaggtctcttgcttccaggatcttggccctcctgagctagtaccaaaggccaggagctgggctgaggaccctgaccagcaggacgtccccaattccaccatagagacaggcacagagaggctgtgcaggctctgggctgttagtcctgcaggacccacgctctttacagagccacacctcagtgatgagagctagcttaaggggagagctggcattggctttgtgcttcctggacatcttccactatcccaagaacacgtcctgtaaacactgcagtgttgtcaggggtgggtgcacttttgcctagggagcagaaatgctgtgcttaggggctgggagtgagaatttcctcctacttcatgccactgtcattaaggtcatgaaaaaccatgctgtttccatccagtgaatgaagcaaccacatttcctgatgctggggcaatctaagaacggcagtcccctttgccagccaccacacctgcccccacaaggacagcatggggctaggtagaaaggtgactggctgggaatcagggagtctgagttccagcaccagataggccatggcacactgggctgccgtttggtggatgacttcacctctctgggcctcagagtctgaggggatttagaccatcttgaagatcaattccagggcaacttctgtgactcagtgaccaccaaataatctcttcagatttggaggaggggagtggaaaccgagcaagaatctggactgctgctttggcagaaggcagctagttttctgcaatacccttgggtttccagagcctaccatttccactgcaccccggcctgagatctagactgtccatgtaatgaccaaggtgcctcccacaggcaaacagactacttctccctcacagcctgccgtgatatctgggccacactggaggaggctggtttgggtggcagtgtaccactttcccaggaaacacagtgttggaactgagcagggaccagggatccattttagcttttgatgacaacaatatgaataagtatagttaaaaatacttactgagtgccagtgtggcatacactgttctaagcacactccgcatgtcttaactcatttaattatctccacagtcctatgcgctaagtgttattattatccctattttacagaggatgaaactaaggctcagagaggtgaagttattggcccaaggtcacatagccagtaggtaaggtagtgggattcaaacctgggcaacttggtacctgagtccttgttcttaatcactttgtgacagtgctgtgttgttgtcaaaatgattcccaaggaggaaaaaggaaagaatgtggctacaaagtggactctgaacaagctggggtttctccagggtttatacgtggaagaaaagatctatgaccaaacaaaaacatcatggggtgtcctagacctgcatgaagatggtttggaagagcttcaaaatgctaagatagacctaaggactttttcagaactactaacagagaatggaagccgcaagctgacaaatgtcagctcagtacagtaaagaaccttcttagagcactgtccaaagatgaattggactgcatcatgagatggtgagttcctcttgctggaagtatgcaagcagagaccagagagaggtgtagttgtataaaaggccttaagccatagaccatgtggttatactaatgtaccagattggtgcaattctggaaggaaacatgccagtgaaccaaacagaatattccaagaaaaagttcgcaggttttaggagcactataaataaataattgccgaatccaaattaacacttcctttctcttaaatggcctgtaacattttcagtcattagaaactagaggcagcttagataattcaaaagggcattggagtaaaatctagttttgatctaggctctgccatttactgtgtggccttgtgaaagttacttaacctctcttgtgttttggtctcctcatctatgaaatggtgatattgcaccctaactttcaagttggttgtgaggagaaaagtaacatttagcatagtacttggtacataataggtatccaaaaagttagcagtatgaataattataacagcatcttgggagtggccacagctagtaagagacgctgaagaggaaattagcaggacattaacacaaaagtggaaatcttggtcagggatgtctgtagactgacaaagacatctagggaataaatttggaaaacagttctgtgaagaacatccagtcaagctaaggacaaattcaatgcacaaagttcactgaatgacaaaaggggaagatatgagagcacaggaaattatagaacacagttgtgctcacttatctacaatatgaatttggtttagggaatttagacctaatttggtcagagcttctggtctgaagacacactaataaacattttttaatttgcagtcaacttttaagattttctctcctcaaataattaaaagaagaaaaatagactctttggagtcagataggtctgggttcaaattctgggtttgttcaacatttgccagattatcttgacctttctcagactctgaccctcagttccctaagctatagaagggagatggttatgttacttcagaggtggaggtgagcagtgaccagattcaagggcccagcacagtgtctggcaccatgaggctgctcagtaaacaagaccagctgttattccacaaatgccaagtcagcacaatccaaatccctaggctggccttgtcagggtatggtggtggcttttgtctgacatttgaaattattgaatttcaaacttgctgagctttcaggggacgagttcattttatagctcctgatgtagcctcagatcaaaggcaatgaaagcgtaaacattagcgtttcttgaccacgtagcacaaataggtcaaactgtgagtggcattgccatccactggtaaggagggatactgcagctcagctccatttgctgtcttactcccagaaaaggaagaaggaatatttcaggagttgtttgtgccaaattctagaatcttggaaatgggaagatttaaagtggtactagagaatggaaacagcagatgtaagaattaagaaaagcaggaaaagactaacaagacaagggatatccatataatgaaggagaggtaaaaagttctaaaattgctacaggcattcctgttagccaagttttccaactcagtcttttggaaaatttcttttttttcttactgagactgtatctttgatttcacaacagaaattcatggcagagcaggatcactttatggctaactttattgaagtgtatctattccaatgatatgagggatacagtgacaaagaaactcaataaacatgtttccttgtaaggtgaccagtctcagctttcagagaggaaatctgactactagtctggctctagttctgcaactggaacctgaggatactgtggctttaaaagctcgccaagtgcttttgcaaatcagtgatgagaagaaaaacaaggctgaacttacctctgtcatgcggggcttgcgggagctggatggcacaagccttcctgcctcaggatgcggagctgtggccatggtgtatgtctctttgctcactttctgcttagacctcaggagggacaaagcagctttagtggaaacccccggaaggttggggttgtacaaacttatgcaccaaccagcgtaaacagaggacctcctatctgcatgctggatgtgatttggcttaatgtagtttaaatagcaccaactgacattagtggttgtgtggaggctggggaactgcagtaccttctttgagtccgtaccttcttgtgacttggctggtctggaggacgtttctgacagaggcagagagctcggaggtgccaaggaggggagatcaggttgttccttggaatcttctttcttcacgctcagtggggtcaaccctcttcggtgaggtttgccagatggctggggatattccttcaaagcttctgagcctggggctgtcccatgggacaatgcagggtgagggaggggaggaatttcctttgtgtcagatggatctgaggacaggctggacagcatttctagctccctcctgccttggccctggttgcctaagtgggatttctctggcctcttcccatcctcggtgctggtaaggaccacactgcatggttttaccagctcaagtttttcatctgccttggaagcctcctcctccttcactcttttttgctgctgggtttccatggtaagttcaaggctgccagctggtgaaaggacacgtttgcttccccctgctgttgatgaactcccctccaggctcaagatactctctgatgacagggaagtgccttttctttcaggtaatgtcacaggcactctcaggtatggagttgggaaagctctgctttgctcttcacttaacccagaagggccgggcccaacctcatgcacatctgcaccacatacagtcgtcccctttgatgggggttcctcaaacttgggaagtgccacagttgctgagctgccttgggactgggtgaccaagatctgggaaagggtggtgtacattgcgctcccataggacggcatattggtctgaacacggacaggcacaaccagggacaccatggtgtctggacaggcaggcagggccagtggaggagctgatgtaggtgctgaggagctggctgggggagccacagggggtagccggatgtcactgctgtactctgtgctgggggagaggccagcacttcctgttgccagtggggccaggctggttttgatctggggcagatggctttccacatcaccagggagctgaagtgcaaactgggattgcagaggcaggaaaaacccagaagacagtgctgaggaggtcgggtatggcatggggaggaaggaagggggctgcctgaaggggatgttggctgggtgaggcatgagctgggggagatggagttggcctgggtgcagaacagtaggctggagaggaagcggtggggcttgaaataaggagggaggaagtgggggcatggagtatggtgaggacaggaggctggacatggcctgggtggagaagaattctggagactgtcctggctcatgctgcacgagatgctggaaggagaaaagggagactggtgggggcaggtatggcttctcatgcaggggtgtctgggcaacggggtggtggaacacttgcagtgcttctgtgtagggcacagtgggccccaatgggggcctgtcctgccctgggcccttgcctcccgggggtccaccatgtgaggtggccgcagaggaaatctgggacaatgagcttttggcagagggtttactggatgagggctgtggttcttcgctctcctgtcttcccttgggggcaacctccaactcagattctggaggcctgctcagagaggcctgtctcaccaagaagcattttcttctctctggcggggccacccgcgctggtggagccactggggctggagcagaagggcctgtcaaggacaagctgccatagtcaaaggatttgctgcgtgtctcggtcatgtgggcagaatgggaaacgttggggctctgctctgaggctgacctccgcatctctcgggcatgtgggtggtggctggggacagtcaacatgtgggtgcccaggggtttggggcgcatgtcagatgagggactgggggcctcggctttcccatggtcatccctctcaaacgaggctgagcggctggacccactcaaagagacattgctttcctggctcgggctgcgagacagaggcacagaggactcgaagctggactcccctgatgattgggccatctctgccaggcgcaacctcttctttttgggtggcagcttctcagctgggagctgggcaagtgtctggctgcgctggggccattggaactcctcagtcttctcaggttccttagggggcggctctggctctgtgtccggccggtcaggctcctcagttactaggatctcaggaacctgaatgttgggctggcggaccaacttaggctgcagggagtgagcagagcgtccgtgtggggcaggtgggggtgatgggaactgggccagaggtttgtcttccccttccaagccactcggctgctcgagagaatcagatttctcaaaggagctggtgtgctggatgacagaaatttctttggacgttgttctcctctccttccctgattctgaaccggaccctggcttgggagtccttggctggaagcccgtgggtccctccaaggagggcactgatttacttggttctgctggtgacttggtggactccaggggaaggttccgagcagcatcagatggcccggggctgccaaactgactttttgtggactcaaaggcaggtggctcttcctcgtccccaaggctcttctctttcctcctcttcctcagtggagtgagttccagggtggttcccagtttgtaatgcatcatttgggaccacggctcatgctcaatctgactcttttcagcttctggagatgtgtgggtgcctgcagagatgggctttgcgatctgaagctctgagcagtagtattttttgtgggcttcgtagttatcccttttcttgtaccgagcaccacatatgttacattcgtagatcaccccttttgttttcaaacccttcttggtctttttggtaagctcgctttccttgggttccacttcgtccgagggcttggaggctgtgtctttgctgcttgggccaggctcctcagaactgtattcccctcccaaaggtaattcgattgccggctggcgcttcagcatccgggggtgggaggtaaacacgtgactgctgtggctcagggcttcggagtcggtgatatggtcatcgaaggagtagctacctcggaaggggtggtggggggtgctgatagtgcaggcggcagaaggcattgagtggcttctcaggagaggcacagggggggcggtactgggcgggtgctggaggctcagcagtgattgttcaggcttggttttctcactgtgggatgacaggggctcccggtagaggctggattttggggactccatgctgctgcgcctggacagtgagctccgccttggcttcacgctgtcgatctcgctggtgtccaccacggcctcgttgatggtgatgagcttcgtgatgtgctcgatcacctgcgtccggggtacagacaaaggcaccaggctgggcttgtcttcggtggacaggggcaggaggggctgggtggaggtggctgtcagcatggcggtccgctgtcctattcgcccacacttgccaaagatgatctcagcgtaggacttggcgttggtgtttggggggctgacctgctgctctgcactctcggagcgagagaaatacccagactcagtactccctttgctgcctgggctcagaaacgcctgctcatcgatcaccttcttcctctcgcttaagcggagggccagcttctgcttaatcgtgtgggtgtcttcaggtttatggctcagggggtgctcagatgagggttccacaaatggaggggggtcttcgagtgactgggctgtgctggactgggacagggaacagcgttcgtggctggaactgtggctcccagagctgtatagcccgctggagagaaggggctgcttgggtcttggggagagctctgcagggtgaccagaggtggcactagtctcctcttcagaatctgtgctttctccctcagtgggctcctcaaactcttccccagggatccgctccatctccagcccatgtgggtacatctcgccacccatgcctgaggccaggcctgctttgatgcggtgggcatgggacttcctgtgcttgtagagattactcttggtcttgaaggagaagccacaggggccgcaggggtagggcctctcacctgtgtgtgagcgaatgtgcttctggagcacgctgggcttggcacagggccggctgcagtactggcagatgtacttgcctggcttctggggcttcctctccttcttgtgtgcctcttctgtgggcttcaaggagacctgggaaggacgaggcacgaagactttggggactccaggaaggtcctcggggggaatgatggaagcgtgggaaggaaggagctggctctgaggatggagcccaggggccacgaaggagccagagggtccaggtctcatggggtcaaccagttgccatgtggacccctccaggagatgctcaggtttgccaggcgacatgaatgctggtgtcagagggtgctgcggaagctgtgagatgtggacggatgcttcgatggggggccttttggggggcttctgctgctggcccgttttctcctgagagccttccctaagaactgatgaggggcccgggaagggctgcggggctaagagctcttgggcggggctctcttgggtggcagctgtgccgctgcctgggtatgggacgctggaagaaacactggtctgaatggcctctcctttggtcagccgcttccggggacttccctcagccttcttggtgcccttgacactttgttcaggatccatgaccttcacaaagacttcagatgctattcagggagagtcagggcgggctgcatttatgaataatcccagtgtcccaaggaggtgtccagctttggccacattggtcaagagctgtgggagccaaacccaagacggctttgggagttttttgcaagtgtcactggctgtgagtggactcggagcaggtcatcagggcccacgctattctattggtgaggcatggccctctactttgcagacagaaaacgcaccagcactttctgcctgaatgtctgtcgggaaaacgtcatgaaggatgtcagtattgccattgtattgtttcagctggcagtggcaggtggcccccacgagtcccccgtgtgctatgcaaacggttgaaggttggagacatctgtgtccatggcccagtcatccctggtcctggcacaagagatgccacgctggatgctgggggtggctcttctcccctttagttctgggttggagatcaacggccttggaggagaaatcacgctcttcttctgtgtgatagatgtacacacacacagaaatacacacacacaaaagagaagacagagttactgggactcatgcacagcctgggcagcccagactcggtgccacacctggctgagacccctcaaaagttaaccagggaaactcaagcagaaccacaggctccggctccacatgtccaagccctgcaattctttcctcccccgctcccatgtcagtgttgggtgacctgaatgccagtgtgtttctgaggactgtggccatgtgggatgctgagaacagaaggcaaagtgggctctgggaactgcagggtggttagggacagaggcctgggctctcatctctgttttgtgatccactctgagtgggtctaagctctctaagcctcagttgcctaatcggtaaaacagataacaaatcctgcctcgactgtgcctcggagctgcagtgggcccaatgacattggagatgcagatgctgctgggtgaactctggatggggccatggctggtgcaggagggaagtgcctgtggtttattcaggggtgagttttccaaggggtagattattctcaggttagtatttctctctggccctgggttctgaaagtgtccacaagggacatcattcactgctttttaccccattgctaacccgcaccccagcccatgtttgaagacaaaactgcaaactactgccacagcctgtgagaacttacaatctgacacagctgtgaccatttgcttgatccaagcaattgccaggaggatcattctggaaggttcctctggctttgcagcctttccttgtccagtcagtgccctggggatgccatggaaatatggggatcattgccctcaagtggaggagcaaagttggtctgcatatagccccaagtgtgtgcctcctcctagggccagctgcaagcagggcagtctcagcttcctgggctcaggtgcatcctcagggccctcctccccaggaacagggtcggaatcccaaggctggagtcaccatggactccatctcacccaaccacctgactttggacatcatgaagatggcttactgaaggtcccgtgttgctaacaggcagtgttgccacctggacccaggcctcccatggccagagtttgttccccagccccttctcaggtgtccatcccctggcatcccttggcgaggccctgggtgagtgatgagcatctctgtgcttgctttttctcctgtgagcatgccctacccccggcatcctgccctcaggctcccctcatgctcacactcttcgtttcactaggtgtgtgatgatacagacttgaaaatgccacttactacatttttgcaggtgctcagaagacgaacaagtctttaagactcaaataattgtctcttaaagggcagggccctcggacactgtgatatgctttggaggagcaggtgatttgatcttttagctaaaaagcatatcctctaagttcactccttttgtgtgccttttctacttggtgctacaaagaattcaaagtaactataacaaaaccatatttatagaagaatgacaaactataaatatgagaaaatcataaataagaataacaaatcagaacaaagaaaatggaaataaggcaaaaagtcaggattggtgggataaaaagagtactgctataccaataataaggacttatggtgtttctataattcagctatatatttatatatgagcttcctggcagccaaggagaaaagggagatttggtccattatggagtcttatagccagacaggatggaacatctaagtttcttgcaaaactttttcatgtagcacttcagtcaggagcagtgaatgatgcaggagatcatttatgtcttcaatgacacccctctggtcattgaatacagtgacggattcaatgacatccctctagtcattggatatggtgcaaatacagtgattgatatttgtcaatgaaagactgtgtatcagcagagattctcctatgagcagtcaaaggcctcctgtgacttgtaccaaagcaggctgagtgtggggaagacagacaaatctcatttcattagattacatctcagtcaacagggtggccatataagataccatccaaactgggacacttggagaatgaaatgggaactactaacagtcatcgaggaacaacaggaataaacaaagacagtcccaggcaaaccaggacaaaatggttacccttacaattaatatttgccttacggccaaaactaggcataagtgccaactgtctctgggtgtctcatacatacttttgatctcttctatggagactaaagttacaccgtgatcttctgatagattcttagagactgactgtctagtccattcctctcacttgacagaagagactgaaggctagaaaggtgatatgattttccctgaaaatcacacgggaatggtggcaggactggaccatcctgtgcctcttgaccccccagccaggactgtctcccacctcaattaatagaagttctctgtggcttctgtggcatgatgcgcactgcagtctatggcccctagtcctatggaagcaccggcatggccccaggggacatcgctgtatccacggcaagagggagtaaggaattgtctagcatctgaacaatagagttgccctttcaacctatgtcctaaccacactgcagctgctggacagaagaaaggggagcccagcaaaggtcggggaactcgtcctggcagccttaccccaggtcttgcttacctaagctaaggcgggcagaagtgctgagccttctaaaaatcagacatggtagacatggtttgcagcacagagagaactgctctttgggctgggctgggcctcctcagcctggctgcactgtgatggagaggcctttgggtgctatgtgtggataatcaagggttggctatacttactattcttattgatcctttcatgcaaggatctgagagcagccccaaaacaccagctagtggtaagctttgcttcttccgatggatggatgggaccctgcagcatgactgggtggtgaaatgatcaatctgagtgggggtcagctggccaggcaggactctacattgcttagtcctgccttctcccctcactgagccacaaggctctccttggcaggtggtggagcgcccagcagctggggtttggtgcaattcccagggccaggtgggaggggcagggtagatgaaggagacagtcagatgactgctgcatcatcagatgactacagggccagcactgcctgcccagggtcagtgtccagcctgcacctgtgggctggacatggtgtttctccaagcagaggcctcctacccacacttctgagtggggagcaaaaaggccacaggagcaccgttggctgccagggcgcagagtgagcgaggcctgtgagctggaggggccaccctgtcattctgcacaacaggcatctgagccatggtggagggtggctagcccaagccacactggggcttggacttctggactagtgctctctgccagcctgctctaccacaccatgacaggtctgaagtgcttaagaggaggggcagggggagaagggcagccaggaccacaggtgcagatgtaggggaacctgcaggacctaaggagacttctgtcttggaatggattccaaatgtggtgcggcataaaccgaaggaccgttctaatgactgtgaccaacagacactaagaaaatggttcttttctaccttctgtggttctgagggtatgtgtgaaattttaacacaaacttgaagtgataaagaaaagagccacttttccagggaattggtgagagcacctgtaaaagtcaccagagaaatgggcccaggagctgggccaacagaggcctgaaccccagaccagaagaggatggacagcctctactgatggtcacagaatgggccatgaggccagtgagagctctcgctcagagaccagcttataaccctgaggggaacctgagcttcagcagccaactggttagctcccacttcaagaagcttcctttggtctagctgtgggagcagcccaataggaaggagatcgggacttgctggggttggagccacaaaagcctcaggggagtgggaagtaatggaggagcccggggccaaggcagggaggcctgaagctctggaaccaaactggaaagcaccttctgtatcgaaggcgtcaggacaacatgaccatggcccagggtggacaccccagaggacatttccagagggcaggtgggagatgggctctctcaggtagacaattccaccagtcctggcaggaggccagcttgaatctgccttgggctctagactgaggagctggggtccccggtcaaagttagataaggctggggcaagataggggcaggggcctgatgtccaaggagctgttaggctaagctggccccaggctggtggggcttaatacagctctttgcttgtaatttacttacacacacacacccccacatatcccaacatgccaaaatctggtcaaaaattttactggcagtaataaaacatactgatgtcaaaaatataagaaaactttcctattaactttaatacctgggaacccagggcacaaggccacaggctgaagaggaggcactcagtaaatattcttatttaatgacctagcaacaaagccagtgccccttctaaaaatctctgtgtacaacactctgtgtgtgtgcatgtatgcatgtgtgtgtttaagctggagcagaattcttcacttgcaaaaaaatactaaaagtggctgtgggctcaggtggtggcaaaacaagccagatataagcatatgggtctggagactaacagggattggtagtcaaagagtcacagaaggatgtctgggcaaagagagaggccaaggtcaaggcggagctctggctgggaacagggattgtggcagagactgaatatttcttccattagccagttctctttcttgtagtaatcaaaggcccccaagctgggtctatggccaccagctagaggctgcctttcccagcctctcttgcagctagttctggccaatgatgtatgcaacttctaggccacagccagaaggaaaagtgcttgccctccacctctccattttgtcaggaaggaacatggatgtggtgggggtgagccaactgtgaccacatggacaagaacatcaccccaaggaacagtgggacaagaagacaagaagacagtgtgaagcaaagccacctgcccctgagagagacatacatctttgagcttgttacttggtcccttttggagcagttgaacaaatacactaactcatccaggggattggagtgtgatgttggtgtctgggaggctgaaaagggtttgccagaacccaggtctaggtaagtggggacacagggagaggtagcaacacagatcagggtttagttctaaagcacaagacaggcacctgtagcaaggtaagcatccagccactaaacccatgcatgcggcaacacagcacagcgactcccaaggtagctttgagactcaggcagcctgcagctgaaccctggctcctccacctcctaactgatggtcccctaatctggacacccctctaagccttagtctccccatctgtaaaaagggacagtaaaactgtcatgtgtggtttaaattgagttgactcatataaatctcttggcatggcacctgacatatagtaagcattcaataaataataatcatcattgctattggagaaagcatttctgtggaggggctgtcatggctgtgtggaaagatctctagactagattccagtcctggctctgctgcttttaggctgacaggctgtcataagactgactggggttaccatgtatgtaaagtcccgggcacacagctggtgctcaagaaatgagaaccaaggttgaattcggaggtcaaagcagggcccccacagaaaccagtgtcacactgacccaccaggatattgggagagacctgagttcccctaaacaggggaagcattggttcttgagttgggcagagccttggcctgcatgctggagccaagtggtcctagcagtggggataagaacacaggcaggcgatcaggtggtgaaaggtctgatggatctgactttatgggatacttttcagattgaaggcttcataccaacccagggcacaagctagaactgataatcatggatgaaaatcatcacgatcctggcacacagctttccaggccaccagatccatcttcctgactccatggaagccacactagatggttctcctactgagattgagactttgcagcctccaatgtacttcttggtcactggattttcatgagataatgaccattcagtgaggaccatggcagagcggctctgtcttgtcagtgtcctgaattctagcctcgattactgccaaatagaagagtcacatgagcacattcctgtcctcaaactcacaacacttgcatccctcttattgccatttgattctgggagacactgactcccagagaagaggcatgaccgacccaacgagagcgggctgggaagtcttcaagccaaactaaagacatttctgagtcctccgatctgctgtttgaggtcaattcctcctgaagagcaggtgctgcctgacgctgacttgacctgcttgggagctctacaggggcagagaggtctgggctgcaggtgggacagtgagtagcacacctggtgagagccagggggctgagcacctgggtctcctcaccacaggcagccggctgcctccctggcttgctttcttcaactttctctgggggttggtctgtgggtttcttccagcaagggcagatcaggaggcctggagtcaccttggctgccatgggtccggtaacctgtggcaggaagccctggaacacacaggtctactgtgtgaccctaggtaaggcactttcctctctgggcctcagttttcccttctgcaacatgaaattgggctgaatgatctcaagatcacttcctttctgacaattttggattttgaaatctaagaccaggtgacagtgtggccaactgaaaaatactggccacatttcctagtttgctcaggctggctgcaatattgaccttaagctgaggagaattccacatggtaacttatgcctcaaattcctgttagaccttggtcaaagtgagcatccatctagtgatacctgctaatctttgtaaaaggcaaccctccccgtgggactgactgagaggtggactggcaaggtcaggcccacctactggcccaccatcctcttggcttctctgggggaagggctggggaaggatcctgtgctggcctgagctatagttgctgacaccaggcaacctgcaattgttggtggaagccctgccttttctgcagatgcttggctcacctataacattctaacctcactcaggtcagggtatcccacagcattgacctaccagcaatcagggggttctgtgcagagaaaactacccctgcccagggatccgcatgtatcccagcaagcagcccaggcctcctggacaccggcttctgccagtctaggccctggccaggtcctgacctgctgaccctctcttgggctgtcaccacctccacccctgtccccagccatgtcatcaatccccaaatctggttgtttctgtcccctgcctctcctttgggcttgggttcctacccctagttttgtcgagaccagaagttccaaagaccaacgacagaacagaaatgctggggaactttctccttcttttaaacgaaaattcttaaatgaaaaattacttgaaaaattttaaaccactgcagaattgtaccatccttggctctttcccctgaatctccctgtccccacatgcccctccccagagaagctacagttaatttaatatatgttcttcccgacgtcctaatgtatttatattgatctgcgacttgttttttttctttttttaaatctatgtatggatatctaggtttacctctttctttttgcgggcagcagcactgtattccatttttggctgtactcaaactcagccagtcccttactgatagatatgaaggttgtttccagctgtttctattccaagaaatgctacatagaatatcttctgcatacttgtatgagtatatcacaggctaacctcctagaagggagaatacttgattaaaggggatacaccttgaagcttttcatggggactggcaaatagctcttcaaaaagcagaaatttacacttccgccaatggcgggtgagcactatttccctaacctcctgcctatctggaatataaactgtctctttaacattagctaataagaaaggcaaaatggttgtatttggttcccattgctgctgtaagaaattaccacaaatttagtggcttaatgcaaaatttactatcttatagttcgagtggtcagacgtctgaaataggtctcactcggctaaaagcaaggtgtcagcagggccacttttctttctgggggccctagaggagaatccctttccttgcctttcccaacttctagagggtacctgaattccttggctcatggaaggctccccttccacctgcaaagctggtaacagccagccgcatctttctcataacaaatcattctaatattgactcctctctccctctcctaaggactcttgtgattacattgagtccacctggataatctctccacctcaagatccttaattaaatcacatctacaaattatcttttgccataatgggcaacatattcagtttccagggtttagaatgtggatagtttgggggtccattattttgcctaccacaaagatatcttacgtttcagttataattattttattattattttttgaaatggagtctcgctctgttgcccaggatggagtgcagtgacttgatctcagctcattccaacctctgcctcctgggttcatgcaattctcctgcctcagcctcctgagtagctgggattacaggcgtgcaccaccacacccagataattttcgtatttttagtagagatggggtttcaccatggcggccagactggtcttgaactcctgacctcaagtgatcccctgcctcagcctcccgaagtgctgggattacaggtgtgagccaccccgcctggccgatatcttatgttttaaaacctgtttcttgatctctagagaggcttagcatttttgcataaacatattcagttatttcatttgggagactatttttctggtttacataaactcttttgatattgaagctattgatcctttacatataggttgcagatatcttctctttatcattagtcttagctgtacagaatttttttttgtttccatgtggttaaatgtaccattaatttttccctttatgacttttaggtttcacatccaatattactttttagaatgtcacccaaattttcttctagttccattatgatttattttttccctcctttcctctcttctttcctttccattgtcaccttggctccatctggcacttatttgtgtgtaaggagtgaggtaaagataaagcttaagtttttttactccctagctagccagttgtcccaacagcattattgaatagtccacctccccacctctgaaatgtctgtggtgtctgataaaagcacaggttctagccctattccaaatccactgaaatagaatttgtgggaaagggacccagaatctatatttttgctaattccccatgtgaatattgtaaatctggcatatacttttctactggcatttggggaagctgatgaaattcctccaactgcctcctaatcaccttgcttccaggtttctagccttctcccagtccaccccactccactattcattgtggaaagagaaatctcttcagttgccaagctcaccagacctctccccttgtcagtaattctcagtagctccccaatgcagagagattcagccattggcgtttcagtcctgtcaaaatagggcccacccagtcttcctggcctcctctctctccatcctgctcttacactttgaactctctgcctttacacattgttgttcctggtgggacatgccgagaaaggagtctggagactaattccacagaggagtcagcatacccttgtttgagctgggttttgaactatgggaagatgttgatggtgagatttgcaagaaagagactctaggtgggaggcttgtgatgattaatatcgaatgtcaacttgattggattgaaggatgaagagggtgttgccaaaggagattaacatttgagtcagtggactgggaaaggcagacccaccctcaatctgggtgggcaccatctaatcagctgccagtgtgtccaggataaaagcaggtagaagaacatgaaaagactagactggcttagcctcctggcctacatctttctcctgcactggatgcttcctgccctcaaacattggacgccaagttcttcagctttgggactcagactggcttccttgcttgcagacggcctattgtgggacctcaccttgtgattgtgtgagtcaatactcctcaataaactcccctttatgtatacatctatcctagtagttctgtccctctagagaaccctgactaatacaaggttcaatgtacgcaaagcacagggggctggaatgtggccacaggaaatgtttcagggctccaggcaggagccccacgatgtgctgggatggcttctggacactgggaggtgtttccacacgtcccctcctaggccccagaatgacgagataaagtcccaaactgtgaagcctcattatgtcaagcagatcttctaacagagctgtggtcagtgactgccctctgaaagcaggtggaaggcacaactgggtccccatggggtgggcaagggcgcactgctgctgctgggctgggccatgcttccagggtgaccagcccctcataccctctgacctggattcattcatggaaaacaggcacaacctagagtccatagatagcctgtgttggaaggaagaggttttttgctaatccaatgggtcaaacagtgctgttcccccaagaagcctgggatgtctgccttgagccaggcctgtggcttaaccagttcatcagtgtcttccaggtgaacctgcctccccctggcctgggcaggaactaggctccattcagatttgcatttccagtgcctgatacagaactccacactcagtaaaatattaaaaatatttaaaaacacttaactgaccacctaccatgcccaaacaaaacaaacatattgattcttacacatcccctttttatagatgggggcagggctgaggctaattgcttcagatcagacacaaaaaggcaaaggcaggatttgaaccctgagtgctggccaacatccaggaaacccccaagggccctgatcttggtcagaatgaccgagtggatcctaccttccttccctgtatctgagatcctccaggaagtcttccctggttaactgcagccacctacatacacttgcatcaaagtcctccctgcatgcaagtcactctgcatgaccatgttaaccttagggctgagtttcttgttaactgctttttccctcaataatgaatggtggatttttcactgtctgggaggctcttaaatcatttcccttggatgactggtctctgtgttcctacttttccttctcctcctccctcccaactccaagacctaaacagggcttggaatttctgcacactggtcaaaaagcaaattctatcgaaagcaaacagaagcctaggcaatcctagacgagttagacccggctggtatttgtcttcctgttagagagctcagggatccaggtgaaactgatatcaccaaggagaatgaagtctcctgtgacatccccatagaaagcaaaaacacatttcacagtcaagatcaagcaatgatgtagcaaaaactctactctgccagacttgcagaggcccagatttcccctgattgtctgtgggcataataattcagaggaagatcatctaaaccaatgtcctgtgcctagacggagcaaatgaactctgactatgtgccagggctgttcttagtatgttacgcaaattcactcatttattcctcacaatgacccttcaggcgggtactattatcattcccattttacaggtgaggaaactgaggcccaaaatcacaaaactgataagtagcagagacagaacctgaacttggaccatcaggtgactcctgcagtggtgaccctcaaggcagccaggccacaccagcctcacagagaggacacagatttgaatcacagtcctgacactgcaggtaaccaaacactgtttttagcagccttcctttccttcataagggctaagcttgttaacctttttttacctttctcctggaaaagtatcgacagtgtttaagccttgcttccattgagaccaaaaatgaactgacattagctgctacagccttacctcacctacacacatctacaaacaaggcccagatgcttgtagctaattcacctactaagttatctaatgtaatgtacatagctagctatccacctacctatctcattgtttatttatatccgatttttcccatgaggattaaaagaggcatctggacacccatgagaactcagtgggcatctatgaacttaactcaacctgtttatcttaaatggtccaggaagtgcttgtgggtgaaagagcttagggaagaacaaagcctgaaatgagagttgcgcaggcccagcaggcttgtcttctggccatttgtgtccagccagtctctcatcaacaccgcctaagagagacccaaattccacatttgctgcagtggcctgatctcttgtcagtttctggcaggtctctagtggttcctttgatggcattttgtttctatacacgtgactgtggcacaaaaggcacacctacctacaagcttcctaggtagttaaggttcttgtgtctactatggagagcaatacatagaatacacaataatatatacacacacacactataagatgaaccacagaagaaaaaatgactgggagactgggtgacatacagagtgtagtccaacagaagaggtggcgactgcctgtggcttctgtcattcttgcccacatggcaggatagatataactgtatagtaatgataaagcagttataacgatcactctactgcaactcatttcttcatttctccactcagtctgcaagtactacgtgggccttctcaatgccaggccagtaagatgaaaacagacataaatcataggccttactataagctacagtaatcaagacagtatagtatcgatacaaagagacacaagaagatcaatggaaacagagtagggtaaggaaacatactcccacacatacagtcacatgatgttatttatttatttatttatttatttagggacaggatctcattctgttgcccaaactggagtgtaatggcacaatttcagctcactgcaacctccacctcctgggctcaggtgattctcccacctcagcctcccaagcagctgggactacagacacgtgccaccatgctcggctaatttttatatctttttttagagatggggtttcaccatgttggccaagctggtcttgaactcctgggctcaagtgatccacccaccttggcctcccaaagtgttagaattacaagtgtgagccaccacacccagtctcagtcacctgatttacaagaaaaatgcatctgatagagaaagtaatggtcttttcaataaatggcgctaaagctattggatatccatattaaaaaatgaaccttgacccccgatatcataccatacacagaaaacgaatgtgaaatgaataaatgataggcctgaatacaaaagattaaacaataaagcttgtagaagaaaacaagaaaatatcttcacggaacttggggtaggcaaagatttcttactcgattgacaaacgcgtaatcacataatcataaaggagagaagctaaattgtgcttcattaaaatttaaaacttctgttcaacaaagactctaataatagagtagaaagacaaaccatgggttgggagaggatatttgcaacacatgtttgaaaacaaattcctaaaaatgagtaagaaaaaggcagtcaacgcacctgaaaatggcaaaagttaactcaaaatgaatcaaagacctaaactcagagataaaactatagaactcttagaaaacataaggaagaagcttcatcacattggatttggcagtaacttcttagatgtggcaccaaaagcatacacaacaaaagtacaaatagataaattgcctacatcaaaatttaaaatcttctatgcgtgaaaggacaacatcaacagagtaaaaagacaagaatgagagaaaacgcttgcaaatcatatatctgataagggattaacatgcagaactccaaaactcaacaacaaaaagccaagcaaaacgatttttaaaaaaatgagcaaaggacttgaagagacgtttctccaaagaagatctacaaatggccaagaagcacgtgaaaagatgctcaccattaccaattactagggaaatgaaaaatcaaaaccacgaagataccacctcacacacattaaaatggctacaacaaaaaaaagaaaaagaagtatttgcaaggatgtagagaaagtgagtggaactgttgcactctgctggtaggaatgtaaaacggtgcagcctctatggaaaacactgtggtagttcctcaaaaaataaaaaatagaattaccatctaatccagcaattccccttctgggtatatactcaaaagaattgaaatcagagtctcaaagagatatgtgtacatctatgttcatagcggcatgatttacaacagccaaaggtggaagcaatccaaatgtccattgatgaatgaatggataaaaaattcattcatgttgtagcatgtgtcagaatttccttctttaagacggaataatattccattgtgtgtatgaaacttgatgacattatgctaagtaagataagccagccacaaatgaacaaatactgcataatttcacttatatgaagtacttagagtaatcaaattcatagagacagaaagtcaactggtggttgccagaggctgtgggaatggggggctgttgttttatgggtatacagtttcagcttttcagaatgaaaagtaatctagagattggttgcgcagcaatgtgactgcttaacactactgaatttaaaatagtaaagttggtcaatgttatgtctattttaccacaatttttaaaatagcaaaagattttaacaggcactacaagcaagaggttatctaaatggtcaataagaatatgtcatgaagttttcccctatgttttcttctagaagttttatgtcataaagttttctcctatgttttcttctaggagttttacagtcttaggttttacatccaagtctttaatccattttgagttgatctttatgtacggtgatttttatgtatggttaatttttatgtaagataagaatccaatttcattcttttgcatatgaatatccagttttcccagcaccatttattgaagagactacccttcctccattgtgttttcttggcacccgtgttgaagatcagtcagcatatatactggatttatttcgggttctctgttctgtttcattggtctacatgtctgtctttatgtcagtaccatactgttttgattagtgtaattttttatgctttgaaattaggaaatgtgaggcttccagctttgttcttgtgtcagaggattgatttggctatttgtgttttttgtggttccatataaatcacagaattgttttttctatttaggcaaagtaatgtaattgagatttttatgggggtttcattgactctgtagattgttttgggtagtatggacatgttaacaatattaattcttccaatccatgaacacaggatgtctttctctttgtttgtgtcttctttaatttctttattaaatgttttgtagtttccagtacacaagtctttcatttccttagctaagttcattcctaagtattgttttaggtgttattataagtgacattatttttctaattttcttttcagctagtttgttgttagtgtatagaaatgccactgatttttgtaaatgattttgtatcctgcaactttactaaatttgttaattagttctaatactttttaatggcatctttaggattttatattattttgtctgcaaacaggaacaattttacttcttcctttctgatttaaatgtctttaattttttttcttgcctaattgctctggctaggacttccagtactgtcttgaatagaaatggcaagcaagggcattcttgcccttagcttcttcctgattttagagaaaaaacttttccgtttttcaccactgagtatagtattagctgtaagcttgttatatatggcttttattatgttgaagtactttccctctagtcttagttttttgagaactttgatcaaaaagggtgtgttgaattttgtcaaatgccttttctgcatctgttgagatgctcatgtgattttaagtctttattctgataatgtgatgtataacattaattaacttttgtatattgaaccatctttgtatcccagggataaatcccacttggtcatggtgtatgatccctttaatgcactatttggtttgatgtgctagtattttgttgaggatttttgcatctatattcattaagaatattagcctgtagttttcttttcttgtggtgtctttgtttagcttttgtatcagagtaatgctagcctcataaaatgagtttggaggtgttccctcctcttcaattttttttggaagattttcagaaggatcaatgttaaatctttaaaaaatattttggtagaattcaccagtgaagctatctggtcctgggcttttccttgttgggagttttttgattactgactcaatcttcatattagttataggtctgtttagactttatatttcttcataatttagtcttgtatttttctgggaacatatccatttcttttaagttatccagcttgttggcatagaattgttcatagtagtctcttatcctttttatttctgtggcatcagttgtgatgtctcttctttaatttataattttatttatttgagtctcctctctttttttctagcatagctaatgatttgtcaatttaaaaaatcttttcaaaaaaccaactcttagtttcattgatttttttcctattgtttttgtattgtttatttcttctgtaatccttatatctttccttctgttaaccttggccttaatttctttttctaggtctttgaggtataaagttaggttgcttatttgagatccttcttctattttaatgtaggcatttatcacaacgaactctctgagtacaggttttgctgaatcctataagttttggtatgttgtgtttttgttttcatttctcttgaggtattttctaatttcttttttgatttcttctttgacccaatggttgtttacagtgtgtcatttaatttccacatatttttgaattttcaatttccttctgctgttgatttccatttctatttatttatttatttttattttttattttttgagactgagtctcgccctgtcacccaggctgcagtgtagcggcgcgatctctgctcactgcaacctccacctcccgggttcaagcaattctcctgccccagcctcctgaatagctgggattacaggcacgcactgtcatgctcagctacttttttgtatctttagtagcgatgtggtttcaccatgttggccaggctggtctcgaactgctgacctcaggtgatccacccacctcggcctcccaaagcgctgggattacagtcgtgagccaccgtgcctggcctatttatttttttagatggagtctcactgtcacccaggctggagagcagtggtgtgatctcagctcactgcaacctctgcctaccaggttcaagcgattctcctgcctcagcctcctcagcagctgggattacaggcacctgccaccatgcccatctaatttttgtatttttagtggaaacggggtttcaccatgttggccaagctggtcttgaactcctgacctcaagtgatccatccaccttggcctcccaaagtgctgggattacaggtgtgagccactgtgcctggcctgctattgatttctagtttcatcccattgtgatcagaatatatatttggtatgctttcaatcttaaatttgttaagacttgtgttgtaacttaacatggagaaaaatccatgtgtgcttgaaaagaatgtgtattctgctgctatttggtggaattttttggcatttatttgttaggtccatttggtctatagtgttgttcgagtcatttgcttctctgttgatcttctgtgttgatattctatccgttattaaaagtgaggtattgaagcatataaaacaatgctcaatacaattttgtcattagggaaatgttaattaaatctacaacacattcaccataacagctaacatgaagcaaacaaaatgacgccaagtgttggcaaggatgtggtacaactggaactcttcttgtgcattgttagtgggaaggtaaatagacacatttggacaattgattggcaaagactaatgccacacacctaccctcagacccagaaattccactcctaagactatatcctatagaaatgcctatgtatgtcctccaaaaaacacaaagaagaattttcatagcagatctattcatgatagccaaaaaaactggaaacagctcaaatgccagcaacaaatagaatggataaataaattgtggtatattcatataacaattatacatagtaataaaaaagaacaaagtactgctacagacaaaaatatatatcttacagatataataataagtaaaggaattcagacacaatagactatatgccgtgtgatgatgtgaatgtggaaactccacaattcaggtattgtcaacgtgatagtattaagaggtgattaggctgtgaagattcctccctagtgaatgggattaggtgtctcataaaagtgcttgctgaggagacttcatctcacttgccctggtacctctcaccatgtaagaatgcagcaagaaggccctcaccagacaccatatgtcagcaccctgatcttagacttcccaggctccagaactgtgagaaataaatttctttactttatagattacccagctttagtattctgtactagcagcctaagacatactatatgattccacttaattaaagttaaaggataggcgaaaaaccaatcttatggtattagaaaataggatagcccaggcacagtggctcatgcctataatctcagcattttgggaggccgaggtgagtgaactgcttgagcccaggaattcgagaccagcttgggcaatgtagggagacctcatctctacaaaaaataaataaaattagctgagtgtggtggtgcacacctgtggtcctagctacttgggaggtggaggtgggaggatcgcttgatcccaggaggtagaggctgtagtgagctgagatcacgccacagcactccagtctgggtgacagaatgagactctgtctccaataaaaaaaaaaaaaaagagaaagggaagggaagggaagggaagcggaggggtggagaggggaggggaggggaggggagggaagggaagggaagggaggaaaggaaggaaaggaaggaagaaagaaaagaaatcaggatagtggtttctgatttctaatggggcaggtgggtatttactccgaaggggcatgaagcagttttctgggtgtacaattgttccacatcttgatgtggttacatagatattacatacacacacgcacacgcgcacacacacacacacacacacacacacacacatacatatgttaaaaagaaaactattccagtacagcggtacacttctggtttgtgtacataactgtatgtatgttatacctcaatttttgaaaagacatgggctttacacctgaaaaatacaaagcttatagggaaagagaaaaaagaaccaaaaagataataaggggtggtagatgccatgatagaaacaggttcccagtacaggttgggagaggctgactcctgggggtggggagggacggctcaccagcgtaggctttagagatacacacactgggctctgaaggatgaacaggatctcaccgagcagaaaaggggatgagtgggagaaagacagaaagatgctggggaaaccctaattgtgtgagaaggtccagtgtggttagagtgttgggtgtgcagagcatagtagtggggggtggggctgagggcatgaatcaaatcagctttcagatttgtttatttaaataaattccccataaacattttttgagtgaacaaatgaaccttctcacggtcatgatacatctgatgtctggaatggtaggacagatgtgttaggatggcagcaagtactgaatgaagagatgtagtactggtgtggttacaaagtccatttcttctcaaattattaatctctctaaaatctgatgtcttctaggccccagaatgccaaaccgtcctcacttggttatggtactgactctctgctgtgaaactgcagagtttttcgcattcaacctctctctcccaatttccttccaccccatctcacaatttttggtggttaccaatttttggtggttctggcagttgcttttagcatcttcaagtaatatacttaaattgcgattttctgatctatcaactttagacagtgtctattcacttcctactatgagcaataaaatttgtccacattctctactttccacttccttccctcctgcccaccttcagatttttgttatatgttattgcttttgcataacaattacattctcatcgacagtataattaagtctactctataggataattctaaaaagtgaagctagttaacaacatcattatgaagatatcattgcctgcgaagccactcagtatgaatggacccatgagaaaggcaagtggttccacgttactgaaacttggtcacaagaagaaaaatggatagcttccttcacttcttcttgaacctcatttaataattattttgggttccttttttgattgatgaaataactccaggaggttttattttcttccagaaaatataggtgactgagtgacaaactttctgaatcttacacatttaaaaaactatttttttcaaagtttgacaggatgactcttagtttatcctccagaattgtgaaagtactccactgtactggagcatcttgcatgactggtgagaaattctgaggtaatttttgagtctctctggaagttttttgttttttatccttgatgttctgaaatttcaccaagatgggtctgcatgctcattttactaattcctgccctaaagtcagtatgatctttctagtttaaaatctgtgtgtgtttcttttttttttatttttatttttaaattgaaatggggtctcaccatattgctcagtgtggtcttgaactcctgggcttaggcaatcctcccacctcagcctctcaaagtgctggattataggtgtgagccaccaagcctggccgtgtgtatttctcaactgagaggaaatttctttggctatatctttcactatttctacccaccccctgactgtctgtggcttctagttctagatctcctagttgatggatactgaacctctggatctatcctccatgggtcttaatgttttcttcttgagactttgctctgctttctgggaggttttcttggttttaacattgaaatgaccaatctggtcttcatgcatatccattgtgttattcagtttttccactgaagttttttccataatgatattttacaatttcagcaagtatttcctttcctccaattgtgctatcttcatagcaacctgctcctctgatattataggttatttcacttacagaggtgaatgaaagaacctcttacttactgttaaggatactactgataatttagttttgggctttcttatattcaaactgtttcctttgaaataagctcttccttttttttttcttttttccattttaggccttctctttcattctattggtttgcttccaatgtttggtgattttggttatccaatatatttatgaatgagggattatgttgtaaagttaggatatgtattaggatacaggttctagctcctataacaaggacctaactgcaggagtggcttagacgagacagtttatttctgtcttatgtgcaatctgagtttaagtggccatggctgatatggtggcttcaccgtgtggacatctttgatcttggtcttctgatatccacagcacatgacttccatctcccaccatcacatccacaccctactcagtgggaacgataaaggggagggcagagctgggagttgcacttgtcatttcagctcacacgagcccatggccactcctagctgctaggagggtgaggcagtgtagtgtttagctgagtggctgtgtgccctgctaaaatttccatcactacagaagaagagaaaaaagatataagtggaatactaactacatagggcttcccgtgaggtgtctcgtctatttctctgaccagttcagtcttgaatgtgagggtggcagtcatggaaaggttccctgcaggagggtgaagcagtgtggcaagtctcctagtaataaccgtggacaggaagtggccagggaactcccacaattgccaaaagaaggacttttctccatggtgggcataatgctatacttcaccctgagacggagctgccaatccttcttctggctccctgccccacatccagtctgctagagaggtctggaatgcccttgctcagctgctgtctcagactttccttagagagcatttgttggggaatttggcggccactggctgcctgcctctttgtgaagaaggcggggaggggtccaactgtacttgctcttctgaagggctctcaggggagaacactgctaacccattccttttctgtgctttgttggctctcagcttgaactatgcttggctcttctgagacaaaaatcactgagacttctggaatcctgggctgcaatgttttctgctctgattgctctgtctgtgcaatctcatgggctttctatcttcctaagatttaggaatgtttccgtcccacggatgacttcctatcttgttttctaatgctgttatgatgtcatcctttcaaaaatggctttcagctgggcacggtggctcacacctgtaatcccagcactttgggaggccaaggcgggtggatcacttgaggtcaggagtttgggaccagcctgaccacatggtgaaaccctgtctctactaaaaataccaaaaaaaaaaaaaaaaaatagccaggtgtggtggtgcatgcctgtaatcccagttacttggaaggttgaggcaggagaatcccttgaacctaggaggtggaggttgcagtgagcctgggcaacaagagtgaaactccgtctcaataaaaaaaaaaaacggttttcactgtcatcataccaattcctagggaagaggtggaggtgggcacttgtgctccaggacttaggaaatcaatgcattcatgactcattggctgaggccaatgtcccttccaggatgtggacaccggaaaggaagatgaacccttcccatgcagggcatcatctcagaactccatggtgtctgcccttagggggaacacttctgatgttcctgaacctgggcccccaccgatgcacaatgcccacctagttccactgagggtaggaacagccagccctgtttgcctgggcagcctagtagttcatggacaccagtcaatgacccgactgcctaagggcgtgcaagcctccgtgtaggcacctggcaggctgtgtttgcctttggaggtggataatcagcaaagtccctgtacactgtcagctaccacagctgagattcagcgagctatctacactaagtgtaccaggagaaagggttccaccccatcctctaaggttgctcaaaggctgtctccaatccataatgacacccctttttaagacccttcagcctccccactagtttaggccccacggcatggctctggaggcctcacctctctcattccctccatctgtgtgttccagccacatggagctggagaattctcagaacacacgccgttcccaatggctgaaatgccctttccctcctagacatgtggcaaactcctcaatgtcctttaaacccaccagtgatggttaattttgtgtcaagttggctatgccataggccaagacgcttggtcaaacattattctagatgtttctgtgaaggcattttttagacaagattaacatttgaattggtaaactctgagtaaagcagaccgctttccacaatatgagtgagcctcatccactcggttgaacgccttaacagaaaaagagtgccctccccagaggacaggggaatgatgtctgcagactacctttagccttggctcctccttcctggatctccagcctgctggcccatcctgcagattttggacttgaaaagcctccacaactgcatgagccaattccttaaaatctctctctctgtatacacacacacaccacacacatacacaattggttctgtttctctggagaaccctaatacacaacttcagacatcaaatccttcagcgagctttctatggcccccttacactcagccagtcacctctgtaccttagacactttgctgctatcacatgtcttacaccttgtggtaatgtatttgtttacaagcttttctcctcctacaggacagggttcttttaggccaaggagccagtctcattcaccattacatccctaggtgggtgaatttgtgagaacaagagagtactgaggctgatggcctaggggaatcctactggatggtgggaggggcattcccattgagcctcttgaaaggcatctggtaagacaggccagagagggacggttcctgcaaagcaggctaacagcactgctcctgaatatcagtcactggtggggcagtggcccacagccttcttcagctctggtgaggagaggaccccacaggccatggtaccacctgtccagcttctccagctccacccagggagcccggtttaattcaataaatacttactgaattccgagcgcaatttcttgtgaggcattcgcactctaggtcctgatctgacctccagatcttccttttttgacaacatctgagctctcaaaagcactcagggaatgtactgtttgtgtgcctgaggggagcagtcatcatcctcagccttcttaaacttgccctgagaccccccaagctcccactctgtgctccctgaacaagacgatgttgtcaagtatgatttcgtggggctgcatttccaaaaaataagctcttgcagttcatacaggctttcttccattcaaccaggtgaactctgaaaatcccacactgtgagaaagaaggccgtaggctcagggtgtgggggcagaagggtgaccctttgagaaaattactagtgtatgttacactcctgttctaaacaaaggtcacgggttgtccagggaattatgagcaaatgaatgagtgaatggatgaataaacaaacgctaagttgaatggatgataacgtaacccaggctcaagtcaagagcatttaattgaggaaacaggagaagagccagaagataagctatacacgggcaaagggacttccttaaaccaaaggtggtttaaggaaggcaaattccatctcgtaacaaagacacaaactgtggagcaactgggataatcaatcataagaaatgctgatggggacagagcgccatgtgccaggctctctgccgagaacctgacatgtcctcagtcctcagaacgagcctatcaggccggcaatgtttttacatccatctcacagatgaggacacaaaggcaccgaaggttccatcatgcgcccaggggcacacattcaacaaagagtgagactgcaagccaaggcaggcagggggtctgcagtgtgtgtctcaaccacttccccatttcacctccacatgtggctctagcagcctttaatcaaggaagcaagggaaaactcgaatgttgttcaggcctggggatctagagacccacctggctttctcccactgtcctgggcaaccaggcaagtcctctgtgagattgtgctgcctgattccatatcggaaaaatatggtattcactagagttgggtttcggggacctttcccgccctgacattctggatgcttctccctagcctgggaactccggttgcctgaggtcggctcaccccagagcacctgattctggccccagatgaacctcctgactaggtctgtgaagatataaactcgcccttcttgatggcccaggctttttctacaggacccaacctcacctcaccttcctgcctggcagtctggctattccaccctgtgatcccacctccactcctcccgcctccccaccttcctcctcccactcccacccacctgtgccccagctcctctcaccctttctgcctcctgccagggttcaagcccctcccttggcctgctgcccggtcccccatcttcccttctttgttcagccaaatccttcttgtcaccactgccagtttctccctgggacctctttccatctcagacagaacccattctgccttcccctggccggtgtttacacccctgtttcagatggatcataatcccaacaatgccgccttacgttagtgcagtgactacagctcaccaaaggcccctgtagccactgtctcatttaatttcacccaagttcctccttgcagacctcctgttcatggctccaactgccccctaagactgcaaacacaatgtctaacatacttcataactaagaatttcctcaaaacagccctctgggaaggggcttatcacttcgttttgcagatgaggaaacagaggttcagagaggtggaaagtggctgggctggatccacagctcaggactctgattctccgtcccatggttctcaaggattcatggtgttccctgagtcctgcctaggatcagactcatttctgtattcctgagctatcctttgcttggacaaatacggtatcctgaactcaggggaccaggagggtttgctggcttaaaaaatgaattcatcagggcctagaatcatcaccgtcctaagtgcctccttcagggtaccacagtgccagcccctgtcccctcccttcatctttgcatggaagagatgggcagagctgggccctttagggtctgaggtacaactgaagcctcagaagaaccgataaaccatgtttcttgtttgccacacagaaatggggcagtctctgcctctcattgtcccaacctggccctggcagggtgaatgcagcacctccttccaggaagcgcccaaggaagctccaagggacctggacagggcagaggattccctgggcagggagcagtggaggacagccaggagcactgggcgcggagtcagccgctaggggctcactgcctgcagggacactccctccattcccaagagctccaaacccttctgacaagctgcgtcctctccaaatgggtttcccaataggctttggcctgagtgaatgatttctttccagaacaggaacacacccctgccttccagcccaggccactcacagctcccctctccagaggcaatgacagttgtcaattcttgactgcttactttggaacgcgtggggcgggtctcgtgacattttatattgtattccctcactgtactaatcttttcacatgcccatctccccagctacacattttggagagcaggggctgtattttaaacaccttcatgttctctgtgcctgccacatagtaggcactcatgggtatttgtgagtgaataaataaataaatgaatgaacaaagttaaaattgtggaaagcttcagttaatagtttgcagaagtcactttaattccttctgaaaaaaggggtgtattaatttgctaatgagtagaattgtgtaaactttgagtatctttctcataaacataactctttaaatgctgtctagtcatttgattattcaaatattgagatacaattcacataccataaaattcacagggttgtgcaaccatcccaatgatgtaattccagaacacatgtatcactctgaaaagaaatcctgtacccattagcaatcactccacattcccttccctccagcccctggcagccactaattcatctagtttccatctctataaatttgccttatctggacatttcataaaaatggaatcacccgccatatgtccttttgtgtctggcttctttcacttagcataacgtttttcatcatttgcactaaaaatatcagtgtttcctggtgtttctcacagcaccctgacgcccaggccacaatgcctgtgagatcacgcaggttggagctggccgctctgagccatcagggcagtgtggcgtccggcagcagatgtctgtgactgggcagtgcagggactcagatgggagaggtagccacaacatgggcagtctgaggtcagcagcagaatcagaatggtcagaaacagatagcacatgggacggcactcaatattcctccccaaggaacagctgcctgaaaatataattatctggtggtgagagaggcgtgtcaagggccaccagccctgagtctaaaggctctgagtctgcagggagagtaccatttctgagatgatctcaaagctcaacagagggtgcaagtcccaagggcttagatggttccattctaggggtggaaaacaggcagtggccatcccaactgctttgccaccctttctgcctaaggcaagcctcctttctgcagggcttcagttcctcgtaggaagtcccaacaggctgagcagagccaagcatgctttggtcatgtacagtttgtgcacagatagattaactcattagttaatcccctttttgtctttttgcaattttaacttgatttattccacagtagatttgaggtaatttacaaaaacaaaataggaacacaaatttaaaatgaaaaatcaacccaggggaaatgaaagaccagaagggatggaagaagatgggtaagtcacttagaaggccccacatggtagctctcttggggccatggatttagtatacagcagtcagaggaagaagggcaacacagttagctgcacagtctccgtgttctgatgatacgctggccagttcctcagaaaaaacaaagctcttcttggcactaagatctgaaggaaatttcttccatgctgttttaagtagggagccctccatgaagtcatcctcccaatacttccggggctctgacatccagctctgagctaggcaattggctctcccagcatctcagaaggccaggtgggccccaccctttaagtcattagctcctgtttgggaaacgttgtgccatttggtgaccaccgttacaagttttctcagaaataatgccatcgtattgtattgctatttatgtaatagtttaatttactttgacttgaattggacttgtttaaaggttacttcttcctaagcaatagggaccacaggagaaactgccaactagtattttttactgaattaaataaataattttaccagtcaattaaagaacttccagcatgttctcccaaaatcagctcatcttctactcatggtttatgtcctgaacttgggaaatcggcccgtccctcaccttgggatgcactggggctgccccccatctcctccacctggagaaccctcagcctggcttccccatcacaccacgcaagcttagagctagagggcacttaagtggggtctaaagtccacgtttgacaggtgaagatgctgggcccaaggaagagaagggattcgcgcaagaccacaaggccagtgacaggacaggcaccaagactgcccagaaacagtggcagggccggtggacatttagatgtaaccaaaggctgaaactcaccaaaagagtctaacaggaaaagactgtgggcagagaggcacagggcctcacccaactcagggcaagcccggtgggggcagggtaaacccagaaaacaatcatgggatggtaatcccgagttcaggatgacggtcactcctgggagcacaggagaaagggacccacattgtggaagcgatgcagggcttccactgtatttgacaagtcttttttttttttttttttttttttttttttagcagggtggtgagttcactagtgttatattatcatgcataatattgctgcttggatgaaatattttgaaaatattttatatttgttaaatatattaataactccaagactcctttaacaagtgtgttttctctctgctaagatgacactctctaccgcatctcaagtggtttaaccaaaggggagaagaaatgactgatttccacaagagacatgccccaggtggggagcttctgtcacctctccctccactcccaaagcctgtgacatgtggtgggtggatctgagcatcattgtacctgaccaaggtggagtccatttcagacaggtcatggtgtcatggttggcatggctcatacaaacccatgggtctaggaggaaacttagagcaccccaagtggaaccatgtgggctccactgatgaatgccacagcagggcaatgggcagtgctgtagaattaagcccccagccaacatctttgttccccacctgcacaaaggacgtgtcttggcatgtatatttttgcaaacagcagactatcccgttcagttaaaggcagggtaggatgtactttgagatttctaagagggacgcacagagtctcagagtctccgggttgaagggactgccaaggacactgacccaagctcccatttgagactccagccttccttagaggctgctctcaggaggccactcactgcctgaggcaatagcaattactttttttttttttttcaaacagggtataggaagtggggaagatggggagccttttttttttttttttgagatggagtctcactatgttgcccaggctggtctcaaattcctggcctcaaatgatcctcccgccttagcatcttgagtatctcagattacaggcttgtgctactgcacctgctcaatttttgtttttctaaaaatggtatcatcctatgtacattcctcagcactcggccttcctcatggacagtctttctaggctacaggccaataggttgtgagcagttatcctgtaccaggcacagttataagcacctcacataattaactcagttactgctcctaacaagcttaaaggacaggcactattgcaatccctactttaccaaagaggagtgtgaatggccagagggtcaagcaacacagtttgtaagtggtgggatccggatttgaaccctggctgtctgtcttcagaccctgtgctcctaaccactctaccgtactgcctttccaaacagagacaggatctgtctcaatcttgttacagctgaatgatggaccatggtttggatggaatacctttaaatttactgttaagtttgtatattttttgtaagttttcctactagaattttgccataaacatcctttatacacatatctttacagactgatgcattcattgttccataggccggatttccagaagtggaaacatggatcaatgtgtgtgtttttggttaaaatacctatggggcctattgtttgggccatcgtcctaataatgagccatgtcattttcactcactggttttgattctgtcccgaggaccacacagaacatctctgaccctttttctccagacaacccctggggtggttgaggacagcaagtctgtctctcaagtattctgttacccagtttcttcaaaagttcctctgacaagggctgcatgctcctgagggctggtccagatacctcttaaagtgcggcaccgcctggggtgatctggcttatgccccttgctccccattcaaagacacacagagagggacattgacagtgcacaggagatatcaacagtgtttcctgacatccatgatgcacgggagagaaccaagtaggtaggattcagacttctcatcttcacctctcccaaatcacacacatgccttcctgagaaagagaccctttgtgagatattaaagaccagccaaattctactcccacatcataagaaactggagttcactctttaattagagaagatgccaatggctttggaactggacaggcttctaagcatcttttagttcagtgtcttcttttacaaaagagccctggagggcaatgaccgcaccaggctcacatgtcattgggtgtgtggcagcatttccctaagctgagaccagggtcactggtgggtgcatttccccagctctctctgcctgctggttcctaggaaccatcttactagaaaggcgtagtgtaaatattttgctaagcagccaagagaggaaacttacccaggctgagctgccctgtgctgggtgctggccatggacacaatgctcaatgagggccattatctgggaagggagggctgtttgttccgctgcgggatggtgccagagcccggagccaccaggcttgccactctggctgccacacagaagagtctccttgcgctcagcagactctgcggttatgcaatgccgggccaggaggttaactctccccaggccaggagccaagccttgttccttcctgcctaagcatgtccatctgaaaatgctgaaaattgagggcctcagtgtttgcaaaatgtgctcgggccctgaacctgctggtttattccaaagggcgtagtgttgaggagctggtgtgcccatccttgtggctcctggcagcctcctaccgaggcccagtgctctgacagcagcgtctgcctgccatcctcgggcaccactcataggccttgcaaccctttgcctgggtgcccctgtcccgttctttccctttcggtggtgtctggtctaagtcctttcttaagcccgagttctactcacttgttcaaagccttccctgaccaccccaggccccagtgacctgagctcaaggatgagtttcccaagacaaaagggaccttggaagttatctatccacctggcccattttccagatgaggaaactgaggcttgaagaagttgactagtctgagagaagactgaacagatgtgtcagcctggctcccctctcagaactctttctcttatacctcacgtcccatctgtcagcaaatcatgttggcttgacctcaaaatggagctggaatcagaccccttcccatggcccccgcagttgccaccctggtgtgtgactctatcacctcctgatctgtcacatcactgcctcctagctggcctcgggctgctgcccccgccccctccagggcagcctccacagcctccttcggcaggacagcccactcctctgctcaggcctcccagggcttctggatgttgtgcctgcctctcccttccagcctcctctgctcctgtgcccccacccccactcctccagccacaccagcttccttgctgttcccagcaggctgatcttgcctccgcctggaatactcttttctgatacccccagcacttgctcctcgcctccctcaggtctttactctccacccgtcctgactgcctgatttcaaaaccttgacaacctgccagccccgtgccccctattcctttcctgactgccaccttgtcacatactatgtatgttacttaagaagataatatatttacatttattttacatacacttatgtttttaagatctcacaaaatatacagtctatagagagtgtgcatgtgtgtgtagtgacgatatgtttgtctatttccctaccagaatgtaactccaagaggcaggtgttttgtgctttgtcacccagaatggtgcttggccccttatgtctaagtagggccgaaggtaaggatgacctacctctttgaggatggatgaggatggtgatggtggctggggtgtcacctgactggtatgggtgttaggagtgggggaagggatgagtttggtggcatatgtaggctcagcagagggagagccagggctccagggaggtcagctgggaggctgtccgaatgctatatttttggagccatatggaataaacacccagacacctgggcctcagtcccccaaccccaaccagccccggtagagcagctccaaaataggaaattcgcagaggtagccccagagaggctgctcagattaggctgcagtgagcacctaggcatggctggccactccctgcttttaggcatcctgaatttgcacgtctaggaatctccatctccatgtttcaagctctctagtgggtgactcacaggctctgcaggggtttgggggctgcagctgagttcctttgaatatctgttgaatgaataaaagaaatggaaggaaagggggaaaggtgctaaggcagacacaggagaagaggacaaaggcttgggagcactgaaacgaccccagggaggcatgccaaacagagcccgaacagaggcaagacagcagggcttgtcctgacaggtggcacaggtgggtccagtttccactcgctttcccacacctgcagctacgctggccaggagcacaaacctcaagcaaacagaaattttttctcgtgatttcagttttagtttgattgacatttttatttacccatgacatagtttcttttaggatagctggctttattctaaagagcagcccaaactaagtggcctaggtgatttggctgttcaaatctcccttttctgatcctcctgtcctgccctacctctcctctcacctgtctgagcacttctctgactcttccatccaagctttttcttcctagatgcctgtactcagtcctcaagctttggtctctaatcccctgcttttctctctctgcactgctcaccttgacttggtagcagcttccacagctgcacacatcacctgccccacccagcacgccccaatcctgcatttccagcagctctcacattcaatatgcttagtgccccactcatcttttcacccctctgtctctggtaaaccttcaggcttgcgacactagtgctacctctaaactccactctcctttgtcctcatagcacccattcacccagtcactcaccctccactcctaccctttccttcaagcaaacagaaaccctgattggttcaacaattactgatcaaccactactgtgcaccaggcagtgctgggtaccggaggcatttgccttggcctgttcttcttccacctgcggcacctcgaggaccacccgaggccctgagattgggagaggaagcctgttccataactggtcagccccacacctgcaagtaattgacagtgtgaccctgggcaagtcacttgccacgtttgagcttgggtgttcccaattgccctttgggaggattattcattcccgcctcacctgtccccagtccagctgggaaaggcatcacccggcttcctacaggtgacaccagtctgaataatacttgtggtgcacccatagccatggtgcagcctcttcctcccacagaccacggccttgacccccttcagcctcctggcccccagtatgggacagagccctggaatctgcattttaaagaaactcaaggtaattctgttatgggagggtatgtggacacacatggagaaattctggctcacaggataaagtctaagcttcctcaccacccccaactcattgatgaaaacttcgccctgctttccagcattggccccctctgtctcccaagggagggcctgcagccgtggccagactgctctgtccactccccaccctgagctcagcaatgagcctgctcttcttcttcttttgttttgttttgtttttcgagacagggtcttgctgtgtccctcaggctgcagtgcagtggtataatcacagctcactgcagcctccgtctcctgggctcaagccatccacccgcttcagtctcaatatttaggactacaggagtatgaccaccacatctggctaaattttttatttttctagtttttgagatgaggtctcactaccttgcccattctagtctcaaactctccggctcaggtgatcctcctgcctcagcctcccaagtagctgggattacaggcctaagcccccaggcctggtcagccctgctcttctcttatgacttccccaacttggaaagacttcctgacctccctatctctgcaagtctctttcccaccctgcaacatccaactcaaatgccttcaccttcctctatcaagctcagaatctccacttgacatcagttagggccaaacacacagaccatcatcatttcctgcctggattgctggctggcttttgactggctcatatcctagctttctaagctgactgtgagctccctgaggccaaccatccatcttgcagatccttgggttcaataacaaatgcttactgagcacctgcagaaacctatacagcagcaccctgctgggtgtacagaagaggaaggccgaatccctgcctagaggggagcccctctcatggagagacagatggaacttgcatatatgaccagggtagaaataaagacagggtaccacagaatcccagagtaaaggtcctaatgccatggggaaggggcactcagggggcagggaaggaaaactcagaaagagggagcagcacacgcaaaggattaaagtgtgacatgttctgcacaagagcaggggtgggggaggaagaaggatggagataacgggaacaggctgaactgggaatgctgagctaagggtctggattcatcctgtaggtcaagggttggcaaatccagccggctgcctgttttcgtacataaaattttactggaacacaaccacgcccattttttacatattatctgtggttgcttccaggctgcaatgacaaagtcaagagagactatatgcccggcaaagcttcaaatactatctggccattcagagcaaaagaatgctcattcctgccatagacgctggaagctatgggtggattttaagcagcagatagcagggtcagatttgtgtttcacgtttctatcactctcggatcatgctgggatgtgctggagcaggcaagccaggggaaagggaaggtggctgggaggctggtacagttttccaggtaggggatggagatcaacaacaacattgctgttttttattaagagattcattaagagttgctatgtgcccacactgggctgtgccctttacacatattcatttaatctgcagagtaactgctggatatagctagagttgttatctccatcctactgatgaggcacagagaagtgaagtcatttgcccaaggtcacgcagccagtatgagacagagcccggatgcaaacccagtggtccaaacctgagctggggccctcagtgccaagctccagggcttcagtgtcaagcatgtttttggcaacagatcccttcgagcctccctgggaatacacagaacacaaatcctctaaaggagaaaatctaccccagccgagtcaggcaggaagtgggaggcagcagtgtggctattttggagaagcgacacgagaaaccacgaaacttcctacctgtcccgttttgctcccatctgtcctcagaaacaaggctgcccctctccaagataaaaaggtgtttctccccacacagtggctctgccactggtggtgggagagagagcactaagcttagcacacacttgctatttttaaagggctatataaacaaacagggctatgtaaataagaaaaaaatgaggtcatccttttaaaacctaaaaatgtcccttttctatggggtgagcagcacaacctcagaaagcacaggggtttttctatccccttgaggcttctctagcccatggcctccaaaaaccaccaggcctggctctcttccttgcacccactgagtgaagggcaggtggcctgggagtcaggactcctgggtttcattcctgggtctgtgggctttgcctcaaatgcctaaggccaatgtgcaatcccagccaccaccatccagggaacctgacatccaaccccacgccggtctctcacaaacacggcccatgctccaggccctcctcctcctgtgccagccctggtttggcaagctgattctcctggcccctcgggtatcctttttcctccccactgcctcacaccttgacctgttgaatggccacagaggctctctgcatgccgatcagagtgacgtgtatgctccccacccccacttctctgcacacatgtttaccttgctccacgctcttctgcaccttttcttcaaaggcgcgggccagaggtcattaaagcagccccaggagctgagtttgctcatcaacaactgctaggagacttcccaagcctcagcagaagctcacatggcctccctgggttgcgaagagtactatttccactactgactgcactctccacagcatcacctcaacttctcccctccccatctctcctccttcctcctctgcctccaactctcagcatccgtggcccctccattatcctccagtacaaaaatgagaaccaccaatatttgctgaaggggtagtctccaaattgtgttccatgaaagtgtttcagaggctctccaaatgttccacgagcatgttattctaaaagtacagtttgactcctattctaacagaaaacgagcacgtacacacattcaaacatgctctatagcacatgggaacacactgaatatagccaacaagtgctgccggtttaatttggtttgtgcagacctcagatgaaggtctgggtagatcttgaccttcaccgttgaaatgtatcttcagttaggaagagtggagctcttcactgggtatctttgtgttgtcattttttaaattcaggactctatatgcgtacacaaaaccatacaagcaagtacactctgaagctttcaatgacaagacaatgtattatgtggattatcatgaaaatatcataaatgattgtggggcttcctgtctgacttatgtgtgtaataggaaggaattcaagcagttgttggatattgtcactgatgcaaaccagaattcccttctactcctccccaaatgcccagataatgttgaactgaagaccattctgtggctttaaggcaagctgttaacaatctgtcaccattcacatcatgttatggatgttgatttagaattccttggccaggcgcggtggctcacgcctgtaatcccagcactttgggaggccgaggtggatggatcacaaggtcaggagtttgagaccagcctggctgacatggtgaaaccccatctctaataaaaatacaaaaattagctggtgtggtggcatgcgcctgtaagcccagctatttgggaggctgaggcaggaaaatagcttgaacctgggaggcagagattgcagtgagccaagatcatgccattgcactccagcctggctgacagagcgagattccaactcaaaaaaaaaaaaaaaaaaaaaaaaaaaaaagaattccttaatactttgcagtcaagccaaacgaaacaagaaagaaaaaggaatattagatattgcagctgataaagcaagcaatacaatgatgatctagggcagaggtcagcaaacttcttctgtaaagggccaaatagtaagaactttagattttgtgaaacagacagtctcaagcagccatagataatgcatttaaaaaacggtgtggctatgttccaataaaactttaccgaatcaggcagcagcctggattaggcccacaggcaagtttgccaattcctgatctagaacctcagatttcaatgtgtttgtgcatcaaaacagaggtgtcgctaataacataataaatataacgttcataataaataataaataaatgtcaaaaactagacagccaggtgtggtggtccatgcctgtactcctagctactcaggaagctgagataggaggatcccttgagcccaggagtttgaggctgcagtgagctatgatcacaccactatactctagcctgggcaacagagcaagacagtatatatcaaaaataaataaataaagtcttttgcatctgacttaaattagactaagtctaaatggcaataatttggagataagaaataagaataaaaatgagaatttttaaacaatgttaaaaatttgaacttaaaaaataatgtattcataaaccatcattttaacctgttttatatattgacattccatgcaagatttggcttttaaaaatagcttctaagactataaaagtttgaaaactgctcaagtttctcattgctgagaaattgcttccatatccattttcaaatgagatctgtcctctagcttctcattcagaaagcacatttattctggagaaagccccacttcaggccccttctgaagagtggctgtgactccatgtttccctgccctcagtaattccacacatagctgtgcccaagcctctgatggtgctgatgggccaccccgccctccccagcaccggggcgtttgcagcactgcacacctctgtcttgttcggatgccatatatcccagctcctccctggtggctgggagggccgtgccagcagtggccgtgatcacctggactccagcagcaccaagtcagcacctcattaatcacaggcactttcttccccagggagaacacaggcagaggcaggagccaggtttctcgctggaactgacagctcatttccctctgggcaagtcccatactctacagattcttccaagcagctggctgagcccacacggacaaacaaagagtctgggcacgaagcggggggaggggagggaaatgccaagtctgcagaggaccccccatctgtactccctggacagttcccccatgtatctggcttgcatctctcagagggctctgcttctggactagttcaagtatctgttgtacacctcatggaatgaacccagatcctgtcctgagactgctcatgagacccctaaatggctgtgataggcacagaaggaaacaagtgctaagttgaggtaccaggaagtgccccaggatgccgagccaggggcatgctggggcattacagcatgatcgattcctatgaacatgtggacattcctggggaaggggtcatccttggagctgtcattgctcttcttcaggaagcatcttggtggagaaaaaagtgctgggtcttttgtaaccagaggctctgccccttaccatctgtgtagctgtctttaaactactgaacctctctgtgctcagtttccttatgtgcacaacaggggcaacaggaccagactcactgaggtttgggaaggactcgaacctgtctgtaaagtaccaaccatgtgggcagcagcatcggtccccgtgcttcagcctgacctcagggacacagcactggggccagagggcagggcatgcagatggcacagggctgcaactgggagagcagggtggtggcccaactgcccacacacgccagaagggtgactcacgtttgggaggtccttgttaacgtggctggcaacattctaggggccttccccagcaaccctgcgaggcaggtatcactaccagcctcattttgcaagtgagaaggatgaggcagagttggagcaatttgcctcttaaaccagtaagtgcctcacacaaccactaagagtcggggctgggatttgaactcagggtgggtctacactgttaagtaccacaacaaacatcccctcttaaaatgaggctccaatgcccagttcttccttggaatccagggaacgattcctttacctcctcaggagaaccctggtctaggcctagggctggtaggcccaagctgtcatactgtgggcagagacacaggctctagccaccccgaagtccaggcagcaacagcgatgccatctctgagggctgcctgtggccccatccccttctctatacagtgaggaaacttcagctttcagagaagcgaaagagtcactgctcctggcatgccaggctgggaaatgttgccttggaaatctcagctgggcccacagacccaaacacaggcccccagaaggaggccctggagtccccaagccttggctgcatcagaatcaatgtagattcctgggtccccaacccccaagagtctgatgcagagggcacaggtaggccagagaactccctccctccgtccatccctccctccctcccttccttccttcctttgtcataccaggcaccctctttctaatccccagctctctgggtgattctggctctccacaccagagaaaacatccaaggacttgttcttgacccaacaagcttctaacactgcacacctaacctgtactgaagcctgaacatctagccagaaaccacagcacatacctgaagatctaaatgcatatataaacataagctgataccaggcctctccccaggctcatttgatcactatttcgggagctggggccctgctattgaaattgctgaaattccaagaatcattgccccaaccctgacatcttttcaattcttcacaacttgggggcaggtggggtgagaaaggggactgaagacctgctgctatgtctctaactcccgtggtgctcctctgactaggcattgggtgggcagtggtggtcttcagcaagaaccattatgtaggagaagagggtagacctctggctatcaggagcacacagttggactggcttgtggaggctgtggcccctggagagggggctgtggccctttgagaggagctgttgtgtcctttgccaggacagaatggaaactgaggtactgggagggggcggactgcatttcatgggagacagcatgggaagcagtagccagttgctggcactcaaggtctctactcctgaccaaggaaggttgaggactttcacaacaactttcacagaggcaccagaaaggcaacgataacactaataataacaataatacatttttcagaggaagaactaagcaagctcatgcaagacagaccaacatggcgcctggcaagcatattcagcaacagcccccatttcctacctgtgctgaaggcaccacttccgatgaccaaaactgaaacgctgttctctctgaaagccagcattcatgtccactcctacggcagccaccctccacctaggcgccgctcttcccaccagaggggcgggcttgcttggccaggaccccgcgaggctcctccatgaactaggttgaggctgctgggtttgtgcctcgaatcctgcaggagatgattgagaaacatggtcaaagaactttcttggtcaacttttttagacacagaacaatccctgcctggtccctggaggacacaccccccaactactcccaagcagctttacttggtacagggcctgatccccacatccccctactttgcatccaacacttaacttctctgagcctctatttcttcactagtgtggtaggcagaattctaagatggccctcaagatttccggttcccctggtgcacagaccctgcaaagcccccaggactgtgaataggatggatggttgggttatgttacagggcacaactgaccttaagagagggggattatcaagacctggcctggtatgaaagccctttaaaaacagaatttgcaggaaatgccattctggtcaccagccttgggaaaagtatttatggctaagtgctcaaaagcaattgcaacaaaaacaaaaattggcaagtaggcctaattaaactaaagagcgtctgcacagcaaaagaaactatcaatagagtaaatagacaacctacagaatgggagaaaatgtctacaaactgtgcatccaacgaagatctaatattcagaatctataaggaacttaaacaattcaacaagcaaaaaccaaataatcccattaaaaagtaggcaaaggacacgaatagacacttctcaaaacaagacatacaagtggccaccaaacatgaaaaaaatgctcaacgtcactaatcatcagagaaatgcaaatcaaaaccacaatgaaatgccatctcacaccagtcagaatgtctattactaaaaaggcaaaaaaacaacagatgctggcgagaccgtggagagaagggaatgcttatacgcggttggcaggaatgtaaggtagctcagccactgtggaaagcagtttggaaatttctcaaagaacttcaaacagaacgaccattcgacccagaaattccattactgagtatataaccaaaggaaaataagttattctgccaaaaagacacacgcatttgtatgttcactccagcactattcacaatagcaaagacatggaatcaacctacatgcccatgagtggtggatgaggtaaagaaaatgtgatgcatatacaccatggaatattatgtagtcataaaaaagaacaaaatcatgtccttgacagcatcatggatgcacctggaggccattatcctaagagaattaacacaggcacagaaaatcaaatgccatgtgttttcacctataagcaggagctaaacattgggtacacatggacataaagatgggaacgacagacactagtaactactgggtgggggagagagagggagggacaagggctgaaaaactacctagtgcgtactatgctcactacctgggtgacaggatcattctactccaaacctcagcatcacataatatacccaaacctgcacatgtaccccaaatctaatagaaaagttgaaattatttttaaaaagcagagttttctctggctaatcacaggagaggaagtcagagagattagggtctggagaaagcttcatcataccctcaccgccttgaagatggagggttgtatggaaaggattggcccgcagcttccaggagctgacagcaaccccggctgatgaccagcaaaaaacaggacctcagtcctaccattgtagggaactgagtcttgtcaacaccttgaatgagcttggaaagcagaatgttccccagagcttccagatgagaacccagcccaccaacaccttgattcagccctgagcagagaatccagccactctgtaccagacttctgccctacagacccgtgagctaacaaatgggtgttattctaagtcactaaattggaggagatttgttatgcagcaagagaaaactaatacagcctggaaaactgactcatattcaggcatgggtggcaatgaaatacagtaatagacataaaagcatattgtattccccaaatcacaaaataaaacaggccaagagaggcctgtttcagggcaggagctcaacagtgattcctgaatgaatacacaaatgagtattggtttttaataactgacttgccaggctgttgtaaggatcaaataaggaaatatagaggaagatgctttgtaaactagaaagccgaagttgtttcagtcagtggtggcgtggcgtgtcatatccacgccgtgctctttggaggatgctctggtttgcccgctgcaggcagtgtcgtgggatggatgagaatgtggcttccagggccaggtatacctggttcaaatctagcccttccacttctgacgtctgcaacttgagaaagttgcattgccttgctgtgcctggcaagtggggctaagaatggtgagtgccttccagggcccgtactttaatgagtccgtacatggaaaaaggttggaacaatgcctggcacggcccacgtaactgctctgaatattatctcagagtggaacccaataatctgggtctggagtaacccgcacacaggcctggggcactgttacctttctcctcttgggcaccctgctttttattcacacagcctcagaatcacgtttggcaaccatatcgcactgctgattcctacagagcatacaggtcaccgatgcccccctgctgtccccttcccaatgtacctgctgctatgaaacccagccagccccctcctacccccagggcagcatcgcagcaccacacagtggagaggcttgctctgtggctctatcaatcagttcctgattctgccgtccgaaccagcccaatttctcactactctgtgggtttctatcctccctgatctgacctcatgccctccaatagattgcagttattaatcaaaatggccgtgctctcttcctcccagtgtagaaacactcacttctcagaacacgctattctacaaacacaatctacagtttcctacctctgagccttggctcaggcagcctcttctgcatgggatgctactcacctccctctgcaatcgtgcccaccttgctgaatcctgcccatcttccctcaggaggttcagctagctcccataaaactggacctaagttctgcctctccagaataccccaagcacatttgctgtgctcctcctaaggtaaataacagcatccactgtgctcagccacggcttaaagcccttctagattgcatacaactcaggcagggtcattctgactcactccctcaccccgagtatggcctgtcacacacagtcagtgtggaacaattctctttagcgcccaagttggttgtttattcatttaacagatgtccactcagtgcctattttgggtagagccgggttgtaggtgccagcgttaatagatggcaaagatttaatctctatcttcaaggggagcacggagtaggggtagtcaattttgatggtgtctgaatgtgtaagagagagaaaaaagaaagaggatatttaaaacaaagggagtcatgtaagaaaagacagatctcttgacctcgtgatccacctgtcaaggcctcccaaagtgctgggattacaggcatgagccaccacgcctggcggatcacgggttcaagagatcgagaccatcctggccaacatggtgaaaccctgtctctactgaaaatacaaaaattagccaggcgtggtggcacatgcctgcagtctcaggtacttgggagggtaaggcaggagaattgcttgaacccaagagacagaggttgcagtgagccaagattgtgccactgcactccagcctgggtgacacagcaagactccaactcaaagaaaaaaaaaagaataaaaaaaagataaaaagaaaggacagaggacccccaaatggccagaatgttcaagaaaattgcatggtgtccacatggctggaggtgaggggcagcgacagtgggaggtgctgtgtaggggccgggacatgacggtttgacagatgaagtggcctggatgtggtggtgctgtgaagtgaggtcattttcatcagtgaggtcctgcagccagggtgaggggtgtggcttgaggagaaaggatcaggtggaaggagagagacttcttctggctgcggtcgtgaggctggtgtcactgactgtccccagtctccccctccgtggcaggtcagagggctgcccaccacacccgtgtccaggtcaccagaaaaggtcacacacacctgagggcctagatggcaaaccgagcccatttatctccctcttctcccccccgcaacacccctcaaataaaaggagaaatgtgcaaataagaacagatctgcagtagcatcagctggccagaaagtccgagggaaaacagacgagagggagtgacaggaaatctaatcagagcgaagctagcctcacccagccgggcagtgagggcccacctgccaggcaccccaggacttgctcagagctcctccatggcagggcgggctggagtggggtcctgaaatcccccccaaaaagagtggatcctctcagtttccaaaatgaccaaagtgagagttgggcagggaggtactgggagcagaaagtacctccccacacacctttctgccttcaactgcatgactttattatcccaggagcctctctccctggcaaatggcttcactgttcatcacagaaacctcctgaaggacccatctactcttcaatcaacagctggtgccctacgattctctgaatcccttgcctggcctcaaaatccctcacctcatggcttccaccagtcctggactactgtgttccttacacaaccctaaccaagcccccacattgacacacccaccttaaagagaactgctaggcttcagaaaacccaaccttgcctccttcctcccagacaggccaaagccctctggaatcagcaccctcccttcggcaagtgagtaataaactcagctttgccttaccaacaagtttgtagatgatatctggggagctggcatttgacagtctctacaaaaatgcttggaatcaaattgacattcaatttggtatctgcatcatttacaacagggcagacctccgagcttggaggaaaaagggttaaaacccttagatccgttactcagccaagtctcaaagccagagagaagtataaaatagtgtgacacccaccacccacgcatcttttcttaaaaaaaaaaaaaattactcgaggaatcactcaaaggaaataagaattgtaccagaataagtaattcaaaaaaggacaatataggatatccaagaaacagggagaaataataaaagcagaaaaaggtgaagtgaagtctaaacaaatgttgataatcatgatcctatcttgttgggaattagatactatttaattcttgacatcaatagagaaatctgtgtaaaaactaaccatttctagaagaaaagcaagatgcaaaccttttaaaccactgtgtggggagaggggaagggagaaacaaagaaaactctattaatttagccaagagtgggaaaagaaaaattaaacaggaaagaaaaagtgtaataaacaaaagacataaaataagatgacaaaagacacaataatatgaataaattaaattactttaagttaagagaccaggctggataaaaggaaaaaaaaatccagctatatgctgtttggaaataacacacttaaaacaaactgacaaaaaagatggaaatcaaataaatggaaaaaagcaaatggtaacgaaaataatgcgagaaagccaatattaatatcagacaaaatgcaaaaatgttaattaaatacactaaactggggccttttatattgccgaagagtctatttctccaaggagatacaaaaatcacgaacttttactctcatcataaacacagaaccacaaaatgtataaaataagacattcttggaatcacaaggaggaggtaaagaaagaacaggaaatgtcttgagcattattatttgaaatttggtggtataagtaacctccaaagaagaatacaaagggtttgaagatgtagttagtaagtttaacttcatatacattcaagaaatagagaaaacacctttttctcaaatgtccctgtactagactgcaagaaaatctcaaattccaaaatgcacgaattgtacggaccacagcctcagttcttgatgaaataaaattagacattaacaaatagcaaaaaataaaaatacataaacaaatgatgcacatgacaatttaaaaatgcttttctaaaaaaactcttgaatcaaagaggacagcaacgctatcgtaggataattataaatgtacaacattgagaaccctacttttcaaaatctgagtagtgcaatcaaagctgcatctagaagaaaatacaaagcttagatgttttcatgataaattaagaaaggttgaaactaaatgagttaagcacataacccaagaaactaaaaaagaatgaaataaaccaaagtaatctagaagaaatgaataaagttgaaaataaaacgagtgagaaaatgacagcaaccacaactatatatatatatacacacacatatatacatatatagctgcatatatacatatatgcacgtatatgtatgtatatatacatacatatacatacgtatgtatatatacatacatatacatacgtatgtatatatacatacatatacatacgtatgtatatatacatacatatacatacgtatgtatatatacatacatagctgcaagctaagctttctgagaagaccaacaaaatggacaaatcggtggcaaatctgactagcagtaataggcaaagtcgcaaataatcattaagaaaggtgatgtaaacatatacgtgaacattttgaaaaatcaaagagaatttgatacataactgtgtcaatgaatttacaagttggtgattttctagaaaagtataaattgtaaaactgaagaagagggagaaaacctaggtagactctaataactatagaagaaactatagaagagaaggctgtcgaagatggaattccagattagcagagaaagaatggattatttaaataaaagcactaggacaactggctggctgtttattcattcaacaaatatttattaagaacctactatgtgctgggcattgttctgggcactgggaattcagcagtgaacaaaacagaaaaggtctatgcccttatggagctgagagtctggtgaggggagatgagtaacaaacaaatccgcaggtaaaacaaaccacatggcaaatagtggcaggtgttacaatgaaaattaagcagcaaaatgggtacagaatgaggaagggtggagaatgccattttaaatagaatacacgcaccatagacacacagaaatgtatatggattagagatataaacatcctataaaagcaagttcatgaaaataccagaactattaaaatatttctatactttagtgttggaaaataactttcaaagcccgaattggacctcagtgctcttaatggaaaagattaataaatctaactacataaaaatattaagcattacataaaacaaaaaaccccagttaatcaacagttaaaaagcaaatgacagattggataaaaatatttgcaacatatatgaaaaagtgtcaatatccataatatgtaataagcatccacaaaacagtaagacatatagccaataaaatggagaaagaaaatgaacagatcattgcttaagaaataaaaatgtctaataaatatatgcaaaatgctggcctcgttaataaagaatatatttaaaaatgtggatcacttgaggtcaggagttcaaaaccagcctgtccaacatggtgaaaccccgtctctactaaaaatacaaaaattagcccagcatggtggcacatgcctgtaatcccagctacttgggaggctgaggcaggagaatcgcttgaaaccgggaggcagaggttgcagtgagccgagattgtgccattgcactccagcctgggcaacaagagcgaaactccatctcaaaaaaaaaaaaaaaaaaaatcggtatcaccttttcccatttggttagcaaagaggaaagtgattgctaccatcaagtggtggagggaggagtcgtcatcaaatacttctcaaatactgctagtaggtatagatgaggagaatcttttaaccgtgtctaccaaaatgtatgttgactcggcagctttgcagtgtgcacacacatcatcatacacaaacatacacacacatgcacacatagggatgaccactgtagcactattttaacagtgaggatggatgcagccttaatgaccatcagcaggaaattggtttaataagtaaatgatgataaatacacacaatggaatagtcatgggaacataacttttcttaaagataaacatatactcctaccaataacagagattcattgtggctttgtctatgtatcaagctttgtctatgtgacgtacaagcttcagcgcttctcacaggtagtctccctgcccccctccctcaacagtctgccgggtggaaggtgccacttctgcccccattttccatctgaggcctacagaggctaaggcctgaccaagcggtgaaccttggtctgttagactctggagactgcactctcagctgtgacacacacttcctctcaacgggatggtgaaaagcaaaatcacagacacacatctatctgtgtagctgtgacggatggaaaggacctgggggatgcaatcttgtcctggagggcactgcagaatgggtggggcttgaaacatgcgttcttgtttctacatttccatactgttctttttttaagcactaagcatgtatcacttttgtaatttgaaaatgatataaaagtatagagacagaaggtagaataggggttgtccggaactggggcagagcagaatggggggtcagtgtttaataagcacagaacttcagttttacaagatgaaaacagttaagaggccaatatcttaagtgaaacaactaagaaacagaaaatcaaatactgcatattctcacttataagtggaatctaaataatgtgtacacatggacacgaagtgtggaataatagacgctggaggctctgaagttgggagagtgggaagggtaagggatgagaaatcacttactgcatacaatgtacattatttgggtgacggttgtactaaaaacccacacttcaccgctatgtaatatatccatgtaacaaaattgcatttgtaccccttaagtttatacaaagaaagaagagaaagaaagaaagagagagacagagaaataaagaaagagagagaaagaaagaaagaaagaaagaaagaggaaggaaggaaggagagagaaagaaaggaaaaggaaagaaagaaagaaagggagagagagagaaagaaagaaaaaggaaagaaagaaagggagagagagagaaagaaagaaaagaaagaaaggaaggaagtaaggaagaaaaggaagaaagaaagaaagagaaaagaagagatggatggtggtgatgggtgcataactttttgaatgtatttaataacactaaactgtacatttaaaaatgattaagatggtaaattatgttatgtgtattttaccataataaaaattgagaaactgatataaaagtgtcttctttttagaaaacagttgaacagggagggggctactaggggtagaggggcccatctgcaaggtggcacccacccagggcaggaaggaccagggccagctcctctgctggccccacccaaaatcatgaggagggagggcccttgctctccactctccaccaacacatcaaagcaaggcctttgccagcagctggtaggggccgcatccggtctgggcactgggggttggcatcactgcagctgacaaagggttaaagaaaaatcctggatgcctggcaggggccagcctcactgggtcataacagctgttttccaagggctggcagggaggcaggggggctttggactctggcactgggcctcacacactgatcctaaagaaagtggagaagaaggctggccctgaggcccctgccaccctcctgacaccctcctgacacgtggcccttccctccactctgaacggaacgtctgcagaaggggccggcacatggaaagtcaaatttgatctgtgtggggcagggaattgtgggatgaatctttctattttcagttttatttgttattgtggtctgtgatcaataagaaaacatgaaaatctaagacatgggtcacacatggcagaatcatatggaataatcctggtggttcatgctgggatactggcaaaggggtggatgggaggggaagagagagaattactggcatgcctcatttacccagcaccacagaagtagcatggtatagcatagcgagttggccttaacatcatcagaaagacatgggttcagaccctggtttcatccattactagctcactttcctcatgagtcagaagtgaagactctcaccccctccctgggtttgccacgtggatcagatgcgacaaagtgtatgtgaaatgagtatgaacccagtatacaaaaggcactcaataaatgcctgtgcccttcttcagttatggtgggacaccttccaagtctctctccctctgtcaatctctcctccttctggcttctgttttggggtttggggttggctctgtgacccacctccctctctgtggtcagccttccggctctcactttcctgaggggctcacctttgtttcagcggagtgcgctctagtctgagaatgctgtgacatgcagctgacagcctggaggctgccttgggaaccttcccggtccccagctgtgttctccagacaagaggcttctctctcacatggtagctgactcacggatgagtgaggcgtccccaacaaggagagtgggcagagagacaggcaatggagtccagtcattgatagcgacaagacctgctttgaggatacccagaaatgttttccaggaaagacagggcatttaaaaatagagaatggtgatactttccattgtatgaaggagcaaaaaagaagaacttcaagtacaagataacatattccatttagtggcaggtaggaatatactgtctcataaactctacactgggatttggcagaagaaaagttcatggttttcaggcactgcagggacaaggaagggaggtgttgctggtgtatatggggagcacccagcccaggagtcgaggagaataccggagtggcgggaggaggaacagacgagactggaggagctgcacttggagatgaaggttctgagagctgctggggcgggggttggggggcgggggaaggtaggtgtgggaggagcagtgaggtcgcttcctgctatatcaggccacacctcgcagccctctgtcacagaaagccccctggaactaggcactctacacaggggagcagagaagacaccgtgttccctctctgggtgcaatagaaatcccatgaggcagccccacatttgaggtccagctgcacccagctaagtgaccttggacaagacactctccatcactgggctagaccccagggtgcaaaggtgaagaagaccttgtccatgtctcaggctgtgatggatctagcagggaagatagataagaaaatcagtggttctggccctttctcccagggagcccaaaacctgagctgcttccccgcaagaaggcttctaaatctccccgggttgtagacacagaagccagaggtagaggaagaacccaacatttgttgagtgtcttccacgtgcaaaggctgtccctgcattttttcacagtcatactaatgctacggtcaggctccatcatcaccatctgacaactgaggaaactgaggctttgaaaacagagagatgtggacagccttgcactgcaggagggcccaaggctctggcattaaataaaactggacattactggtcttagacactgtgtggccttcttcgagtccttgaccacctgtgagtctgtttcctcacctctgaaacaagagcaagagtgcacgccctgggctggggtaagaacaaaatggtacggttggcttcccagaaaaatccaccttctccctcttcctcttctggttacttctgatcttttagctttacttatgtttatgattatttcatcttctaaaataagaagataccagatcccataacaagattgctgcaacttattcacagcaaagcaggtggaggcctcgggagatcccggggactacagaacctccaccactggcccacagtaggacaggggcagggagtaattcatgcctactaggaagactgtgataacaggtgtgtgtttttggaggcagaattgctttctgcccacacgacagctgcccccttagctaagaggggaagcctggtgacccagggtcctccggggacccagccaggcttctggtctagatctcaacctgccccactcctgcccagtgctaccccatcttccaccccatccccacctccaccagttcagagattcagccagacagaaaggctgtgccaaaggaaattgtgtgccacagggcccacttggtctgctgtggtgttcttcctttttttggactttgtggctgtttgagtgggtacctttttccatagaaagtttccattgcatcagttatttacattgtcaccacctatatgtgggctctggtttcgagtcggtgaaccagagcaggccctgtggggcccaacactgcttacagggggtgacaggagccagttgctacggcaagaggacctgcagctctgggtcaaccctcagagccacccccaaccctggcaggtccactcttagtgtgctcagtccctttgggatgccatttttagggtgagatttaagagaatttaagagcacaggctactaggtttgcatcccgcctcctccacctcctagctatgctctgagttattgacatgacatctccgggcctccgtgaactatcatttgtaaagtgggaatgacagtggcgcctacctggctggactttgagaaggactcaatcaggtagtgcacataaagtgcttagaacagggcctggcccaaagcctcaatccatgttaatgaatggacaaggatttcctgcccccaccctggctcagaccctactgcccatcctctcttgtgtgaaccaacagcaacagcgtctgcactgtcctgcccagcccaccgatccatagacccagacagactgtcctgatagccagctctcaccaagtcactcctcgccccaaatcccaaatccttcagtggttctccttagagagtaatgtctgcactttacaaatatgccaggctgcctcggcatcaacactcccctgcaaagccccgctcttgccaactgccatgctccacattcatgcctctttgcagttgtctctgtctggaatatttctctccattttaacgtggctaaatccaacccacaccagcctgggtgagcccacctcataggcctcctcctccacaaagccctccatgactctactctctctctggccaggaatgatctttcatttaaggatttgatctctttgtcgtggtgtttaccttctctaccttgtatgggtgcaatataatacatacaaatgtgtgtgggcatcacagacaaaccatctgatctctgaggacaggactgggatgtgtgtgatgcatccgtgtcactcacagagccttgaacataattggtgactgtgagtgaataaatactgaattctctcaatttactaaccccgtcgacagggaaagctatttgggtgtgtgttggtgaagatcaatctgcagcccatcagtgtccacatgatcctctcggttcttcttgagggacccggcagactggggtgtcagccaggggccaggacccctaggggctcacagctactcagactctgagtctcagcatgggaccttgcatctgaggcatgtgtggaagtccaggaaccatcactgacttcttctccctcttcctcagcctccaccttccatatgtcaccaggttctcagtgaatcagctccctaagttcctacgcccatgagcccctctccaccctaccgccaccgtcttggcctaggcttcagcatccttgcctcctccctggtctccccatgtgactcccatccttttctgggtcttctctccatgctgctgccccaagcggtacttctgcatcacagctctgattaggccacaatgcttcttgccacttctgatgcctgctgactgccatcagaaacccagatcccctaggaaggtgctggagtgtctctcttctctaacgcttctaaccctcatccagagctttggtgtaacatcaatcacactgtccagcgacatttattcccctgcacacgggtcttcctcgcagacagggagtgccttcagggcaagaacatgtcccgtctgtacccccagtgcttggcatgcagtcagcctgctgtgaaagcatgctgaacagacgagtgcatgaataacaatgaattaaacacaccaccactgccctgccttccagtgttgccctgacaccaccatattcaggacctcatttttgggaccaagcaacaggtgaagttactaaagtgacagatacacagtctgcctggaccaaaggttgccccagggcacttgacatccctctgtctgtgctgcagctcccagaacccctgatggcctaatgtcagcagggcagatgcttgccctggtgttagctacatggcctaggaacctggagacggacagaggtcttagggtgtttccagaaggaggggaaggaaagtgaagggcgttccacctctggtcgctctgtaccaagaccttccatgttgttaccttcccctctgcccacccccctcaccccctccccaaattgtgtctgccttcccatcctcttttttttttttttttgacagggtctggctctgttgcctaggctggagtacaacagcacaatcttggctcactgcaacctctgcctcctgggctcaagccattctcccatctcagtctccagagtagctcggactacaggtgcgtgccaccacacccagctaatttttttatttttgtggagatgaggtctcactatgttgcccaggctggtctcaaactcctgagctcaagtgatccacccaccttggcctctcaaagtgctgggattacaggtgtgagccaccgtgcctggcaaaccttcctatcctcttattcctcaccagggtcacctccctgtttccctgtcaggctgtggccacctattgtgcctgaagtagctaaactcatggacctatgggacagtacgtgtggtgaggaggtgggtgaacaggacctgggatctgaccacacccctaccattaactggccacgtgaccaagaacaaatcacattctcttctaggcctcagtttcccctcctctcaaaccaaaaacctgaacaagtctgtctctaaggaccccttctgtttaactccctgtcaggaggttgatttctttaccagccagaataattctttctaattaaaggaaacaaacagagagaacgatgtgtctttctctgctgctcctgaaagccaggatggcctctaactctcagaatataagtcagatccccttttgattactgaaggaatgtctccatttggtggcaatcttcatgcccatataacccagggatttaaagcacacttgcatatctgttcttttttttttttttttttttttttggatgttaacaattgggtaagctaggcctttatcattctcattttgcagagtgaggctcagggaggtgaggattatccaaagtcccccagcaagcaagagggagaagaggaactggctcccaggatattataccacagctggcccaggtcgttggcctaggagctggcctcacccaacaggcaggcaagatactttaataaaacaatagcacacatctccctgtatttttatacaagctttcttcatgcatgcagaaacactctgacgcatgggtacccaaagcttcacagtgagctggtgggatgcctaattcctagaagccaggctccacccagacccaacattccagagaacaggcaatactgagaaccatgctttgtccaggcagagaatccttggttttgaacactccagcccctgctgctatcccaggcctccaagcccttgaatcgaatccaggccagcagaagctctgctgcacaagacagggcaatgccttgttcctcttggacccccaggccctgctggctgcagggctccttctctgagactcccaagggagggctgactgcatgtgatctgaccgccacacagggagggagagaagatgagggcctagggccctagaagagaaggaagtagggttgcaattctaggcccttcttccaacctggctctccctcttattgctcatggtcttgtactgttactttaagaacatattgatcctgccttccatattttactgggaactccttaacagagtctccacagtaggtcctccacatgcacctgtgcagtgcacagcctgcacaaccattcacaacctatggcttctggccatcccctgcatagtatgtatcaccactgtaattaaaaaactaattgcataattacttattctgccttcacagaatataaatcctcaggggagcaccaggccctgtttgtcttgttcccaagctgtagcccagcctccagcacggtgttaacagagaataggtgctcagtaaatacatgctgggctaatgaacccaaccaaccattcgttcatgcattcagtttgaaagagagtgaacctgccctgcaactgaaggtgacaggcctctgttgtggccccagctctaccaatgtgtgtccctgagcaaggcatttccctttctaggtctgttccctcatctataaaatagtgtggggtttactctccatgccacatttgcacgaccccgaggaaaagcacctccttaaattttgcaccccgggcaccttgctcacctcacccatcatgacctgaccctggttttctacattttcctggttttgtccagacctgggcttatgggagatgctcggtgaagtcaggagaagggggcttccaggcagcattcaggggatgccaaggttgggagaggagtttttactcctgggctgtatctctgggagagaaaaataacagacagcagtacttccccaggagagcagtgtcttcaaaggccttcttcatcagccttgtttaacctccagcctatggagaaggaaggagggaagggttggctcaagatccaagttaccaagtgtcagggccaggggcaaaccccaggcaccctgtgttcagatccagacccttcagcatgcggacacagcctggctcccatgagtgcggggcacaaccagtttcagccggcagaggcacacacagtagcagaggaaggagatgttccttgcaggagatgggacgggagccttgagaaacaggagggcttatggagaaggatggggtggcattcctggcagaagagatgatgtctgcacagtgtgcctgcaggagaccatgttcaagggtctatgaccactttcttacttgcagagtggtctggccaacggggacccatgagggtgaggcacaaggcaaagctcagatggagataaaacagaagagcacgactacagagtcctctgcctccagggcactccaaggacctcttccccatcatggcctcagcctccctgttgtactgcatactttagttttgtaaggcttctgtaacaaattatcaccaatttaagccaaacttaatggcttaaaacaacacaaacttattatctgagaggtctggaggtcacacatccaaaatgggtctcactgggctaaaatccaggtgttaacagggctgcattgctttctggaggctccagggaagaatctgtttcctccttttccagcttctagaagctgtactccttctttggctcatggcctcctcaaagacatcaatggccaggtcaagtctttctcacactgcaacctcctggcactgactcttctgcctctgtttaccacacttaaaggcccttgagattccactgggaccttgtgggtaatccaggacaatcaccctactctaaagccagctgattggcaatcttaattccatctgctaccttccctcccctttgccctggaacccaccatactcatagacttcgagaattaggatgcacacacctttgagtggggcattattctgcctttcacactgtgtgaggcacatctcctccaaatggggttttggaaggaaggtggcccaggatgagagagatggggtggatggtgtgggcaggagagggaggcaggcagacacacactcaccctcctggctgcctgcttagcacacatcaccattgaaaactttgtcatgtttccatgctgaaccgggcacaagctgtttccacagtgactgcaagagcagaagcagagccagaaataaccccactgacatggaaagcctccccttcccttggtactttgctctctccttctccactctccccatcatagtatgggaggttccagtgggttctaagttggaggcccttccagggcacgctgaggccttggggaacactcctcctgcagcctggctccagcagggggaacatagggatctgactgtggggctgggcctggtcacctcatttccacaccactgtagtgagcttggagtctcctctcctcagcctcactgcctctgagccacaagtccctacaaagtcccaatcgctccttcttggatctcttgccaccaaacactgggatccgcagaacactcttggtctcttgggccagaagcccatgggatgttctgatctggccccctccttgggcctctgggaggcccctgactggtgaggccctgcctggtgggcctgggacccactctcacaagccctgccagcccccagcccagtccttgctactggtgagccttgccagcctgctcagtctccctgcaccaggagccctatctgggaagctgggctcaaaccctaccttctccaaaagcccctctttctacaggttttttccttagaacaagatctcacccactgcaggggctgaaacatttgctgaaatatatagaccaacgaatgcccgggcctcaccatccataccactccctcatatggcattgtgtctctatggccctgggaaatgtcctccacgactgtttaatttctcatgtctttcatcctagtccgacaaaggaaaatggagttaatgcacctcctacctgctgggcactgagcaaagtattaaacgagcatgcatcggcacatttcatccctcacctccactcaaccatcatcaccaccatcttacagagacgcaactgacttgcccaaggtcacatagccagaaggtggcagggcccagactggacctctgtgtgccagactccaaagcctgaggctgcagccaccatgtcccactaggggggccaggggaggagacacagagatgatcaatagcaaatgctaaacgaaatgtgtccaatttgcctcctagaaagccctgagcagctcaaggtgtctccaatttttgtctctttgtatgtattgggatttggcctaagattttatttgggttttcaaaaagttgggaggatatggaggggggttacatgaatttaaaagttcggaggacatggactgtaggccaaccccatccttgtaccaatggcaagaccaaggcatggaagtggaagtgacttgcccaaagtcatggcctctgccactgaagccagtgaactccacttgtttctcccacccattccttgatggagaggacatcgtatgctccacttagcccttggcactgcttggcacagaatttagagtccaatgtggtatgggtcctggatcctgctttaacagtgctgcatagttgatggcttggtagctcaagtgctcagagcctctgcgtccttgtctgcacagcagagcctgtgtggatttattcgagaaggcatagacctgctttggatcatataatattaggatcacgggtaacagagctgggccctgagccacttctacgggaagatggaaagagctctatatttagactcaaaagcctcaagtagagtcccagttctgatgctcatcactttgtggccggagcctcccacttgacttcattgagtcttactctgggagacaaaaatgtctcccataaggggttggtatgaattgaaatgaggtaacacatgtggaaacactggaggcataagaatcctctgggttgcagaatcccaggctccaccttctcccactgtctgattctacagctgcggggcagggcccaggaatctgtatttccccaatcccctcattccccaccatgattctgttgcagttagtcaacaggccacactgcaagaaatccctctaaaaagggctcaatatgtgtttgttaaatacacgaatccttgaacatctgttgagctgcatatggctgctaggagacatgggccgaaggaaataagtaattttccccaaatacatttcctatgaaatctaaatgatgggaattgggttggggcttcgaagactaggagatgatgcaataatagcttccttctccaaagagctcctccccttagatggggagagacctggctggagggtcatgcccagtggctcaggatcaaatgcggggaggggtgctctggagacggagtcccctggggatgagttccagaccctgttctcttcagcatcttcatgaagacaggaaagaaataactgaaaatatgctcattaaatctgcatctggcacccaatttggcagggttgccaaaattctgtaagactagaattaaattagcaaattgcaagtaaaatgattttaagcaggcatgatggaattcatcagggccaggtggaagctcatgggggaagggagtcaggaaagcccacatccccgggggtgggaaagcctggccgggaacggaaacggaaaagaaacaaaccggcaagcagaaatgacccaaatccttaagattcacccttggaatgtggtggtgacagaggcagccccacactgcaaggtggctagaggctccttctgggagccaggaggtgtggctgggcagcacccggttaaggatggcagctcttcaaaagagggtcaagaagaaaggacccgagggactgctggggaatgggaggggtgggtcctttagactggcggccccacaagggcagacacgtgggcggtgacagagcagtggcatgtgttgacactgctgaagcaccattgcgtgcttactgatctcacagtcagggaaaaacactggcatgggcatggcgggggcaggggaggtacagactctgaggaaggaagaagaggctagaagcatttcctgggcgcttgctaagtgtcaggcactgtgttaaatatttgtcaagtattataatctcatctaatcatcacaataatcctgtaatgtaaagagtcttcttttctctttattttcttgggttttcttttttgttttctgggtttttttttttttttaatgaagagatatttaaagtaagaagtagacaagtcctgcttcatcctctcaaagcctatttcccagatgaaaccaccaagcatagttcactgggcttgttcccaggctgtttctctgagcgcagaaacatttctacatgtgcatacacagacttaactgtttaacttttcctgtataaaaatgagattgtcctaaacatattacacagaaacctttttccagttaagaatacattctgaatatcctcccacgttaagacctgaaggatcatttctttcttttgaaatggccacaaagtattctctggcacaaatgcaccataaattttttaagcattgtctctgctggacactgaggtcatttccaatttctctctatttcaaacaatgctacaagggagtacctttgtacacatatatttttgagtacatatttttctatagccagggaattgctggaccaaagtgggtacagtcagctctatctgtgggttccacatccatggattcaaccaatcgaggatcaaaaatagttggaacaaaaattccagctgggcgcagtagctcatacctgtaatcccagcactttgggaggccaaggcaggcagatctcttgagtttaggagttcgagaccagcctggccaacacggtgaagccccgtctctactaaaaatacaagaaattagctgggcatggtggcacacgcttgtaatcccagctacttgggaggctgaggcaggagaatcgcttgaacttgggaggtggaagttgcagtgacccgagatagcaccattgcactccggcctgggcaacaagagcgaaactccatctcaaaaaaaaaaaaaaaaaaaaaatccacaaagttccaaaaagccaaacttgaatttgttgtgtgccaaggactatgtgatccacataaatgaagtgatatgtaggcaatgtattaggtatcgtaaataatctagagatgacttacatatacaggaggatgtgtgtaggttatgtgcaaacactacaccattttatataaaggacttgagtagctgtggattttggaaccctcagggcatcctggaaccaattccccatggataccaagggatgactgaatatgcatttataattttcattgataccaatttagattctcaagaccctttggcccttgccagtactagatcttctctattttttaaaaatttttttacattttgccacctctaggcagtaacaatctcatttttaatttacaatctttggttttttagtggctagagcattagtcatatatttatgggccatttttatatctgtgtactatctgtttatcttttgcacatttttaaaaacttggctatgtttttagttagttgatagaacaataattttctaactaatagttctttaaataataactaatacatagctttctatgcacctggcactcttctgggttcctgacaaacttcacagcattgactcaaagccccgagaggtggtcacagcagtccatgtttatagccaaggaaagggaggctcagagatgtcaagtaacttgtttgaggtaacacaggtcagataagaacacgccagagtctgaaggactagctaagccaaccacttcatcacgagttagttctttctgaagccttcccatatgtcccttgccatctaatccacagagaaagaaaattcccccttaaaatttccctctctgttatttatcctttgcttcatttgcaaagcctttaaaagagtattattctcatatgccaggtaagaaactgaagtccagtttccaacgagaggcaatcatagcatggaattggcccctaaccctgatatgcctggggacgtgcctggaggagtgaggagaaggatttggcatggggcaggatttacacatggggccgaggatcagggaaagtggaggctgaggcagggcccaggatggcaagagttttaaagagcaggccaggcagtctacaggactcaccctacgagcaacgtggaggggtgaaaagctgggacaaggagtcaggtgaagatcggcctagtgagaaatcatcatcaaatcagagggtgtccccacctcaccggccatttccactgaccaggcacactgaccaataaagaagcctgccctgcggggtaacaaacacacctgtgtatatgcaggtgctggcaactctatgtgtgaaagctatacatgacaaaagggtttttggtctttagtggcattttaaaataaggttcttttttagctcctaaacaccaatgtcacatgtgggtttctgggttacaaacccaccattgatttgtcacatgagcttggttaccctcgtctcaatgagcacacacaatacttctgcctcccatgagcaccgcacgtagggaagggaaaaggatcatttgcatgccatttttcttctgaggataaaagaaattaagctaacaaagtgggaaaaaatgtgagaaactgacatgctgaaactaacatgcagaaataagttttaagtcactgtttattcactttaatttttttagctttgacctcagataaccttagcatttccccaaatgtttttctgtggaactcttctccagctattctgtatgtgtctaaatgtgtgtgcgtgtgtgtgtgtgtgtatgtacataacatatatatataacatatatatatatttgttctctgatcaattaatcttaaaaagctgcacacagtacccacctctacacacacactcacattcacaaccctcacacacacatactattttgcagatacccaatgcacttctgcatattaaagactgagaactcctgcaggataagggtctttaaagtttcccaaatgtacttggccattggactttcattttctccctgtaacacatctttacaccccatggcacttgtggtctacaaacacaccatgggaaaagctggacttctttatttcataagatcagagcttgcttaaaataaagagcccagatatcctacccttttaaaaaacagatgggttctaatcaacccatgatgatgatggtttcctgcccacctgggcatctggtgcctctcctagatttcagggcgacaccaaatgttcgcatgccaaggcaagaaaccgttaggaggccaggtgtcctgcacaggctaagctgtgtggctcagcagttgaagggtgggtctggatcaatcccttgctcagtggctttcagcccaagggtccccagagactcacctaagccaactcacttgttctgtgaatggagaatgaggcactaagcctcaaaatcccctggcccctgttctctttcatccactccatgagacacctctccctgggcctaaatattttctactgcaaaaaaaaaaaaaaaaaaaaaaaaaaaaaccagattacctttaaaggcctttccagccctctgactcttctgactctgttctccttgcacctactccttcccagctatcgtcactgcaattcattatatagatatatagtcacttgatatagctctacaagtaaaactatgtttctgtctgttatagcatcaagtgaaattgagttggtgaactttcactgaatacaaagggcatacttggcctaggttaaaatgtaagttatacggtatacatgaaattcacgtgggggcagtccctggggaaggaatctccaatagaaaattcctctgccagtgttgttacaggcactggtttataattttgctccttctcacacaggcaactcaggatagttgcttaggatgaccagtaacagagatttaattacttaatgactctttatggctttcctaagcaacccttaggaggacagctagtggaagtgtatatggattcattcatttatttttaaataaaatgttcatttttggaatagttttagattgacagaaaagttgcaaagatagaacagagaccccatatagcttctactcagtttccttccatgtgaacatcttacataacaaggtatatttgtcagaactaagacattaacattggtacattactagtaactatttcaccagtttttccactaatgtcctttttctgttccagaatccattccagtatacaacatggtattaagttgtcatgcctccttcatctgtggatttattattgttttcaagaaatagacaccattctctactgcacgcagggaggtatgctgggtactacagtggatcccagctgccctgcagggagaaacacagtgtccagtggagagcaagtctgggtttgagtgtccattctgcccctcatttctgacacagtcctgggcttgtcaccccacatctatagttctcaggttcctcaactgcggtctggagataataccttctagcttgtgagagagctgaatgagacagtctacatggaaagacattttgaaggcttaaagccctgtcccatgcagctattattattattaaagttgctgtaacgattatcattaagcatatttgatacactgtttccaaagcaggacagcccagagtctgagctgtctgaccgagccgacccttccagcttcaaatgagatgtttccatagacctccacgtgccccatagagaaaggaaattttccttagtctgttcagttctacacttcctttatggctccattcatgggtcaccatatcagtgataccttctctgaccatcctacagcaaagagcctctgaggccgcgcgcggtggctcatgcccataatcccagcactttgggaggccgaggtgggcagattacttgaggtcagaagttcaagaccagcctggccaacatggggaaaccctgtctctactaaacgtacaaaaattagccaggtgtggtggcgggcacctgtaatcccagctacttgggacgctgaggtgacagaattgcttgaacccaggaggcgaaggttgtagtgagaagagattgtgccattgcactccagcctgagtgacagagtgacactccatctcaaaaaaaaaaaaaaaaaaaaaaaaagagagggagagagagagaaaagagcccctgaatccctccccacggcattctctaacttcccaccctgcttcatgcttctccatggcactgaacccatctgacacattccctattgccgtgttcctttgttcacgattggcctccctccactagtttatgagctccctgagagccccagttgtggtctgttttggtcagtgctgtaccccagtgcctagagcagccctgacatatagtgagggctcaacagatgtctgctaaatgaatgactatatgcttggttttactctgtaatctcttgcttccaccctggtaacttgaaaacaactctttacacccaaacatactgttgaattcaaatcagagcaaagctatttggtaagcaggtggctcagagccctttgggtcttctttaagaaaaaaaatagggtaatgcctttcttttaatttaattcaatgtcatgaacgtttctttgcctgcctcctctcccatgagtggctctgccaattagaaaccacagtctcttccttgtccagagcctgtctgctggcctcctcacataatcaattccaacagagtccaggctagaaaaagctggtaaaatccccacagccccacacgcagccagttcacttccttactgtattcactcagcacttgcacatcaaaggcccatggacttctcagagcaggaagaaacccaggggatccctcaggccagcctgcagctgaggacattgtggttcagacaggggagggaactggcaaatgacacacagtagttagtggcagttccaggaacagaacccaggactcccagctccataccctggccccaattcctttgtgggctggaaccatctccccatgcccgcctttcaccaaggaacacgtacgtgcttattacctggagctctaatctgattgtctgcccacccctgaccattcctgggtatttgaacttgggcactgatgggctgagatgactctccaaagcagcaatgcaccaggcagcagagttaagagccagacagaaaggaaacgggggttgcatttgttcagagccaggtactttacatgctcatctcaactaacactcacagtgccctgaaatgaaggcattataactacattttataaatgaagaaaatgaaacacagagaacttaaaaatgcagcaaattacacagtgagaaaagggcaggaccagcatcagagtcaagttcctcctggtaaggaagcccttgttctcctgcccgaccactccatcagaggcccaaaggcctagacagcactccagagcctgttgggctgggtccctaaaaacaacaaaatattcctctggggaagtaaccagaatgatcccattctagagatgaggaaactgagatctggagaggaaatacaacttgcacatggccacgtggcttgtgggtggtagatttgctcaactctgagcttcttggggatgcagactctctcctagtgcttagcccagagctgagcccccagaaggaccaatccactgttgaataaatgaataaatgacagcgtaaggtgagaagcacaacctcccgacactcccacaagccgggtgtttacaccccaattgacccacacggtggcctcaggagcaagagaccaggctgatgcaggtgagcacaagcctaaactcacactgatatccaaagctcacatcctcgtctctgagcccatcgatgtcagaggcatgggaagtgatgctggccctggtccccattcagccctcagctctccatggagcaatggttatgcaatgaagaggtttaggaagatggcggagctggtaattctttcacccaaagactgatgtttatggcatggaatgtaccttcctcccaaaggctggtgtttggggcaaattggtctattttgttgccccctttgggagcagctgattcattcacaaatactgcagtttttattattctcagtaatttttcatcctaacaactgaaactagttgttgtttatggttcacctactaagtgccaggcacaggtatctaatgagacatctgtcaccctgtaggtaagtgtgagcattcccacatcacagatcaggaagctgaggtttaggagaggcaaagcaaataggaaaggcacagggctagaaagcaggagatataaactccggtctgtgggacgccatcgctcatgctcctaccatgtggcctttgcaggtccgggacaagggggtcggagccacagccaaggacagatggaaatgggaggcagatggaaggcctgcctgacttcctgggcctcctgctggctgggcttctcatcccaggcagaacatctagcaccagggcacttctccacatgcccacatgctgtccccagactctctgatcagacaatcagggtggaacttggagctcttctgttcaaagccctcaggtgacagcacctggcacccctggttaagaaccactgctgtcaattctcagaccattttctcacaactacaccctcttctggaaggttcgaaaatgtttcttaagaaatctgttaattggtttacaaagaatatcacaactcaaaaccgctgagaccttccaattctaagattctcaaccaagcaacaataactcatccacaaatgcatgtgaaggtttgtctttgttaatggcaattattcccaaacagcgtgatgtttataaaaaggactttggagcccaaagtcctgggtttgagtcctagctcaaaccagttatttgaccacaggcaactcaactcaacctaatagttattaaaagcccactatggacccagagtcctgggctgggaagactagggacacagaagcagacaaaaaaaagtcatgatccctcttagctccgagttcctcatctgtaaaacaggaaccagcagttaccaagtgcctgctacacccccgggccttgaaagtgcatgttctcacttcaccccccccatgagcctcgggaggcaggttctcctgtgatcctgctctgcagcggaggaagcaggggctcaagggggtgaagtggcctgggtgagcctgcggcagtgtgtggcagtgtctgcactctttccatcccatcccccgcttggcagattagtccacagagtgaacaggataataagggagagtgctctgcagccgatcaggaaccgcacagatgtatgacatcatggttattaataatggaagcagcacaactaattcacaatccttccagatggaccacctgaattgtctcctaaaaacctcctgcaaacagagcatcgaattctataacggtagagctaagagggtccttagaagtctgaccttttcctcatttacaggggttggggatggacagatctagagggcagccccgccccacaaagcccaggatgcactgttgggctttagtgattgaaccaggaagataagtaggtctcagatcaaacaccagcagttaccccctccaaagggtgctggcaagaatatcagcagcgaactgcaagtatggcctcttcctggtccctagcccagctcctttctgctacagggcctttgtacctgctgttcttctatggcaaatattctttccccaaagctttgcaaggctgtcacttctttattactcagatctcaagataaatgtcagctcctcagagaactctctgggcccccacgtgtagcttctcccattcctccctggcattctccatcacacagctttgtttgagtttcttcagagtgtatatgacgacttagctttatctgatccattaatattcattatttctcttcccactggaatgcaaactccctgaaagaagggattaaacagttttcactgctgtagtccctagaatggtgcccagggcccagcaggcactcagcaaacatgttcatcaagtccccctggatgttggcctgggtcatggccatcctagcatctggcagacactcattcaataaatgctattgaccctctcctctatgccaggctctctgctagatgctgcggtccttgccctcacagtgctttgacattgattaaagcaaacagcacaggagacgccagagctgtggctgtcccatcacatgcaaccaagcaatagtcggccaatatccacaaatatggcagaaaatggaagaaactgggagacatggaggaaatgcggcgttgggttggccctgcaaagcactcccacatgctcagtactcatcttggggagctagtgccaggcaccccctcaccagctctggggacacggggacaaggggacatccccattgccacaactacctcatagctgcagcctagaacacaatgggatgaatgtgtgtgtgtgagagtgtgcgtaggagcagatgtgtgagtatgaacaagtatacaggatcgcataagtgagagtgcatgggagtgggtgtgtgtagaggagcagggttgtgtgtgcgaatgagtgaacaggatggcatgtgtgagtgagttggagtgggctgtgggtgtgtgcacgtgtaggaacaaacttgtgtgtacaagtgggtgtttgagtgtgtaagagtgcacacacgtgtgtatgtgtgcatgtgtgagagatgactgtggtaccattaccaagctcttcaccacaggctccacatgtggttgaactttacatgctaaagtcttcaaaatgaaaggcacagagttggtaactggtcatcacttaattcattcaacaataaatcatttgactctttatgttttttaaacacattctgcaaagtgtccatacaaagcagcaagactggttctagaggaaaattctcaacttctggatgtcattcagtgaggtgagagcactggatggggagtcatgttgcggtccgtgctttaccactaactactgggtgatcttgggccactgtttagctgtgtgacctcagatgagcctcttaactgttctgggcttctgcttactctccattaaaacagaccaattagaatttagctctcaaagtttggttgcaactgtacaacactacatcatctctatgggtagcccctgaagcactgtttccttggagagcaagcctactaacttgaaaagggcccgcaactagaaaaaaaatgctgggttggacaaagttaaagagtcttttattgcaggacttctcagagcctttcatttgccagtatggattgtaattggccaaaagggtaatagagagcttgcacaatttgccattcttactctaacagggaaacctttactggtggaacagctttcagaactaacaatccactgaacacactgggaaaatctgctactaggcacacaggacacttattaatgaccccttttttgcagatgatggaacagaaagggtgttctaagtcacagagcagagccatgacaactaccagcccagaaatcatccaaaccacagttactggcacgtgcacaaggctttacatctacaaaacattttttacttacgtgatctcaatctttcttaaaaacatacctctggggacactcattccatttttgataaaacatagcctgaaagagacgaacgagtctgcccagagtcactaagggatagacccataatttggctctatcagtttcccctatgtccttgatgaaacatcaatcaatacattatatttttatagataaacaactgtggccactatgcagagatccctgcaagatgccaaggctgatgctatctgcacctgttttgcagccaccaccacttctgtctgaagcccaagcaccctgctctgattaaggggggttggggagggtgctctcagaaatgcccctggagtagaagccgctctggaaacatccaggctgtgaagtgggagtagatctctcccagtcgccacaccctcctgaccatgccaggtacaacccgctaggatgtacccccagtgccagctgtcattatgccgggaggaggggctcctcggaggatccagagcaatgctagtttaactcactcccaatgagccccgaggagccccaggctggtgggctctgacagactgaaactgcatggccttgggggaagctagggctgccaaacccattcagcagctcccgccgggtgtgccgtgtcccacggtatgcgtgggtgcgaggggtgagcgccgcgccggggtgagagtctgcgctggacacaggaggctgtgcacgccaacggccgtgccaggcgcgagtgtgccagagaagtgtgtgaacgcgggaacgcttgtgtcgccctagggtggtgacagaagtagtgtctggaaaacgctggctgagagcgcgtgcatcaggccaccgcaggctgcgaagaagccggggcccctcactccaagggtcccgggagttggcaccgacgcactactgcaagcgcgcccgcgcccagccctctcccaccgacgcggctccctccggtccctctgccgcccgctcggcggtgcccggtccctgggctgccaggccgcggcgggggcgcggcgcgcggggcgctcgttgcttacctgcgggcggccgaggctccgctgctctgggctgggctgcgccgcgctggactgggctgcgctgggctgcgcgcccggcctccgcgcggctcggcagcgcccgcgcgctcggctccgcccggctcggctccgcccggcggtgccccaggcgctcgctggcggcccacgcggcgcggggtgggcgcggggcgggctggcgggcgggcgccggcggcgggcgcggctccgggccgccccgcggccgcttggaagctccttatttgggcagtgatgtcaggggaagtcgcaggggccggaccacccacttctttccattcactccccagagtttcctgtcgccgagcacggggaccccgccgccggcccggggcgcctctcccgtccgctcggcctcactgctggccaccccgggatgccttcgcggccggggtcgcagatgggcccgggcgcggctggcggctgccaggggagggtctcctcgcccggggaatccctggctgccggcggccgcggggagggtctgcgcgccggcctcctcggtgacaggccgtgtcactccgggcgccgcccctccctccgcgcccgccccggctccggcgctgtcttttcctcctgggccctctagggagggcagacagggaagcccctgtcgccgccgccggggccctgccactctgcgccacgccttggtcgcacccgggcccagcgggagtccatcgccgtccccaaagtgtgcgctccccgccttccccctgggtgccagccgggctccgggaagcccgcgcctccccaggcgggaatccgctttaatgagctctgggcggggcgggcctgccagggcctccctgggctcaggcctggggtgggggcgggggacaccccggggcttcccaatggcttgactttaccagaagctgctggatctcgggatttgggcctgagtcactctggtccttgctctggccaggatcaagcacacttgagccagttcccagccaggcctccacaggtctgcgggaaggccaggaccctgagatctctctccgtgatctgttatttcactgatgcccaccagaggttatttggcagaggtcaaccctctgccacagtggaaccagggctggccctgggtttggctgactccaggaacagcctcaggaggagacaatggagctgggggtcgggggtgtagagtggggttaagccaggactagagtgaggtaagttaagtgcctaggatgcagaatttaaccaagcactccctttcagggtcatgaaagtttgaggccccacaggggaactaagcactatgctgacccaagtttccagggggatccttggaggctccaggtttcctctggctccaaagtcatgccctcaacttctctaggcccaaagggcggattagtgaccttgggcatttgtgtgcctttatacaacagcctctgatagagctgccacccttcctccaaagccagatcagagcaaatagactcctcccagacccccagctttaatggagggaacccccaccttctaagaggcactacattcctaggggcagagaggaggaagctatggctccagggcttgcagagagtcaaggcaggtgtgattgcagctggacatgggtctgcacactcacgtacacgattgcaaacccactgaccagctgccaagctgcccagctgttctgtggatcaccaccaccccagtctctctcaacttccatcagctcccagggcccaatcccagctctaattgggtcatcctccttctgacaaagccccaaagggaaggaccacacttcctgatctggcatgcaaggccccacggaccagctgcatctcccagagctcagcccatcctgccatttgcccagccaccacccccaacacgcaccactttgcaccagtttccacttcttgaggtcttcatacaggctttccctttgaaatgtcttctccaccccctccagctgtccttcacaccctgaatccaagcctgcccttgatacaggtccttctcttgagcagggcaactggggtggggtgccccctgggacagattcctgctcctcactccactcctgccctgcccccactgtcctgcttcccgttttctgtctgaaagcaactccaggcagaggaggtgggtgccttgttataattcatatgccctgaggggtgactttctatcattcacacacacaggctcagatgacagccttgctcctgccccaagttgaatgacatcctcctcccctttgagaggtggcctggcctcaagggaccctcccaatggatttggtcaccttccatgatgccacaggcaactcaatagttcctgcctctacagacttgcccatcacctcacattgaagtcagttattgggggcctcctcttcctcagactgggagcttcagggaactttccatcttgatccctctcccctcccaggactgataagtttacaaatgtttgttaagtgaatgaatggtcctgaggggcaaatcctaagacaaactaaccagaggacgggggagaatttacccaacccagaacagtggctgatgtcctagggtccctggctgggggctgggatgaaaggcggggttctcagctagactggcttgaatgctcaggagactgggatggcttgggatttgtctcctcctttctcttgacaaactcctctgcagccatcagggagcctgggatatccccatgccaaccccccaaaacacggagtcctgagctggccctaatgaggtggaggggaaggatgaaggaaaatgcaatttgtcaagccctttcattgtaccagacacagtcagactggatgcccctgagccttccaagccatgcaggcctttccagcggtagtcattccccaggccaggagtgtcagctggggagccctcacctagctcctcccacaaccatctgtccccacttcaagactcagcccccacctcagttctggtgccaattctcactggaagccagaaggtcttcaggactccagcctcagagctcagagaaagaaggtgggggcagacagccctgcttcgaggctaccagcctgacctcgactctactctgtgagcccccacctgcagaccaggcctccaccagtctgcagaaaggcagagttgaggtgcaggacacctttcccaccatgtatctgaaaggcaggtggtaccaggtgccagttccttcctatcagccccatcccctgcaagtaactgggccaggtcttgagaaagtcccagtacttggccctgggggccttcccacattcctgcattcctcaaacatgaatcaggcaccatttctgtgttgggaacatgtaatacacaagcctgtgttcatggatggagactgacaggtaaacagatatcccattgctaaatgttacactgctgtttgacaaggttggagaggggtggagtaggggcatacaagatggaaagataagattcattctacttctggagctacaattcaagaaaactgtgatccaggtgtcccgggctagaatgctgaatgcttgtttccacggaaatgttatacacacacacacacacacacacacacacacacagtctggatctgctgtaaagccagcatcacactgtagagactttacaagctaaaagagattagagcagagggcaggtttggcatctgatctgccatctagaaagctatctctatggaattttgtttccagcttataacaacaaaattagacacaattttggaacccactgttgctcccaaggagctagggaccagcacagtgtgttgggagcacttttaaggtggggtggggctgagcaaccaggccctgtgggccttctgggttatttatgtttaggtcttacactgacttagcaaccatcccctctccatcctccatccccattgctgtgctttcctggactcagatgctttggttgttttcctgtttggggtgtgtgtgcgtgtgtgtgtgtgtgtgtgtatgtgtgtgtgtgtgcatgtgcacatgtatggtaggtgctctcttcatagacctgttgcacacatgaagcttctgtcctgggacagagactagagtttgcattttatggatatcaccttcctgaggtccagtcctccagactcagttcccatcctttctctccagcctgagaactgtgtttccagcttcctgacttaacttgatgctgtggataacagcatgggccttggagccacatagacctgggttcaggctccagccccacatttactgtgtcaccttgggcatgttacttgatgtcactgatcttgacgttctcatctccaagggctgctgggaagttttgacaagacactgcaatagaactcttcagtgtacaaaatagtaggtgctcaataaacagtagcattgattactgtcctcccatatggtgactcagaatcctcctcctctcatactgctcatcttcatggatgtgggcatcaatcttctcaagcccgaagccagaagcccttctccatgcctggtgcctcaattcaggccaccatcaccaacaagttccaacagccttctccctggcaccgtgcccagcttacccctgcaatccattctccacacaggtagaactctctaggacaccttcaagtgggtccctgttcagcgaaaccacccggtctattagggcctttaacaacagagcctcagtttaccagtccaaacctccctctctctgcactatccccatccaccctatgctcccaccatacagaatctctcactgtttctgagccttccaagcacattttgcacatgcagttccctatacttttcccctcacccatctgcttggccagctcccactcagccttccaggccagctcagaggccacttcccttgtgaaggcttccctggcccccagggagtgttggcgtttcctttgccatgagcctccagcacttgatacagactgtcctggcttgtgccccactatgagagtcatttcttcatgtgtctgctgcccccttagattctgcatctctgtgcatgaccaaatcttagctctaggaatgtcacagatattcagagcatgctgaactgttaacacacggctgctctgaccatcctgcctggtaaccagcaactacaggaggccagttggcctcaagctcatggaatagttttccccaaatgacaaaagcatcctcttttcctatacttcagactgagacctgggtctggcctaagctctgagactgcctcattctggcttttcaccagcattttgggggactcccacagggctcagcaggccccaggtggggaaggcggggccttcagttccaggaaatcagaagattagtcaagccacactcccctggcagctgtgagaacaggttttccccaagccaagggacttgcaagatcatcaataacaacaaatatttactctgcccatggctttgtgcccaccaagggaggtgcataagtacagcatcaacttccacagcttggattaagatggatgtgggtgcatgtcctggtcctgacacttactggctgcttaactcccctatacctcagttttcacagctgctaaattgggagaataacacatcccaggaaaaatttagaggaataaattagagcagataaaattaaaagagaaaatgcatttaaagtatcaataacagaagcaatatgtattagtcactcaataaagaagccccccccaagccccccaactcaagctctttgggggatactatgatgaacaagacctagtccttgccaatagctgatgaagtgagggaagggggacatgagaattaaatcagaccctataaacatgaacacaaggtaaacagcaacaggaatgacaaaaaagagttctgggagtagcagagggagagaagaattctgagatgcccttacattcttcttctctcctgagactttcatccaactgattgatataatccatgtggccagcccagggcgaagggctgggtagggcagtgggtgggcaggaaggaatcccgaggcaagacaaatgaggcctgaaggatcctgtgctcaggcagctcacagtctggttccggagaggccttgcacactacagaaaataactatgacaacagtggatgaaagcagtgaatgctgccgaagacatgggcgagagagatgaatacgggaggggtgaggcctggtgcaaaggctactttcaaaagcctgcatccacagcaaaggactgtggaagtggcctcaccccatccctgctcaggctctgctcccactgcagcccttctgacctctcaaggccagaggtgagaaccccaatccttcagccttgcaatcttcccacttgcagtcatgcccaggaagggagtggcctgggccagacagctcactagtccgtaaacataatgtgaatttggatactccacttttccccatgctgttccttctacctggcatgcccttcctcctcctatcccccatccacccttccctccagctcccctgtaaattctctttgcctatttagtgaactcgtcctataagctctccttcaaaagtcctgtttttcttattttttcctgacttccactctcagcagaattgaaagcacccttctcagtgatgttctggtaattagctttgtatataccatcaaaatatttctcacattatagtaaagtatttgtgtctggtgcccctactaggttaggagagctctggggtcaatgcttggtacctactaggtgctcaataaacagggcacctggaaggctttctcctgaggcttcccgcagctggggtggaatatggcagcctctgctactctgcctgggagtgcagaggaagcttccatgatccctcaggaactccagactcttagtccagtcagccatgtaccttccggcctgaaaacaagccctctgagagctgtcttccccaggattttctgctgatctcttgcaacttgctcctcaaacccaccctgaactctgactggattagaatcccagcaagggtcctgggcacctggctgtgtcctatttagaaagggctgagtcaggcgaacttataagcagaggcaatgtcccagagggtggcagggtggaagcgctgaggggagacctggggaggggaaggcaggcctgtgaatttggtgggtcttggtttgaaggtgaaagatcaatagcagtctgggggtgggaggagggtgtgatggttaattccatgtgccatctcgactgggccatggggtgcccagacatttggccaaacattgttccaggtatgtctgtgggggtgtttctgggtgagatgaacatttggatcagtagacttaaagcagattaccctccctaacatgggagagcttcatccaatctactgaagacctgaatagaatgaaaaggctgagtgggaggaaactcctcctgcctgactgcttgagctgggacattggtcttttcctgcctttgcaccagaatgaaacatcggctcttcttgggtctcaagcctacccacttgcagaatggaacttataccattggctttcctgggcctcaggccttcagactcagactagaaatacacatgggctctcctggatctccagcttgctgacagcagatcataggacttctcagcccccataagcacatgagctaattatttacaataagtctcttcctatgtctatatctacatttatctctatgcctatcatattgattttggttctctagagaacccttatagatgtctaaatcaggacttccctcagataccaggaggaccccatattcctttttggggtctcacatctccaacaactctgaagtaagtgagcatttccttcttcctcatagctagcagaggcctcactccctgggagggcctctttgcagatgggcagaagccgtcagtcctctgtggactcctagcactcaatatgggtcctggcacccagtaggtgcacagtgatattgactgaacgaatgcatacctcacacttatttgggtagccctttatggtttggggcataatcacacccatgtcctcatgggtgtgatcccaaggctctgtgaggggcagggcagggaccatcagccccagttaatagatgagcaaacagaggcccagagaggacctagaagcagttccagcagaaggaccctatctccagggcattggctttctctggagcagccatggcccatgtttagcaaaaacaggatgctgccctgagcccaggtgcctccatcccccctgaattcatgcactctgtaacacatgttcagccactattggctgggccctgttctagggacttagagtgcatcagtgaacaaaatgaacaaaaatctctgccccatggaacttatgttctaggggaaagagacagacagtaaacaagaaacagaataagtaagtaaactatagagcatattagcaggaggtatggactatggcaacaaggcagaacagagtaagggaaccaggaatgcaggggtgggagatgagtcacaagtttaaatagggtggttagagtcagcctcattgagaaggtggcatttgagcagcaacttgaagcaggggaagaattaagccacgcagttactaggaaaggcctttataggcaaaggggcaaccagtgcaaaggccctgcgtcgggcatattacacagggcctggcaggccaccgtgagagctgtggctttcagagagataaaagaaggcccacacagaggcctccaacagattctacccttcctggagtgtggggcctgctcaggcagataataggagagccagaggatgcctgaatggaggtgggaacggtagacaaagaagaggtgggaagaaattttccctgattatcatccctttctgcttcaaccagacacccccaagcaaaggcagctcctgcgggtgggggacaggcccctccccaccctgcctctcctaagcctccctctcaggggacttgtgaggagttaatgaagttgagcccaggaaagcaccacaggtagactgtagaacgctgggcccccagctggctatcaccatcactgcccagcctcgacagggaggcaggggcttcgcctttcctctgctacacactggcagatgcaagaagcagatccgctccgaagcctagatgaagtcgcagttagcagcctaattttagactgagcatctgctcttccgtcccagagatgcagctctgtctgggatttgctccttctggaattgccggagaaacgaatcctgctctcgggggcaggcactggtggtgtccagatcagagctgaccaataggccctgccatggggaaggcctcaggagctgtgccaccctggccatcctgtgtcctcctagctgagctcccatctcacactgacatctacagagtcctatagcttccatcttggagtcccactctgccttctcagaaagccacaggtcaaatgaggctccgcctcacgcagaacaggggacctcctggacaggagtggcttttatccatccccacacccacagctcccagcgcagaccccgaagaattcatcccaggtgagtacggcccagtcagactaagactaggagagcacaaaggaaggaccagttgtttgcaaatcttcccaggaaagcttgtcagaggagatgagttttgagttggattttgaagagtgggtaggtatttatcagtggaaaagccaggaaaagctatggaggcaggggaaacagctgaaaagaatatgaaagttggagaatggcctgaagggagggagaagaaagtggggagaccctggtggggattgggcaggggctgggtgcagttgagttgggccacaactccaggctaagcagttggggttgtatctgcaggtgggagagtctatgggggcccttagcgcatgagtgtgctctgacagatggctgtggaagacttccaggtgggaagcccatgcccctctcacctgggagagccactttccctgttgacttcctccatggtttgccaggtcctttggggccctccccacctccctggcacatgtggggcaggccccatgtgcagagtacactgtggatactcactcccctcccagacccccacctgagctctgcccacacatctcctggcatcaggcccatcacctcccacccttctgaccgctgcagccactgcttggtccttgtctgaatccccagttcccatgggcagtgttcttttgcttctccggcctcagcttctctgccctggggctgttatctcaagattcctcaagaatgactctgcagtcccacgtgcctctccctacctttctgtttgtgggcggcaagccctgttctctgagctaaggactttctacacatcaccttgctttatcccccaacaatcctggaagatgtttattatttatccctttttacaggtgaagaaaagggtttgatgagcttaatttgtgattgatcacacagccaggaagtggtagagtggaggccgtctgcctctcagtcctctcccaccaggttcccccagccttgagggcagggcttgagcagtgatgcccaggccagaggcagtcaagacatctggccagttcaggtggggagtgaggagagtgaaagaggaggaagactcagccagggaccatgcctggattcccttgagaaagaatgagttaaacacttacgtaaagagatttgcaaatagattctacaaaacaacatttggatgatttaagtgttaaggaatcagaaccatatggattaaatgtccctgacgttacgtatggttttaaaaattagaaggaaatgtaccgggaatatacacatgtataaaatatgtaaagccaggccacatttttagctttgtggacatggagttatttgaaaaatacggcacagcttctcccaggctggcggtccccctgccccctccccaggccttgtcttctcccccaccaaatggggctcagctccctccctaggggcccagcctgagaaagagacttcctggaacagccggctagctgctctaaccacaggacagttggagccaaacagctgggtcaggaacgactggggtctcccagaggccagatgggtggtctcaggtgcaaagaggcagtgagagaatgcaagtttcccaggaggacctttaagtactttatagagaagatgttgagtagctcaggagaggcagacagcattttcagttcattattgcttttgaacctcactcagtttccccagcagccacaggaggaaaaggttattacccccatttcataggaggggaggctgaggctgaggagggctggctgctcggcttagcttacaggcagtgcaccagaccacgacctggatttcctggttacacacccagagcttctcctcactgtatctcactgcttgaaacaaaccaaaaccgcgagcctgagtccaatttcttgaactctaagcattttttttctttcaagattgtgttagcttctcaagcttgaaggtttatctggcagggtatttttgaggactccctaagtatgaataaatcaagtttggttgtgagtctaaattgcacatgctgttgagctagggaagaagggataaaatgttcagtttgggaaaaaccaaaccatcagaaatttcctggccaagtcctggtggtgaagagagaggatgagaacaaaaagccagttcgttaaaagcatcacgttaggtgccaggagtgtgggacctccctgaacccccaccccagcccgtgcagaaggtggggttgtctttcttctgcagaaaaggaaacaggcacagagagctttgatgatgcacagctgcgtttctaacccctgcctctctgacaccagggcggggcatttccctaaacccagctggctggggccgacctccccagaggggcttgtcagatgaagccagaagcaggtttgtcaggagaattgaatgtcacccagacataatccccgtgtcgggaaagctggccctgagtctgtctcatgccccgccaggtctccaatgcccagtccagtgcctgatgtttgttaaatgatcattaaacaaatcaatgggtgaagaggaaggaggcatcaaggaaccactacatcctccccttctctttcttccattccccacccatgccactgttttgtggacacaagggatggccttcccacgaatgtattcattctggcgatgcttcatcctgttcagtggcattcatgcttacagcctgtccagagctctcagggtgctgactggaacctggagtatttcaaggacgtgggattctcagggcaggaaccaggggaaaaggagaaagggcagaggaatgaggacagagaaggtgagagactcccagctctggaacttcctccctgccccgtacccaggacccctccgtagagtttgcagtagatctgcccgtcgatgggtttcctataatggcctattcacaggtgtcctttgtccagggttatcccagccccacccggctgccggccaccaggatggaatcctcacgctgagatcacatccagccgcctttccacacaagcacctctgaggagtccctttgtctgcagcctttcccatggtcaattacgttgggaaaacactgcctattccacagtcaccttggagctccccagtgtacacagcaatgcacaaagccctgagaggggcgggtaaagaaaacagctcatctttagtccacacttattggaacagaacagggactccccttttcccccacacaggtcccatcctctgcaccccattttcacagccatggaattcttaaaatgctggcacaggcagcctagaaagcccctcagaggccttctgctggcttctcatttatagaaccatcctcccatgggtgtccctgtccccccacaggtaccccaaatgtccttgactccaggctttaatccgtacccctgtgtgccccatgcctgtcctgcttaaatcctctcaatggcttccttctgctattaagacaaaggccaaattcttccacatggtgtccaaggcctgcttcagtgaccccacctgcccctcctgccacatctccccctcgatccacctggggcgtagggtcttctttcggtgccccctgcctcagggcctttgtacatgctgtgtctgtgcctgggacactctgctcgtacatcccttccacatccagcggactcctcttcaacctttccatttccccttgcatgtcacctcctcagggaagccctcccctgcccccaactaaaccaggccctgtgcacattccccagcaccaggcatctcctctccagagcctctcaagtagcagcatttgtaacttttatttatgtgtgcagtcttgtcagatgagagtgacatgtatgttttgctcaccatggaatctccagaaactgtcagagtagctgtgacccacatggattgtttctcaatgctgagccctgggatcagagaactgatcaccctgtgaggttagtactgaggtgctgtctccactcagagcctgctgagccctaggaagaccaggagagtttaccactcatcgtgaattccctgcacctggcatagaatatgattcaaactcagccctcaatatgggtgtagaggaaagtgtgcaggggtggtgggtgagcccatgggaaggagaaccaggccacaggctctgctgatgattgcggctccagggtgtgtccacacggcccagctcagacacataatgttatggagctgaggtgacataggatcttggggaccggggacaggacagctggggaactgccaatggccgggcaacatctaatgccacatcaccccgcttcccctcgaccagctctgccaaccaggtgtttcttttcttttctttctttttttttttgacggagtcttgctctgtccctcaggttggagtgcagtggcaccatctcggctcactgcaacctccgcctcccaggctcaactgattctcctgccttaacctccccagtagctgggattacaggaatgtgccaccatgccccactaatttttgtatttttagtagagacggggtttcaccatggtggccaggctggtcttgaactcctgacctcgtgatccatctgccttggcctctgaaagtgctgggattacaggcgtgagccaccgtgcccggcaactaggtgtttctcagcactccctgaggcctgggtgaggctggggatggcggggacagtttcctccccatgcaggagaaggtggaagaacaggggagtcagactccagcccaatgtctcagaaattcactgtgggagcatggcagggtcacacaatgcttccgagcctcagtttccctatctgtaagatttaagggataagccaatatagaatgatttacatattttgcctcacattattactgactcagcgctttcatccatctcagggtaatgcacgaccattccttttctttctctgttcagtatcctctctcccctttcttctggcaagaattcctcaggaaactgccccccaactccactctcaattcaggcagggcttcccttcacaggaggccaccatcctggccagggcagggaggggcaacctgtttggccaaacacaatcgcgcagtgacccaggagtagtcatgtggcccaagacgggccaatcacagcacctccctaggatttttcaccctgcaacagctgggaggaaagtccacttttcattctggagtcaccagctgggatggtgaaggctagggagccagcaggggccatggcccttctccaccctgcagagtcactgtgttatgccgtgtggaggatgacgcccaaaagcagcagatgagactgagatcaacacgaaaaggagtaaagatgaaaagaatggggaaaataagagtctggtgatctgatgacattatatcagctcctggatctagccatgcctgagctccaccacctactcatccctataaaatgagacaatgagacaaaactcagtttctctcttcccaccccaactctcacttttaaacaatctctgaaaaggcaggaggaatgaaaatgagcatgcactgagagccatgcactgctctaacacgcttcacacgtataatccggtctaatcctcatgacaagcctatgtcgtaagagagaaatacaatagtgtgacagaagacaatggatgctagaaaagggtgttaaagacctgagctctaatcttagctctgccgtgcaccagcggtgtgacattgagtcagttccttaacttctctgggcttatctttgcttcactataaaatggggtagtgatgcctacctcaaaggccatcaggagaatgatgagacaaaacaaatgaaagagcctagaatgttcttggctaggagaactttaatacgtgttagttgagcctgtgaagtccagaagccctacagctagtcttgtttctaagaattagtgttggccatggggaaaagaagagaggaatgtgtgacaagctcccagctaaagtccaatatctggttaatatccagcattggcctgtaactatcaaatctccgatgacgtgaggttggctgatgcgtctgcttccccgcacatcgggcggtcaggtgagtccgcaggaacaacagttctggtgagtggtgatgggtcaccaaggaaaggggcctgttaatagtttccagatgggcctaagctgcttccagtctcccctgcacagtgttgaaaagatgggctaggactctgaacaaagctgaacttgacctggaggccccagctaatgggttattggctctattgggttggggacagggcatgcctctctgtgctgggctgtctgagaggttggcccatttgtgtcaccttctggagagcaattctaaaaaaatgctgctctgaataaatattttggttccattttgcgacgtggctgttggggagatttccatcgagtgtggtttgcaaggcgattctcctctgttgtttactctcggcgatccccacagcctgttcctggcagcatctgcatctgctgcactcctgggccgctgggacctggatgctccgctccagagagaggctgagttggccggcccctccattgggagcctgattgcgacaatgcattaggcagctggccaccagacccacagggcctccccactcctcagcttaaccttgctctccttagccagctctggctaaggctggtgctcttttagaagtcccattcccaccaacaaggaggaggctgtaattagcccagctgctctaggccaggggcttggaattcctgtgggcctagagaagcagccttgtccatttcctcttcccaggggtggcctccggctcgcgctcctctccacccacacacctcttccccagaaccacaaccacacagcagcaggcactatccagtctgagcagtaccactgtctcccacccatcccccacacatcaaagcaacttggagagaaaccccagcccccttgggcctgagcccaccacacctcttggttacagtgactgtgacgactgccctacccgcttgaggccaggtccccagggctgccaaggctcagcatgcccagccctgctcagatgatgacagctctccagccaggaggccacacctcatctcaaagaggaagcagttagaggtgggagccttaagcacactttcaagccagctcatcttagactctgctccctatcaccatggccagatgtccagggagaagaaggattcatggggtcagggtctggcaatcaagacagagaaatggcacaaagtagggagggtgctttccaggcatagagtttggtgtcccagtacaggacccatggcccagggagaaggtgctccacaagggatacatctcaaggatcctgggtgggaggactcatatcacgactgggcatttggaatgttcaagacccttgccatggaggcagaggctggcacacactgttctttctccctcccttttcttctcacctccccaaagccactcccctactctttttgacatgcgtccaattctggtggctcaagttttcatgatgcaggccttctgggaccctattttgcagatgaggaagctgaaactcccagaggccaaggtccatgcccagggtcacagagcaagcaaggcagagccttgatttgggcccatttgtcagaatccaaatccagcactcattccatggcaccatggctgcctctgaacatagaaaggacagatcctatctccccagttgggtgcgtgggactcatttgcctatacctgcaatggaagctgctagtccctccctagcctcactcagtggtccagagaccagttgcatgcatttggggaggggactggtggcagggatggaggactgctttggtatggaggggagctgaccagcctacaaggtgctgctgcccagctgtggctctgctggcaccatgtagaccagcagtgtccctccttctcccaagctctgcttggctccagactctcagctcagtgcctgaaggctcagccctgcccatcactgaattcagcctgcccagacctgggaggatgtgggaaacccagttccatctagggctagaattaattttctcaccagaagccacatgccttgtggatgctctgggcttgcctctactcgcttgccacagtcttctcctagtgcccttgggaggcagggcatctatctggaggtctgacttgagctcaatcctgctgccttaatgagaacttcaggtccactttgctaagggtctttgcaggacacctgtctggctccacagccacccactccatgactataccctgtgcctcatccttttagcaaccaagttttggatcctgccctgaaggggagatgggccaggatggttgagcctccttctaagagacactggctctcacacctcaggcacacactggtccctgggatgaccatgtgggccagacagctaaggatgtgacatagtcatttctctacaggtcacgttggcaaccaggcctgacattgggccactcctctcaggccaagcagctgagacccctgggctccatcagtactgagcatgtccaaggtatctaagaggataccttagattctggccttgtcctcaaatgccaattatcttcttcctgtccaaactcttactctggcagggagtcactcagagtgctaaaacagtgggaaggattgggggcagtaagcttcaaccagaaagatcacttacaggttcttagcctcatcacagtgtccagctaggtggggatcagcctatagttccaaggccatagtcccacttgcttctttttgaaccagctgatagctgtctcagtcccactcagggcaggaacattgtcttttatgctggtgctggaaacacaaaccacacctctgcatggaaactgccctgtgctctgctctgtgattctcatgctggcatcccaaatcttttaaagcagaatgtggagttcctaatcaaccggcatcaagtttcagtgaagccagatgaagcagctctggcgatctgccgcacaatgttgtattaatacctgtcgtctacaacaacgtattgtacacttgaaattttgttaagagggtagacctcaagtgttcttgctaaaataaaataaaacggtatatggcatataaatcaaacaggacaaccccctctccgtggaagcttttatgaaaataatcacagctaccacttactgagtacttgctatgtgccatgatctgggctgaccatttcacatttatttaagcctcacaataataatccctggagggggtattaatactattcccaatttgcagatgagaaaactgaggctcaaagtccatcctattccaaagctcttatcattccccagaagctaagaactggtgtgtgtgtgtgtgtgtgtgtgtgtgtgtgtatagacagagactgtctgctggagtgcagtggcacaatcacagctcactgaaacctcaaactccttggttcaaggggttgtcctgcttcagcctcctgagtagctgggactacaggtgtgcatcgccatgcccagctaatttttatatcttctgtagagacagcatcttgctttgttacccaggctagtcttgaactcctgagctcaagtaatcctcccgtcttagcctcacaaagtgctgggattgcatccgtgcagcaccgtgctgagcctgatctgtgtgttttatcaatgggctttggagatggttcttgagggccaggggtgactcacagttgaactaaaatgagatgtgccctctccccggcagaacatactaaagtgctcagctggtgctcacgtggctgcaggcctcctgcctgtgtgatcccagggttagtttgtgagccacagaggacaaggcacccttgcaccacattctttcacaggcacagctctcggggcacacatcctctgggccagaatggtgcagcgctggcctggcccctctctccttgcttccccagagaccatcctaatgggatgggcaagtgatccagtgggctggtggcacctgagggaggaggggctgggagggaaaccttgtgttcagctacataagttccactgccacaaccttgtgactatgtcccctcctcctgatatggactggctgccccaacttggatgttctttctgactatgtgcaaattccgattcatttacaaatctgctcccagctcccctctgggaatggtgaagccctgctcaggcacatccctccttcctctaacgctatccctgatgacatttccctggctattacataatcaagggagctcagccaggactttaattggaaaagctcttccccaagggtctccgcggatatcacttgtgccagcccaagccctcttacctctcaactcctctctgtggtctctttctctctctctctctcatacgcacacagggacacgcagctgaggccacatcttctgtgcctgtccttggccacactcagtggcttgcatgcttggtgctcactgtgaactatgctgccctgggtctttcaggcccatccccaccaggaagtcttctctgagcacctccacaggtggctcagggctggcctcctcctggcttccgtggcactctgtgcttatggcattgctgtggatgtgtctgtctccctacctaggtcgtgagctctcaagggtaggcaccaagcctgattcttccctgtgctcccagcccctgaattggcccagccccaagcaggctctgggagggttgatggaacgggtcagtgaagcagagggaggaccccgccgaataccctgtggttggtgtcttggggagctctgcattagctgccttacagactttccagaaacaccaagaaataccagctctagacaaaccaaagaaatgaatccagttttcagagtggaaactgacgcccagccggggacaggtggtgcctagggatgcaggacctcttggtggtagagaagtcttaagggggctcagtgcaaactcccttaggcctctccaccctcctgctgcctctgagacctcagtaagagcctgcggaagctcactcagggctgtgctctgggggactcatttctattccttccaatagacaccttccaggccctgggcttggcctgggacttagtcctggtgctcacggagccgtacagacatggaccaaaagagctgcaaagcggggtgaaaatctaataacagaaatgtgcacaaaagtgccaccacggaagatgggggaggtcaggggagacaccatggaaggaatgacatctaaactgggtcttaaatgagagtttacaagaggactaagtggagatgggagatgagaggaagtgggtggttcagtgaaagagaaatgtgcaaagacagagaaacatgaaacaacacagcaaaatggggatctgcccaagccaagtggtggggctgaagcccccaaaacagaagggaacctgcactttaaggctgaagcagtgggcaaggccacatcaagaaggacttgaaagctacactaagccaactggaccccagctggtaggaaaagagccttatatttgcagtccgtgtgcctcatgcagagctcccttccaccaaccccaaagtgggaaaaggcactggcatatgacataatcctattctatcccttacccaggcaaccccctaggccctgtaacaaacacttcaccactgatgggaactcctcttagccacagacatccttgcatctcagagctggagctgtgaagtgctaacaattaatcattgcagagatgagttcacggtgacttcagaatatggagtccttagggataagttttataaacaggtttggaacttcagcaaaaacagcttctcttgagtctgagtaaaggaaagggttattgcctggctcagggctggtatggccatggctggaggctgggaggaagcccacaatggctgtgtgttttcccgtgagattttacctacactgaaaatcctggagcatcttcttggactctcactagggcccaggactcagtaaaaattcaagagcatgagtcaaagcagcctggcagaggatagagctaagttagaagaggctcaggacctggaggcagccctctgtggtgctgcccctcactgccatctctataccagcacttcgaggttcttcccatcaccaccctcctggtcctatcactgctggtgaccctcataacccatggaggaactcagcaagttgtgtggggtgcagggtgttgctacagagctcagatgactatcagttcctaattggttagcagctgtgtggtcctttgtcctgtcttccaaaagcactgcctttaaaaaagacctttgcctgaccttgagatcaagtctgctcttttgacaaatgtggaaactgagccccagcaaggggaagtggttaacccagggtcatgaggggaggtggggacaggggtgcgggaggacccaggtctcctcactgtctgcctcaccactctgacttcctggaggtgactcagcgagacaagcagcagaggaaggaagtgggaaagggaagcccagcctgctggattccaggtcaccactttgttagtccaaagccaccaaccaccttggccatgcagctctgcctggtgccagtgaccttccagcccttccttcccaaggctgcagctgctgaccatttcctccaaggccaagctcacatggcctctccagggtctccagcgactccctgctgtacagtcccatggtgctgccctcctgctggggtcaggagtcacctccatagacctggcatctggctgaacctgtgcaggccgaaggttcatcagtgagatgagaggaggtgtaattactgcctcatgtttaatagctgggctctggggcctgttttcagttttcatcacttgctggccatgggtgctttgatcaacctccctgaactcagtttctttaatctgtaaaatgagattacatgcaacagtatctactttgtaggttgcttgcaggattagatgagataatggccagccgcagaccatgaacttaagacacattggctcttgacatcattgactatgctaggtgtgtttacatgcatcctctcatttaatcttcacaacaacctgccaggtggataccattattctctttcactggtgaggtgagggcacacagctcatggccagacgtgaacctggttctgtctgattccagagcctaaatattctcctaccagctacagaaccttctcttactgttatatggtcaagtgcctgtttttgccctatcaccacgtgcttgtgtggacagggcctcttctccttctccctggattccagtcctggctctgacacttctcaggaatgagacttgtctctgagcccccactgtcccatccatacactgaaaaattggcactcccccagccttcttcttggaggaacacacaagaggacggatgtgatggtgttttgcaaactgtaccttgctgtttgaatgcaaggtgctactcccccaaacagaaatgcttttgggactgttgcgagtgcagcctgagggcagagatccaggaggaccagggcctgtaggagtacctgccttggccaccacaggaattgctgcaggtcccttcagtttgtggctttctatatgttgagagcaggtccttgagagcaaggcggggaggctgcagatacagtacaagtctttgtttccttgcctgtttcctccactgcactgtaagttcctcaagggaactggactggctcacagcacatcccttggatggatggcattcacccccctctccagccacatgggctcctgggagctcaccaagtgggccatgctgctttgcccccatgcccagctcaactccccacgggaagagatcatctttctctcatgaacccaggtccccacctcaactgtagcacttactatatcacaaacccgatttctaccttgaatcctttttggaacagagtcagggtttgaataaataaatatacttgaacttatttgttttctgtctgtttcttttgctggattgtaagttccctaaggcaccttctgtgtgatactcatctttgtaactctcaataaccagcaccaggaacctttggggtatgtgtagcatggttctctctccaacccgcctctctgtcttgcaaactccccctctctcaggggctggtgtgtgttggaactgtgtgtaacagtggaaacaacaggcaccagtggatctgaccagcaaatggactggcttatcatttgggggttgcctcatgtcttgatgaattctgggtttacttttgggttctagactgtggtttttttgtttgtttgtttgtttgttttgttttgttttgttttgttttttttgagatggagtctcactctgtcacccaggctggagtgcagtggtgcaatctcagcccactacaacctctacctcctgggttcaggagattctcatgcctcagtctcccgagtagctgggactacaggcacacaccaccacgccaggctaattcttttgtatttttagtagagatggggtttcaccatgttggccaggctggtctcgaattcctgggctcaagtgatcctcccaccttggcctcccaaagtgctgggattacaggcatgagccaccacacccggccatagactgtattttcaaagtcaccacttaagtaatctcctccagaacaatgggcccatcgatgttcaagatacacaatggggagaaagcaaggagtaggaatccatcaaaagccccgtacagttgtcttcttttctccttgactttgccgttgatgagtttacatgcctgaccacttccaggacatatcaagcctggacatagctggattgtgagagtgtgctgtgtacttctaagtactgactggaaccatgcaaaagcccagcctcttttatgggtcaaggagtcctggtgaagacagtatcaagccttctgggggtggggatggagtataaacagacagcagttctgagaccccagaacccaggaagcagttctagctgctatgagtccctggttctcatctgtgaaaagggagaataataaaatccaccctgcagagttatcagaggagcagcatgagattacaatatataaacacaggagcatggtaagaatggattcattcactccacaaataatcatttagcatctactatggaccaggccctggtccaggcactgggcacaatatacagccagtggcatgtgggctggtcctgagtgctatcaagaaaggtgaagcagaaaaagggaacacggaatgggggtggtggcagtaggaggtgctgccatgttaagtaggggaccagagaaggcttcactgagaaagggacatttaagtaaagacccaaaggaagtgagggatgggccatgtgcatatgcttcctaacagaggaaacagtaagtgcaaaggccctgaggccagagtttgtagaacagtacacagtccagaggatatgggggcaagaaaatcactggggctgtgaaggcatttatgcaacttctgaatttcactcagagacaggaagctatggggggttttccagccaagatgacataacctgacttttagagctaatcactaaactttagctgccccttctcttcaaagcctcatttaatatccagacctctgcaactccagcctatgtgcctctcctttctcagatttcttccagctttccacatctctccaaaccaagagggcttcatcatgctctgccacatgcaggctggagagggacctcgcagagaggctgtagttgggaagggagagaaacagagcagtcttaggtaatggatcttgctctcctctctctgtgctctgaaggcctctgggcctggcccagctgcagcaaacgcacacacttaggtgcacggcgatgctgggagcaatgacagagtccccggtgccccttcatcatctgagaaagctcagtgcagaactgggaatttcactccatgctccctcaccctgcttatctaccaaaaggtgaaatcatttgttttaaaataaaacaattcccatatctgtcagtggtttttaaccttttttgggtcactggctcctttgagaatctgctgaaagctatgagctatcagaaaatgaacatgagatatgtactcattttcttatcattttaggggtttcacagatccttgaaaattcagtgaagaaaccattatctaagccaacaatttcccagccacagctccagatgaatgaatgaatgaatgaacaaataaataaagaggctgagtgcagatggaggaacgatgggggatgaacagagcagaaagatgcatgtgcctgtgggcaccacggttcttgttgatagttcctgacaccttcaaagaagccaactgggaagtgatatggggtcagggtgtgcttgacaggtgacctccagatagccaagccgatcttcttcagttcctctcgtctgaccccttctgttgttctcctctgaccccttctgttgctctcctctggcccctctgggtgactatcgtcctaaaaggtatcaaagcacacttccctgtctttctcagggtgtcctgaacaaaacaggactcttttcctggatggctatggggcaagagaatgaacgtaaattcagatgtataaaatgtaagcaatcactttttctggtcatatggctgacctggctgaggcccagagcccccacatcggtccctccccagccctctttctgggatccaggtttctggcctcccagttcattttaatttttgatacatctccagggaaggtggaatgaacacttaactcattcttaaagtcacaactcccactgtgaaacttttaacacaatctcatttttttctaatcattgttctacactgtaacatagggagaccttaggtggactagggtgggtaggaatccgtccaaacacacaatggtcccagggaactcttctgacagagaagcacctccaaggccccggtgatgtggctccgccacctctcctctgatcattctgcctcctcctcggcaccatgctccagacatcctgagctgggagttccccaaacggatctgttttttttttttgcctctgttgcttcatgtgtgctgtgctggccacctggaacacaggccaccacctgcttgtctcacaagaaagctcttacctctctgctcaagctcacctcccagcctcctcagagagcccatttccttcccctgggaatcccgcgtcctcaccttaacctcagcacttaggacactgtatttccaacttctaaaaaaaatctttttgggagaataaagttacagtttagagaaagacacttacaagtgtttacttaccgattcatttcatgaactgagtcttatttatctttgtttccccagcaaacagcacaaggtacgtattgatgtttccgtaggtatttgcaaataaatgttttcctggtagagtggttctctctctacccttccagctagattgtctgttgtgacctcaaccccctgctggtagggtcccacctttcactggcctccctcggcctccacagggcacctgttagaactgtgtgcaaaccacgagggaataggcgctgaggggctctctcgggagtgaactcgccaacttagtgtttggaggttgtgcctcaagttacggctgccctggtgagtctgtgctttctgggatccgggtgggtagggtcactggtggggaaacctcctccagcaagttgtcatagtaaccaggactttccatttcacgggagagagtccctgggaggaaaaacacaccaagggcttgggaggagtggtaggaagccatgaaaagccttctgacactgtcctcctgtaccctttgctttgcttcctactggtttacatgctcaaggtagaggccattatgtgtgggcatctgagtagaagctgctgaaaatagccgcccgactatttcagggagcagctgaatatgcatgaagctattttagaaaagatgtccctggcccagctaatccaaaccccatcctttcccttagaagtgccaagacaagttgaatgggacctttcttagtctttcccactagggtgggggtgcttcagaagccacagaaacaacaccctggctaatgttggccttgcagcctgtcggctccgcctcccagtcccgtggtcacagaggcttctagccagacagctcagccttccacggtcctccggggccttggcagccttcaacaactactttgccacaatcccgtgtgcctaggtccttgggagtctcagatcttagatatttccacatttgttcatttattcattcaatacacttgtattgctggataacatgtgtgaggattgttttgggtgctgggaaaaaatggtttctgacaccagcttatggcaggggagtgtggacaggtgagtagaaagacaataaccataaagttccaaaacagagaggaatcaggtgttgggaggttggggaaggagcccatgcttcttcctgatggctggagaaagaagatggcatttgagctgagccttgtctgagaaacatggctggctcaaggggcaggggatggctgggtgtggcaggggcaccctggtggaagggtgtgcctgacaggaagtgagaaagaagggcaggagattgtggggacactgaatgctgggctagcaatgccttctctgagtcctcaggctgggatggggagcaccccgcttccacgagcctgaagtgcctggtgcacccttgccactgccttcaacctagaccggaagtgccttgggccaggagcctggtcagatcctcctgagcatctccagagccctgtgccaggcttgggactgagtacacttacatattgttggctgaaagcatggattctggcccggcacggtggcttacacctgtaatcccagcactttgggaggccgaggcagatggatcacctgaggtcgggagttcgagaccagcctggccaacatggtgaaacgctgtctctactaaaaatacaaaaattagccaggcatggtggtgggcacctgtaatcccagctactcgggaggctgaggcaggagaatcgcttgaacccaggaggaggaggttgcaatgagccgagatcgctccattgcactccagcctgggtgacaagagtgaaactccatctcaaaaacaaaaacaaacaaaaaaaagaaagcatggattttggagccagacttcctgggttcaaatctgggctctgccccttactcactgtgaccttgggcaagttatctgacctctctttgcctcggctataaaatggggataatactagagtctatctcatggagcttcttggtgaaaagactccattacatgaattaatatatgtcaagggcttagaagtctgtgtggcacatagcaagcaatacataaaagtgttaactatattattctaaagaatatggatttttatcttgaaatggagtgccatcaataacaagttttccttctaaattgaaaatagctttattgctttgactgatcatatcatatgtacctactgtaaaaagttaaagcattatcagtataaagaagaagagaaaaaaatcctccccttaaatcctgactcagataactactgacatgaccatctgctatggcctgaatgtatgtatccctccaaaattcatatgttgaaatcctgaccatcaaggtgatagtattaggaggtggggcctttgggaggtgattaggttctggggacagaatcttcatgaacgggattagtgcccttataaaagaggccaaagaaagacttctcatcctctctaccatttgagaacacagcaaaaaggtaacacctatgaatcagacagtagagcctcatcagatcacgaatctgccttgatcttgaatttcccagccttgagaactgtaagaaatagatttctgtttttctaagccactcagtttatggtattttgttatagcagcctgaatgaatgaagacactatctttttagatacagttgatcctctttattcatagattctgtatttgcaaatttatgtacttgatcaaatttatttgtaacctccaaatcaatacttacattcatagtcacttgtgggtgtgcagagtggtgaattttttttttttttttgagatggagtctcattgtatctgtaacctccgcctcccgggttcaagtgattctcctgcctcagcctttcgagtagctgggattacaggcctgcgccaccatgcccagataatttttgtattttagtagagacacggtttcaccatgttggccaggctggtcttgaactcctgacctcaagtgatccacctgtctcagcctcccaaagtgctgggattacaggcgcgagccactgcgcccagtgtggtgaaaattttgagttgcctaatgtgcgtgttcccagatgaggctgaatgaggcgaccttctgccttctagtttcagatcccatatggtaaacaagtgtccacgaaaaggacactatggacagttttcgcagttttgcactttttgtttggtgattttactttttcaaatggcctccaagtacagtgctgaagtgctttctggtgttcccaagcacaggggagctactgtgtgccttacagaggaaatgccatgttaggtaagctttgttcagagaggagttatagcgccactggccctgagttcaatattaatgaatcaacaatctatgttaaataaggtatcttaaaacagaaatacacataacacaaggttatacactgatcagctgagaaaaacattgtaaccagaggctcacaggaatcttatgctgtagttctcctaggagcaacagttcagtatttgctaattctgtgtttgtgaggactttatagaacataactactatgaataacaagaatcagtgacatctttctatatatatggatgtacgcttctgtgcaatttggaatggacgttccatacccttttgatactttaaaaaatcatgttaatatgtcaaaggcatctttccattttcataaatacaggtcctcagatggctgcatcactgtgcacgtctctgtaatgaataaccagtagctccctattgatggacaatttggttgcttcccattatttgctattacaaacaatactatgatgaacatccttattggtaataataaaagagctagcatttattcagcacttagtaggggcccaaccctctgctaagagttttataagtgttatctcatttaagctttgccacaagcctatgaaagtggtattattatgcccactttgcagatgaggactttgatgcttagagatgttaaggaacttttccagggccaggtggcttgaaacaaggtctctctgatctcagactccacactcttaactaatgctctgctgctttcctacacacataaaccttgggcactttaggatacttgtttagaagtgaactactgagttgaaaggtggggacatttgaaagtatcaatatataatctcccctccagaaaatgtgtatcaattcgtgacccactaaacagtgctccagtgttcctgtttctcattctgcatttccccaagtattttcattctttgaaatggcccccaaaggacactttgattgtttaatgtgtctcctttgcccctgggtgatgactcttcacatgctttgtatcctctgtattttgtcatttatgaattgcttgttcatagcctctgcccatttttccgctggcaatttgtctttatctaatacttcacttacaagagctctttgggtattagtgctgctaaccttttacccatcatgcctatgttgaaatacttttcttagtttgttatcatcctttaacctgattgttgtggggtggggtgtttgcccatagggtttttaattgttttccttcacagtttctggatttgatattacacgtaaggaggcattcgtcattccggtatgacacaaatattccctcgttgtctttcttttagtatcattatggtttcatgttttttaatctccttggaatttattttggtgtaggaactgaggtagggagccagttgtattccctctcctccatacaaatagctcgttggttgtctttagaacacatcaggaatcacctgcattttcatctctaattatcaatgccatgcattcacataccaatcctcacgtacactgatatctacttctgggctctctgttccttgagccacaggtctatttctgtaccaacactgattttttttctaggccattcatccatgtttatttttccagatgtactttgtaaacattttatgaaaaattttttttgggatttcgagattcaattttatttatagaacaatttataataccttcttcagttgactcttcataattttatgcttttatttctttggagaatgaagtctttttccctctatgctttctaactgccttattttggtaccaccttcttgatgaaagcttttctactcagccctgcaagagtcttttctaatctctccccactcagcactcggccttttgcatgccccacccgacctttttacccaaaattataattactgcttagacagtgagctccttgaaggcaggttccttgcatggcctatttatacatttcctaccacacctggcaggttgtcggggctctggagatatttgccgggtgaatgaatgaatgaacaagtgaatgaaagacatcctcctggaaagctaattgtgaaatgaaacaaatcgattacaaaaaccctctttcataggctttcattagaaaacaaaatatttgtccttggctaaatctccaagaacgtgtcagaatgagagaagtggctcactactagactgcgtgtcatgtgcaacatgccccaacacctgtcctcagagactgccatcctcaccaagcaacagggcacttctcaggcaggctctcaggccctaaaaggcctccaggagaaggaacacaattattcaccatgtgcctgtcgctgagctagacttttaccaataagatacaacaccctgaaagttgggatcactagtctcattttgcaaatgaggaaactgagtctcagagagatgtaaccctacctagtaagtggtagggcctgctgaagtcagggctgtgggactctaaaaacctcgcctctcctataataacctccagaccaccagagtctgggaggttgaggggctgtggcccagaggggaatgctatacagagtcaaagagcaagggtcctgctgtcactaaaccaagacagtccctagaaaacttgtttcccccaaagctgtatgatgccgcttctataaatcattcctaaagagcttgggtcaaagagctactgtcaggcagggggcacatcacacaggcattattgttgctatgggactggggagtggaggtatgggggaggtggtggactcgccatggaggcggggtgttggtctccagtacctatctggagatggccctccagagtcctcctccttgcttgcccagggggttgtggcttttagacagccctgcagttccatcctgggagtgctgccaagcagccacttccttatcaggctggcagtagctgggcaggcctcagcttatttctaagtctggattagagctcaggtttctcatggaggaccatgggttgggggccaatacatttactggacttgactttgtgcctggcccagtgtaggccccagggacatggggatgagcagcctacaagcctcctgcttcatgcagctccattccaatcaggaggtgaatcacaaggaaaacccccaaccctgcccaagagccacagtagagatctctaatgctgagggtgcccagatttggggggtcagccggctgcagactgtggaggttggatgtcaggtgagggcatatgggcttcatcctgtgggcagagagaaatgccctacattctgaagcaagagcctgccatggttagatttgtgctttagaaacagaccaactaggtatattcgttttcaataaacgtgaattctttctcaggtgaaaattaaagtgtttccattttggacaaataatcccaacgtaaggaatcacagcagatggctatgggcctggatgagccacttacctatggggctgatgaatgggaagagccctgggcttggagtgagagacccacatccacggtcaagtccctgccaccatcttgctgtgtgacctccagcaaatgacttccccatctcaacctcggtttcctcatctatcagacaggaatactgccacctaatacacagggccgtcttcaggacaaaatggggtatcaaatggcactgtatatttgtacctacttgacaaatgtgaggcatgagggtgagactcctgaagaccagtccacacccctgagggcatttcagatgccccacagcctgcaatgtcttgggaagtctctctcagctgttccagctccagtcaaagactatcctgtcaaaacatgaccccatccagagaagcaatctcccgtgtgtttggtgggccacctgcccacggggcgcagcctgctgggccacgaacatcaacagcagccccttcctggtgggagaaggaacagggagctggcttgttctctaagagcacagtgctggcgggtgacgaggcacattttaaggtgggatgcttcttcctgcaccgttggcagctgtctacataaggtgcccattatgtgcaggccccaaggccagcgggcctgagaggccaagctaaaattactgtcagatgtgcacccgccagacacactgaacatctgaaggtcagatgcctccaagcagccacccgggcaggagcgtggcagatgggcaccaaacagctgtggcagctgctgcctcttgttcctcccaagcacagagacagacggccctgtgcagcagcctggttcaatagcccagcttgagttaaaaaatagaatgtagagtataatcctaatttaaaaaaaaaaatctgcgtaactgcatagaaaaaaaggtggaagaggaattcactaaatagcccagtcacggatgtggaatagtaggtgaattttttttcctctactttccaaaattttctcaatacatatgtattacttttgtaatcagaagaatacacaataagatgctatgttatatattcctatgaaatatataaaatgattaaatggcatatgctttgacatgtggtatatttgtgtgtgtgaatacatttatacggctggctggtattaaagatcaacattctccaaccccgcgttgcacagaagagacggaggccccaggaacaaagcaggaagcagagaggcagattttcactgaggctgctgttgcactggagtttccccaagccttgccccacttaattctgtagctggttttattcccacttgatggagatggaaaccgaggtacagagaagtgaactgattcactcaaagatgaccagctcggaagccatagagccaaatcccaaccctagctttccacccacagcgcactgagcttcaagaaaggaaaggcctttgaaaaaagaacagaacaaaacaacaacaaaaacaccctgctccttgaagtctcaaacattcagaaagcaactccttaagggagtgagttttgaattatttcctgagcccctccacgtgcacgcctttcttagctctgcggggctcatggtcatcttcccagagctacccatgggaacctttgagaggatgggtaacaaatcatgatgtgggggcacaaaaggcacagcaaatcccaaggtgggactggctggcaggtgtcaggcctttgggacagggtgagggagagcgagttggctggagaggctgctgtctaaactctcagtcttccagtgctttgggaggggcagcacccctctgcaacgccagatgccctgatctgaggcctttgctccagctcttccctctgcatgagtgccatctctatccccacatgctgccctcagtcttccagggcccagttcatccaggcatttgtgcattcttattggtgaacacattttaattgagggcctgctaggtgctagagcaaaagacatagtatcaaccctgtaggtgcctctagtgctcagagaaaggctacccagggtcattcaagcatagactctggggccagactgtctaggctcaccctggctaagccacttcacagccctgtgtgtttgggccagtcacagtctctctgtgcgtcagttgtcatctgtaaaagaggatgaaaagagcacctgcctcacagactagtgcaggtggagtgtacatctgtgtaaagctcttagagaacagtgcctggcatgtagtaagtgctcaataaacctcagttgctataaacattctcatcattaccctctggtgcagattccctccttatgatgcccaccctacttttgtcctctggctggtacctcctctatggtcccatagcactttgaacacccctccatgagagcactgatgggcatgcagtacaggtgtctgaggacctgttccctccttgtctctacctgggtagagactaagtttattcatctccatcccagcacccagcacagatgttataacatcaccaggtttatgtcagcatttgcaggtaatgtgtgccttcaattccagtcgagaaaagtcttagaggcattagaggttgtctatctggccttatcatgtagctcatccatgttgcccttgaactgtggggtctgaccctgggtgtgatctttccgatgagaaccaagttgatgagggagctgtgtgctaagcttccatgaatgcttctctgtgacagggagttctgctgggcaggacatcgaaaacaccaactactgacaccccaacacatcctggtgtttcccgtgccatgcctttctccactggggccccatgaccccactgctgatctaagaactcccatggatccttcgggtgccagtgctcctggccccaccccccacaatgcttctgctagccacagcccccactgaatgtagctccctctctcctggtcttctcttgtttctgccctgggcctgtggggctgctcctgctctcagtgtgtggctgttcctttgtctatgtgtcccttctggagaaggggcaaacttgctcttgtttgggcccccagtgtccaccaatgccaggatcagaggggtgtcaggaaagctctgctgagctcatttttcagaggaaagtcaagcccgctggcctgacctcccattaaggcacgcacgctgactgatcacaccaccttctgaacccaaaactcacaggtggctctaggccagccctgcccatcagttgccactcactccatcgcagggctgagtcagcagggaagccccgaaagtaagtgctgagcacgtggtgcataccgtgctggcctctcgcttgagctcttgcgtttgactctggcaccgctgcaggaggtgggtgttctatacagagaggccttcctgaggctctgatggttccaccgctcctcaaaggaggggcagggcagggttggagcaaggctctctttggccccagaacctactcattctacactcctgtgagacgacaggtgtgtgaaagtgttctgagttctaccaacggaggaaactgtaaaaccatagaattgccagctattacccaccacacagaaatcactctagtacaaccttgctatcaagaagaaggcttcaggggccttgggaacagcattgaatccttacagaattgctgcccaggagggggtggcctattgtccttcaggggtaggaaaggaggagagtgagtgggaactggaagagcagaagagaagcagtcctgtggctggagtggcagcccaacgcaggatggggccccggggacctgaaaggatgcagagggatgctggagtctgtgagagccgaggccacagacacttcagcacggggtgtcctgccctgggcccctattgaggttctgtagattctgacatgtgcacctcctctcatctcggcctccccaccactttcctccccaccctcccacaccccggtaggggcctctctcagaaccacagggctgactgtctcccttccctgcttgtgtaggacccagcctgagctcctgggtgaccagagtcctgccgctctcttggcctcactcccatactcctcctcttgggccctgcatcccagcgactccactgctccacttgctgtcccttgggctcagaatgctcttcttccatttttcacccggtgaacttctattcatccttcaaagcccagttcaagcgtcaactttaaattgtcttccttgaactacccccacaaccaaaccccgacagaatagagccctcctgccttcacaggttttgctgttctgtggctatttgcacatcgatctcctccactggagcagaagcttcttgaggataatgccatgatttgttcatctctgtgcctcagtgcccagcacagaggatagagcacaacaggcaataaatgatgtcctgatgacgaggtcatgagagggcaggcatggggctggtgattgcatctgagtttgacttccagcagcatttactaggagaaatacaggccccctccccaaaatgcacacgtacacatataaggtgaacacacagctcagtccaggatctctgtggctgtaaagtccatggagcaatcaaacaggagactgagttctaaggatgtggtacacagctgcagtgtcagccccactgtcctccccagagcccagggccttggcttgagccctgctgggttcaccgagtcccactccctcactttgcagacaaggaaacagagacccagaaaggagatgcttgcttaagattttcctgagcaataaaggcaggcctggggtcagaagcatttcccttggctcctggcccaggactctcccatcaccatatgctgccatttgcagaaatgccagctgcaggactcgtgacatttgggtggctttttcctaaagtgtcggtagcgtgtggggctccattctcctgcccgaggctaaggtcattcctgtctacctcctggcctcaaaacacagcctaatggcctttgggctgtgctgaaactgccctgtgtcctgtgggggatggggagggctcacctgccaaaaaccagccgtggtctcatggtcaagatgtgtcagagatttctagagcttggagaactgtgttggagggaggcctgtgggaagtagagaaagtgagaatattatgccaccgccatctgtcaactttcatctgagtttgaaaaaggcacccaaaaatggtgagcacagccttgctgaaagcaaagccccggccactaccccttctctaacatggttatgacgaggtcaagatcaggtccctgcggatgaaaccacagcctcaaaaccccagtacagagctgcaagtcacaagttgtctgccctgaggaaccccacaggtatgctggtcctgtactcaggcctaaggctggaggaactcccacttccaaacactcctcggggaaaacaccctttgtgggttccctaagcactgctcattgtaattcactcattcttgctttcattattcattcattcatgcaagcattcaacagccatttgggaaattgttaggtgttggtatcaggtcctcatagagatgaagtctctgagtgtgacagcctagatccagtaagaaaggcgtgtgtagacccaggacaaatgccacaggctggtgggttgcctcccttctccaagtgacctctgtgccaggtgctgggcaaagcactttggttaagctgtgcaggatggcagaatgtttctaccattttcggtacaaggacctctctttgtatgaaattatttctccaaactcctgatggtaactgtatacctattatcttctcattgagaaaataaacaatacaaaagttacaatgaactaatgctttacaattaacttgtattttagtaattatagcaccactacatatatttaaattaaggttggacacatactcatttgagacatattatttatgtcttctaggcttaaggctttgagcccttggggatccattcattcaatattcattcattcaacagacatttatggagcatctctgagatgcccagccctctggctcaaagattagggatcctggttcaagaaggagctccagctctgcagtgaggtacacttaagcttaagcccaggtaacactggatgtgtgcccttagggaggccatctggtcttcttccagctctgagtcctcaagagtaagatggagatgtaatcctgacattggaaagttgttacgaggagtaaatgagatagtagaaagcatccaggtaagggcctggcaccaagcagaagctcaacaaatgggcacccgaggattatcatcatcaccatcatccccaccaacatcaacatcattactatcaacaacagcagcagcagcagcaccaccaccatcttgcttcccttctcttactgaaccttgagaagcctttccttgtccctctactagggtatacagtagtttctaccttataatagagttatttgtatccacacttaaaataccttataatagagttatttgtatccacattttctttctttggttcatgcccagctctgtaatttcagagttgcgtgaacttaggtaagttatttaacctctctgaatttgtttccctgtatgtaaaatgggaactgtatttttagtaattcattgaattgtaatgactaaatgaactgatgtacataaaacctcaacacaatatctgtcatgtggtaaatgctcagatattgcaggtcattattattcatgttattgttattattattaacattagtattaatacaatttctcctcctggcctgtgagcccctaggggcatagtccattgaaaattcatttctgtctccccacagagtctagcacaaggccggtctcccagcagatattaataaatgattgctaaaacagtcttggaggttcacacaaatcaagtgcaaaataactcaaagggcatggtcaagggtaaagagccttgtcaggaccctgaaaaaccccaacagatgtcctgaagggagttttttgtcacccatggagccaggctgcaggactgctaggaccattcattcattcattcgtttattcatcacactgacacccaattttcactttggttgactaacaaacccttgcccggtgctttttcctattgtgaaatctcgtttccatctgctacctcatttagtctccacgaaaattttgagaagaagatagaataggtacattactgacaatccattctgtaaatagatgaaggcccagagaggtgacaaggcttgacaaaggacatacagctgtcaaggccacagtgggaaacggaccaaggctctgctcatgatcttgactccttcctgctggcactttccaaatccaggatcattcattcttgattctcattgtccagtttgcttctcagcaaataaaactgaattaaattatttttggtgttattttaacatgactgttggaaaagaaagactctaaattccataagggcagagactatgagagccctaacagtgtgggggcaggtaaatgtatgaactctgatcccagactgcatgcgtccgaatcctgattctgatacttaatagctgtgggaccttgggcaaattacttaacctctctgtgcttcaatttcttcctctataaaaaaaggataataatagctatctatagggttgttgtgaggattaagtgatccaatccgtgtacaatccctagaacagtacctggtgcatagtaagggttagttgtaattattatttgtattattatttgtgacgtatctcctgcacctagcataagacccaacacataaaaaatccctaataaatatttattggattgttgaatggataaaatactttctgtaaagaagtaagtatctatgctttaagtattattaaatatctatgcttaagtattattgagcaaggcaaaagaatagctgaagctctggccccaaagaagctggagtcccccagttccttgctcacagatctaggcgggaggagattcgtgattccaggattcaaaggcctgtccaccaactggcagtaaatgtgactcatggttaggaacacaggttttagagtcagacacttaaattcaagtcctcactcttgttctgtcactcactagttgtatacttacctcctgtacttgcctcagtaccctcatctgtaaaatgggaatactcacacctaccttgaagggatgttgggtggattaaatgtcatatgcaggaggtgaagcttcctgcacctgggcccagtccacagccacagtaacaatgagcttacaggatcaacagcagctcatcctatgggccaacttgttctgtgctaagcatcgcttccaccgctttctccctcacatgggatttgggggccttcaccagggatggactcatttgcatagcccaggctccaccttctaggccaaaaggctgctatgaaaaggcacattctctatttggcttcagcatgaactgggctctgtggaggcgagacagctgcttaggaaatgggctcctgggaaaggtggtctccagagaatcagcttagagaattccttgcaagcgccagtgccagcaactagcagcctgtatgcagctgcctctgagtcagtcccagtccctgtggtggctacagacccttcctttactctgtttctcccactaagaccccaaggctggcagcctgtcctgcttatgggaaggagctaacatccattgagccagaagctttaattctttgcctcgtttagacttcacaatgagtctgcagtgggcacttgaatcttgccacataccagccatgagaccctgggcaaaccattcagctgcccatgtctgtttccttaactatgagcacatgtcaatatccttgtacactagacccattttgcagaaaaggaagctgaaccatagagagggaaaggcattgtcaagatcatagaactaataaatgacaaagctggagctgtttgacttcaaagttccatgcattcattcatccatcaattattattttagagcctaccttatggtgggcactggctccatagactgtttttaaaaatatctgtattatcaatttcccactgctcctaagataccagtatgcaaggcaattcaatttaacaaagacatcaagtccttctatgtgcccaggcactgtgcgaggttctggtataaaggatcacattgaaccctcatgacaatcctgtgcagttgacctttttatgccctttacagaggacaaaatgggtaattcaaagaggcaagagaacgtgtccaggctcactcacggagcctggatggacgcctatgcccatgtgatgccaaaactcacttctttcccttcccaccatgtttctttctctacgctctcatctccccaccctggcctggcctgcaatgatgcagcctctggaagttccatcagtatccctggcagagggtgttctccatccagcagagaaggacagctgtcagccctaccagcctgtgccatccacactggatcttcaggactctgcttctccctggctccttccactccctgaacttgaccccaggatgacagacctataaaacccagaaacatgtttgcttgtatcttgcctacttccaaaaaggatgtgaggaaggttaaggaacaaaagtgcagaccgaggctcaaaacactggacaaaagcaaaatccagatgtaaaagagcagggggtgctggaagcaaatgttttgaaggacactgcccggcgctcacagggtgtgaggaaatgggtgctctcacatcgctgctggtagtgaaaatagacagaatgcttttgaaaggcaacttcagagcgtgcatcaagaactttgcctcacaaatatccacacttctgggtgtagtcatcccaattcccagaaagacagtctaagaaaaaaaattctaagcaagttccatgcagtcttacttctaatactgaggcattgaataccgacagcaaatctaagtgctaacacagggaaagggctaacacaccattgaaaactagggtacagctatatcaagggttgatagcctgcagtacaaatccaactggtagcctgtttttgtaaataaagttttattgggacacaaccatgcaaacacatggaaagggttaacctaccattgaaaactagggtacagctatatcagaggttgacagcctgcaggacaaatcagggtacatgtgcaagtttgttacatgggtatattttgtgatgctgaggtttgggcttcaaatgatctcattgcccaagtgtgaacatagtacactataggtagtttttcaacccttaccccctttcctccctgtccccttttaggattcccagtgtttattgttctcatcgttgtgtccgaatacatgtgttttatttttatttatttacttattttttttgagacggagtcttgctctgttgttcaagctgaagtgtgatctcagttcactgcaacctctgcctcccaggttcaagaaattttcctgcctcagcctccctaatagctgggattacatgtgtgcaccaccacacctcgctaatttttgtatttttagtagaagcggggtttcagcatgttggccaggctggccttgaactcctgacctcaggtgatccacccaccttggccttccaaagtgctgggattacaggcgtaagccaccgtgccaggctggaatacatgtattttaaaaagagagataactagctgaatatgctctgggcgtattagtggccacagtaaagagtgaagatgggttttaattgtctggcagtaggaggggaccaggaaaccaggaaagtcaaactctcctggcccagattttggagaggaattagtcaccagggtctttgtttcaaggagtttctgagcaacacaatggacaactttctctactgttccgccgatgttctgaggtgttgcccacatagacagcaagtcctggttattggtcctctaacaatgtcaaagaaagaatgttaagctatcgttctataaaggcaattcactcagtggtcagggtgatataggagttcagttcaaataaaatattgcagaatcttctagaaaaaagcatcatcatatctagctgaccagtgagttttagccagagaatattttctttgaaaataacccttaaattgcagatcagcatgtaagacagataaaggcagggtactctggtggaagctgtgctgggtatatttcatgctgctcccctcagctcccccggggctgccccttgaaggggttctgcaggacctctggggcttcttagagcccagctggtgaactgctacattagaccatccccagggcacctgctgcatccctggtcttttgccaagtcgagggcactggcaggagaagcagaggatactctgctacccacagaaggcagaaccatgtcctctagaaaccagaactaccacgagggcaatgacaagatttcgttgtgaaaattaaaaagtgcgacttatgattatgcttccatggagggccttgggtggggcaagaaaggacttaccctctctcggatggcagttctggagcagtttcaaagtctcttaaagggccaaggctgaggcccaagtccccgtactgggaagggtgaggagggtctctggcgggtggatatgcctagaggacaaatgtgtgaaccaaggtttttgatccattttcattccaagagggaagaacaagaagcctattgggagttgggtgtagatggtacagtgaagtcactaagagggggatcttgggtcagatttgaatcctgctctgctacttattagctgtgcccatgagaaagttactgactctttctaaacctcagtttcctcatctgtagaaaaggaaaatgaaagccatatatgatagagttgtgggaagaataaaatgatttactgcatgccaagtgcttagcaccttacctgccctaatgaatacatgctcaataacggtttgctatctgcagcaatagacctggccaagccgaaccctggcctgtcaggagtcagtaagcctggggtttgaccttcaattcatgtgggcttgaagaaagattcagggatgttccggggctgacaccagtttcctgtagctgatgagcagaagacttgttagaatttctagagtgactgggagatgccaggaggggccatcccccaggtgagtgcacagggagcctctagaaggattcgatagaatcctctgccctatcagggtgacattagggagggactacctttgtggggacctgagagagtgcttcatgtaccttctgctctgagtgaccagccccatgcagttgagattgtacatcgtttacctccacatgggaaggcatgccagtcaatctctgctctgtctctgggtcaagcatcatgtgctaccgtggtgggcatttgttgacttttgcccacttggcaccccttctccccactttggcaatagcattctgatttcatttggggaaatcagctctcctggtcttggtggacagtaaatcagggcttcctgctttctcacaaccaaggggagggcatgagcctaagccaggcatctcagatgctctttgccaggccctgactctgcgagctcattcttccatctctgtggccatgacaagaccacttctgattagttcctgttttctggtccctggaggggccctggatccttttctgagtctgcttcttcagccttcctgtcaattccgtaagattctcattatccttctgatatattccctctttgcttaagttatctcaagtcagcttctgttgcttacactgaagagccctaatggtttctgagaggaacaagtcaaatggcttcctttggcacaaaaagctatgaccaggagctctggcaccaaaactgcaaacaagaaaacttcaagtcaagtactagaagcaacctagtagccatgtcatcccccatgtcttctctgctgttggaggctgcttttattggggtgagctcagaactgaatgaaactccattccattttccagtgattggctcatatgactcagttctggtcagcggggtaaattactcccattttagagttaagggaagcctttctcaggggttctgggaaagagtttctttgctaataaaaagagaatctggggaagatgttcctcttctgcaccccctaccaccacatggcatatggccctggactgtgccagctacccatggccttgggtcatgacactgcagctatggaggtgaggctggccaacggggaagctggaacatgcctggattctggatttctgggctgtacgtttttcagcttttgaaccactcctacctccactctttggagtgaaacccctattgtgtaagtcccttgtagttagctttctgttacctgcagcccaaagcctcctaacagccaagcgagctttaaacctgggaatgggcaccccagcagcaggccaggacagctgcatccgggtcatgtcaggtggaagcccagagaaaggagcatccagtgagtggggcagacctgtggtggatccaagcagggccattcacgggtgggacagaggcagcctccaggcagtagcaatctctgaggtcagaagaaaggcagtgtcatttcctgacgatcttccttgtttagggcaggaaaccagcctatagcttgaggacatggagaacagaaccaagccccaagtggggtttgggtggaatggtgatcgccagtcaggggctcactgaggactggagttcatgtggggctctggctttgtagataattggagtcttaggcagggaaattgaggcagaaagaggcaaatccagttatgctgagtcactgacacggcaaagtttaggcgagggtgcagctcagtaacccccgccctccactgccatccataggaatgccagatgcagagttcagggcaatggggtcaattgcagcttctgctggcccactgggaactaagattctgctggctttagccaggttcagctcaggtgatgaataggcattttggagggacgtgtctggagtggggcagggggaggtagggactttcggttaagaacccacttccaccagcagctgagaaagccctagggaagtttctagctgtgccaatctgagtcaacatgcaagcaaccctaatgcccgaagagagctctactcaagttcaaggcagagtgttggtccagcactctgccctccatcccattcttcgtgcatcagccaggggatttgtcacttcctcctgccacatttctcatctgcacactctgcctcttcagagctcccacctcccctctcctagcatggagcaaaaccccaaaatagtccctgggggtcatctgcagggctagaaagattctaaaagtgtaccctcttcatgtgaccaaaaggaaaacagaagcacagagaagagcaagggtgttctgtcatcctgctgtgtgacccagggcagccaacaccatttctaaggtcgcgccagctctgacatcccatggctttgcttcaaaaggacaagcacatgtgaagtggtcaatgaattcttcagagccttatggaatggctctaactctaagccctcagtgagggtctgactatcctctcccccatctcttctcttccaatggctggtcccctgcgccaactggccagcacagtcctactccttgctctcagcccagtcctccctctcacaatgaggcgcatctaaagagcccccgcccaggcttccctgccctaatactgtgtcctgtgtctagaaactatgtgtctgtctcgttcccaaggccaagcacccaccttattcctgggcactggtgctgtgtcctgccgtggcctcacaccccaagcctgactccccaatccctgtggccgtgcagcagtggtcaccataggatggcggctgatcatagcttcttaaggacctgattcctgctaggttctcagctaagaatttgacatggattactccactgactccccaaagagggccttatcgtatagtcaccatcgctactctcactttacagataaggaagctgaagaccggagaaatcaaccagcttgctgaaggttgcttggctggtaagcggtagtgcctcgaagatgtccctgagtcagcccttttctctggactctccgctctgctgcgggcctagactgcagtccccactgccacccaccgggctggccttctagtgccctcccttccctttgcgcactattggtcacaagttcctggcttctctcaattagtagccccaggcctatgcctggccatgatatctccttcagagaggggtgagatttgacaggacccagaagaacaggcagagggtacggggaggccaggaagaggccagaaatcaaggctggtgatttgcaaatgcagagcccatggcagcatccatggcgtctactggttccctctccagctcgctcactggcagttgctgggctatagcttcatgggctgatggtggccgagcaccaccaccacccagcagacactaaggagcacggtgaaaaagcctgggctttggggccagacagtcctgtgttcagatcccagctctgtcccttagaagctctgcaagtttgaggaagttccatgggaaggtgatctctttgagccttagacttccaagcaataaaatggggttgataacaccgatcctgcatagcctttgtgaagacatatgaaaagcatttgtcaaatgcccggctttcggtaaaagctggttcccttttatgccttctcctcgtccttcctgctaccccttggagctggctgtctcccgatgccagagacaggctctctgtgttgagcggcccgagtggttccaacgatgcccaccacgtggctggcaggggcccgagcacactcggcacactggagataaatacagggtccaggcacctgactctaaacaatgggctattctggggttttaattgctcataaaagggaaggcaggctctgggcggtgaccaaccttggaggtcaggacatgcattggggtggcaaacagggcagcaaacacaccaaggtgcaggtgcagaaacgccagccagcaggtcgctaatcccagaatgtcactgagggagggtggctaacaagcctctaggatgattaccctctcagtgtacaaatggggaaactgaggtccggggaggagagcactttattctactgcttcaacaagtactcatcaagcacctgctccaggctgtgctccgtgctctgcctcagcatttcactgcgtgaagcagagacagattcgacacatgcagttacagtgccctgcgacaagtggcaggagaagcaggaacagggccatggtgatatgaaggaggcatgccgccctagtcgcatgcaccattcattccgtaaagatgcgcccactgcttgtgcgcaccaggcactgctcaggtgctggagacacagccctggacgaaggccaggccctgcctctgtggggtttccagtctcctggcagagaaaggcagtagtataaatgaagaggtagagaatgtaacatcagggtgtgtaagcaccgaaaaggaaaacaaagcagggtaaggggacactgggcacctgtggctggccgatggtttaggcagatggtcagggccgatgctaacagtgacaaattaactttagcacatgagatgcgcaggacaataaaggctctgcccttctgagtgaagagggaaaccagcgtcctgagctgacctgcctcaggggtctcagaaaaccagaaacagagccacaacctgtcccaggtctcttgtatcacaggccagagctggtcccctgcatggcccggcagcccctcccttcatagacaccgttcctccctccatcctccctggggagaagcaacaaactggtgccctcccaggctggaggccaaagccaccaggccttttcagccatcacctccttcctggccagttgcccatgctggcctcaggcagtggagcctgacaggagatccttggcctcctgacacagcggggcaggcttgtccttccctctgccacctcccaccgatgtggaagtcttggtgtcagacacacgtggtccttccacttctgagatgtgtgaccttgacaagttcagcagagcatttgtcaaaactggatgctgggccattctcacagagcccctgggaggattaaataaagtaagaaataaaaggcccccaggagcctatggcctgcagcaggcttggtaggcacggacaccttcccctcttgcagtgtcctcccacccccgatctgcgccccagcccagagcatcactccctcttctgagctcccactgccctgaaagcacttgttttctctttctgggtctgctctttgtccctgaataggactgccaactctcagagagcagtctctggcttctgcaagtccctgagcctcctgcctggggctcagctcagagagtcacatgcagtcgctgctcaataaatgttcttccaagtagctttcagccacgaaagtttaacttggagaataatggggcatgtagagctctggattcacagtcagcctctttatcagctaaatgaccctgggcaagttaactttttatgtaaatgaggataatcaccaaataccccaaggttctgcaaaattatatggtgattttaacattattgtttccattatggaatcataggtggagacaagagtctattaaatttgtaacctggtactacagttcttcccacaacatccagccccctggatgttcggcctctacttgaactctccagtgacagggaactcactacctgctgggcagcccatgccatgttttgactgcttctgagcattagaaacttggctttctattgttttaagacctgccatgctgagctctggaatgcagggaaatgagtgggtgatgagcaagcctgggggaggggctggagagagctgcaggatgatggtgggagggtggcagggagctgagagccccccgaaacaatgctgctggtcagtgggccacaggctgtcagctccccttccaagagaagctcctgataatggtgcctcatctgctcatggcttcagaacctgccagcccttccagaagactgcctcctgcccagggctgctcagcagctggactacaggggcccgggttctcaagccctgatgtatgatttatgactccgatgagctcaccagctcagggagggagggtgatccgaggggaggctggaagaaggctggttatggattttaaccctctgatgttactggctgggaatttaacatcaataattcaaggcagtggggagcaagggatgggaaaaaggcaaaagagagagggaggtggggatggaaagggagaaaagaggagaagaagtggaggacgggaagaagacaggaaaagaggcaaagatgcatttattgagtgtttcccatgggtaccatgccaccttcgcctcctttagctcatttaagactcactgaaatctatgaggcagatactgtcacctctaatgactggataaagaaattaatgctccaagaggaaaagcaaagatttcaaggacagcaggggggatgaggggatgggatttggatccatgtttgctgattccagaacacgggttctttctactacaccttgactttagagggtagccaggtcaggggacacagagggtccctgctggcctcaggacacctggccccagctcacactctggggctgacatggggagagatgagtctgaagggcttggcccctgggagagaaaccagccactggccttctggacagcaccaaaactttgttgctgaagctgaaaaaattaactgctatatttaaaagcattgttcagttgctatggtaacagaggggctaagaataatataaaaagaagatgatatgccaggttgtcactggcaacccaattttaagggtgtgtgtgtgtatgtgttttaaaaggagttttctggggggaggtgttgaggttcagactgtcttccccactccctccggcaccatctgccccagcgacatgtccaaggtgcagccaggcctggcatctcactggtctgctggcatcgggggagctggcacaccctggccctgagcctaaagataacgaaggctctcagctccctaactgctgtcccctcctggcagccccccactgcctgggctgcttccttcagctgcggaaccccagccggaggcacctctcaaacagatggcccccaaatagcttcttctctccgacctgggagctttcagccagcctggcagactccctggggaccaccagggaaaacagatggtcaggagagaagagcaggagacagatttattgatctgcagcatggatgtcagagataggaggcggcttggcagatctgggcatggggctgccctactccctgacgtgtcctggtgagacatgccaggtccagcctgagtcttcagcctgggcccaggcgacctgaaggggacccacggcaagcctggggagggtgggaagatggatggggactgggggtcctcacgcaccagccaactgtttgtcagggctgtgatggcagcacccatgggaaccatgggaagaactgggtggcaaaaagacaaaatccccaaggcagtttattgacagccaaggattagaaagaggcctggtatttttactgtgtcatggtcatgcaatatgaaggagagttttgaaatcagactggggtccccaggccggctttgctgcatgctaccatgtgacctcaagccaggccctcagcatcttggtgctaccatagggaaaatgagagtgacccttaggactatggttgggcctcaataaactgaagtttatcaaacaccaggcttcatgcctataatatcctcagcaggcagccctgtctgccaggagaaaccttcaccttagcatttctctatgtcaggcccaaaccgaaagccacagaggaacttgcacatatacacagggaatgagacacagtgagaggtgccttcacatggaagtggacggtggggccccgagcaaccgatcatgcctggagtgggcagggaaatctgaaggaagagtttgaggtagtccttgaagcaggagaacggcagggtgacagaagcacactccatgtggaggaaagcagcaaaggccgggcagggtgcagggagcacagggagggcttgctgagggcaagtcttagcctctgaggccagaacctaccagcaaggtgggcaggaagaagggaaatgatcagagctgggtgaggctcgatagggaggctggctgggctgggtgaacccagaggcagggaggcccatggggatgctgggcaaaagtcccagccagagataagggggctgggccaaggtaggacagtgctttacagtttacaaggcgtggccatgtccattacctcatttatcatcacaggatggagagagtttgctgccccacccaagctctccccccatcaccacctatcagcacttcccacaggctgggggcacccaccatgtacagaaggagctacatctagattcctgagcatcccctagaagtggaagagtccagaagagctggggggccccgatgagggtgagatctcatgagtgggtgtggccacaaagggcttcttgtaggaggagcagtgggagggccctctggacagacagcatgcttcaaacaaagctgggggatgggacaggtcatggtgcattgggaaatagtccctggaccctgctgggagaaagcaggttggggatccaggcaggtctgggtcacggagggccctgaattccagctgagaggctgcatcctcctgcaggcagtaacaagccgtggggagctcagaggggctggggcaggagagggagatgtgaacgaagccggttagaagccaggctgcatcagacaccactgccttcctcctctctgtcactctcaggcatgactctccttctcccctggctgtctgagtgccagcaacagaaagcaggcctcaagctgcacgcacgttgtggaagacgagtatgtttactcagcagcacacagccagctctgcccaggcctcggcctggcagtcttctcttttggggagagctggttgccctgtgtcctgctctgagggcacgcagttgtgaccttggtttcccatggtgaaggcacccagagtggtacctgggggaaggttctgggtctcgtgggagttcaggctgagccaggagagagctgcccaagtggctcagcatctggggaccagaacttgggcaggggaggatcccatggagcttgcattttccgacgctctttcccttattccctccaaccaatatttgttgaatacctactttgtgtcaggcgctattctaggcggtgaatcagacaagaaaaactcctgtcctcttggaacttaaattctaataggggaaacagacaacattcaaacaaagaaatgttgtcaggtggtaatgagccctatgaaagaaaatacagacaacttgagaaaggaaagagaaagtgactagagaaggtgcttgagttgatgtgatcagggaaggcttctctaaggagatgaggttctaggggtgacatctgagcaaaggcctgggtgaagtgagggagcaggggcacaaggatttcaggcacggggttggtacatgcaaaggccctgaggcaggaataagcctggtgtgtttctctgactccttgtctagtgctcttgggaaaagagaggctcaggcaggttaggtgacttgcctggaaccatgctgcagatcagtggctgagcaggaccagaggcaagttttctgcctgtttatccaggggtcgcccaccatatgtggactgggcacatttcaggcatggaccctggccagaggatggacattgactgtaggggagggtgagtcagtcattcagtcaacaaacgctgactgagcgcctagctcacggcaggctctggctgtgctgggccctagcacacagcagggcacccatggatggaagcgcatgtccccctggagcctgcattctagtggagatcagagattatggggatcatgggattccaggaccctagaatctgtggccagaatctggaaatcccagaatcagaatgaccggtatcttagcatccaaggattcggaatcccccaagcacggcttctccatatgggaaattggcagggcccttcagcggcatccagcccattttaaagaggggtggaaccaaggtctggtgcactgaatgtcccacatagggtggccagtggtggaaccagggcctttgccaaggagtctgggcttctggggcagtgaggcgactgtgggcaatggggatgaatacaggcttaggccagacagactggccgtgggtctgtaccctacgcttgctatgtcgtggaatctttctaaatctcagcttcctcatctgtaaaatggcactaagatggcatctacctcaaatggttgtcgtgagaattaagataatctacgtaaagtgcttagcatggcaaatgcttctaacacttgctgttgtgctggtaattattagtgagacttcaataacactggtatgaagtgttagatgacagagattgaaccctgctggaatgggaacagcggacctgccccagccacccggcttagcatcccacagaggatctgcccaggcgtgtcagctgatgggaataagggttgtttcactctcacctccagagacaaacatggtgtgtgtggcctggcacgagtccattgccctcctctctccatctctcctgtcttcccattccctcctctgtctctgtctctctctttctttctctctttcacacccacacacacacacacacacacacgtgcacacacacacacacgtatgtgctgtaattatagccataagaccttgacccagcccagagcagtgaaagctgagaccaaaggcattagaacgaaggcgctagtggattttagctgggggtcaaggtacatgttttaacccttcctctttgctggactgaaactaggcttgatggactaggacccaccaggaggttagaagggcaacagcccatggccaagtgggagtaacaagaagcacattcttaatactgtgagagataaaggccagatagctaaaattgagggctcagagtgtgctgctgcagctaaagacaagagctgcacaaaggacaaccaggtaccctggaagacttcctggaggaggagagagaggagctttgaaggatggggaggatttgaccatataatttattgctctatatgaaaacagcattcaaggacaaagtcaaacaaaatcaagtacaaaggcacagaggctcaaactgttagggtgcaggagacagtgaagctcctcttacaggttagatggaagtgaaacagactgggaggtggagcaagaacttgttttgcctttagttctcgcctttaccttgaaacaatggtcattccttcattcatatgaataactcatctatctaaaacaattttaggcagccctagtgagccctagtgagttttccttcccttggctcaatttctccatctcctaaatggatttgtcactgacatggagagggagactgcccaagagcagatgttcctgaactagtagtcagctgttggctgctccacatcactcagggacgtccctgtccccaccatgaagtcttaggctcattggaaagccttggggttcttgagatgtccgtctttctggggcaagttcacaataacagagaaagatgacacggtgaccaggctccagaaggagacacacagagcccttcctcagggtcacttcaacctcacagcagccccagtgggactcctgactcatgttagcaccaacacagggaaccactaagccttggagaagttcagtgtcttgcctgagtcctatatctggtaaactggcagagccaggctaggaagcccagacgcttcctggctcctatgtcctttccatcaggccaggctgtctcttgccctaagttgcacaggccaagaacagaagctaagacggaagtgatttattcccaggtacacaaggactcaaactgtggagcggggctggggtccagccacacactgagctccagaggcccagttctggtttcagctgagtggccctaccaagctacttgctttcctacgtctcccctcaaacatcctccccaccctccatctacatcgcagatgccaaaaagtcatcagagcaggcaggaaattccataattggcatgctaaacctgatgagctcaggacaccacctctgagtgggcctccagggctgctcccaggccccagactgcaactcttgaagggcctaaagaagggagatcctataattttccccatttgggacattcaacaaatagaatggttcattcacagatttactccatttggacacatcgggaatagccttgggtctgtctagaaagagacatgttcatccagctctgactcacccagttccagcactgaatatactacattattattctaccttttcaaagcctattatgtgtgattcctatgtgaggagttgagggagctacaggtgagaccagagtcaggctctaatgtcaagaggctcctaagacaagaaattagaacacttgtgcactgctggtaggaatgtaaaatggtgcagccactatggggaacagtatggaagttcctcaacaaattaaaaatagaactaccatatgatctagcaatcccactgctgggtatttatccaaaaggattgaaaacaagatctcaaagagatatttgcactcttatgttcattacagcattacccacaatagtcaagatgtggaaaaaacccaaatgtccatccagatgaatggataaagaaaatgtggtacacacatacagttgaatattattcagccttaaaaaagaaggaaatcctgcaatatgtgacagcatggatgaacctggaggacattatgctaagtgaaataggcacagaaggacagatactgcataattccacttagacgtagtgtctaaaatagtcaaactcacagaagcagacagtagaatagtgggtgccaggagctgggggaacgggaaatgggaagttgctgctcaaggagtataaatgttcagttaagcaagttgactaagttctagagacctgctgtgcaacatttgcctatgatgaatgatactttatctacttaaacattggttgaaaggtagatctcatgtgaaacattcttactgcaattttttttttttttgagacagagtttcagtttcactattgtcgcccaggctggagtgcaatggagcgatctcggctcactgcaacctccacatcccaggttcaagcgattctcctgtctcagccccgagtaggtgggattacaggcgcatgccaccgcgctcgactaatttttgtatttttagtggagacgggatttcatcatattggtcaggctggtctcgaactcctgacctcaggtgatccgcccacctcggcctcccaaagtgctgggattacagatgtgagccaccatgcctgacccttactgcaatttttttaaaagctcataagctagaacaagagacgtaggtaggtgcataggttaatcaatagtgctaatagcaaatatttatataatctggatcctgcatcaggcacagttctgagtttttacctgtattaactcacttgacacttgcaatgctattaatactatgaaggaagtatcattatcatctctgctgtacagaggaggaaactgaggcatagaggggttgagtcatggactcacaattgctctgctgctcacaggaacagagctgggatgggagcccaggcaggcagctccagaatctgtgctcctaaccccacacggtgctgtccatcggtgcacagaactgccttccctaacagaggtgtgccctgggtagcacagaggctagtgagcgtgatccactccatcagagggaggggcatggacattttcctagaggagtgatgcctgcacagactctcaatgatgaagctctccatcatctctgaagactaatgaagccagccataaacatgccatgggaggaactgagagggcctctggccaagcaggctgcccctacccctgcccctgggatctctacctccccacctgaccctagtagggtcttcttcctccctcatgcaagctcctggaactcttggtgtgtatctccttcgcagtgtggaccacaatcagctttgtctctgctgcagacttgtcttacctccctccagtggagtccttgttccacctcccttcacctctctgacatctctagctcccagcacaggcctgggatgtagctcgtgcttgtgaaatacttgttgcactgatactagttttccacatatatcagggctggccctggctggacctggagatcagcaaaataaatttggctggccttccttccttccttccttccttccttccttccttccttccttctttccttccttccttcctccccttccctctcccctccctctcccctccccttcccttcccttccctcctttcctcccttctctccctccctccctccctccttccctccttcccttccttctgcctgcctttcttccctccacttttagcaggtatttattgagtatccattgtatgtggcaggtgcaatgcagcaggacagtctctattctgtgggcactcacagtctagtcaaggagacagactagcaaaaagacaattgttggtgaaatgcattctgacatgagtccagggagcataggagcacatgaaatccacaggcttccacaggtgtggaggaagtaatcaaggaagacttctgggaaatggcatctaaactgagacttgaatattgagtgtgcatgcatgtgcatatgtgtatgtgtgagagaaacaggaagaaagagaaagacagagagagagatgcatgtgtgtgtgtgagctaggaagcaagaggttaaggccagagctttgagggaaagaggtaagaccaggtaggagatcctgagggtccttgcaagttgctctaaaggaatttagcatttaaccccagaggccatggggagctattaaaggattttatttggggaatgacgtgaccaggtttgtgttctagaaagatccccctggtgcactatggggaacaaattagagggggcatggtggtggcagataaaagcagctacagaaatccaggtaagacaaggctgttagcagtaggagtgacaggaagggacacatctgccagatcttgagtcacttgattttccttgggggttgggggatcaggaatgagccctgagtttgggtcatctcatcccttccatggggcccctctctttcctgccaccatccccatccttatcccattgttgtaacggaaagtcatggaattcttgggggaactccatgaaatactaaagttctggttccatcacaagaactgggaacaattttcactagcagaaaatgcacccataccataaaatcatacacacacacacacacagccaccacacacacacacacacacacacacacacagccaccataaaaaaatatgctgcaaaactccgcagaattggctggttttgatattcctcattaatatttgtttgctacttgtacatttcattttattgcctatgagcactcattagcagtcaagcagtagcaagtgcccagagcttatgaaaagccaatgggagaaaactagaagaatgagataatgataagtaataactttgtcctttactgcaaattgggaagagctaggtattggtttagtgtaggagtgaaacatctcagcacagccctcagagcccagggtcagggttaggattagggttagcactttcataggtttcttctggtcaaggctggaaagcaatctgattaactagatcatggtaaggaatgaatgaccaccagagtagcttaatcctgcctggaggtactagcagctcggctttagagatggagaggaagtaagctttcccaacttccttcaaatgctataatctgcctgtaaactcagaggataatacagatgttagtttctcttgcgataataatatcatgaggggggaggggcagctcgaggatgaatctttttctccaggtttgcagcggtagcttgaagtagtgtcttggggtggactctgacatccccttccaccactatccactgtcaccttccgaagccactccaaatgagcaaacataaactctaggttaaaagtgtgcttattctacaaatgcagcttcaagataagtcttctgtatgttcccacccctcaccagaatactgtccctgggatcctcctctgagaacagttggcaaagctggttggtccccttagggagaaaagggctggccttcatatggaatgcctagggctgaataaacaatcagatggggtttccttcctgacctactactgctgccaagtaaagtgaacagaaacgtccaccacagaaggccattctccagatgagaaaaccaaggatcagagaacaaagacttggcttggattacatatgcaggaggttcctgcacatctggccacacctaccctttctggctctttgggacatatgatggagactggaggcttccaactctgagctgatgcacgggtaatggacaggggcagctccacgtcagtgagacgtgatgcattaagatgctgataccatggaaaaaactgggaggtgtgagcccctccccagccatcacacacaggccaaacatctggtctgcactaagggcacctgccaaatctcgcctgaggccatgaactccagcccaggtgagacggttctgttcctttgcaagggtggcccctaggcctggacaaggctgaggtgagagtccggctggggctcagcagaagcctgtgaatgactccggttgtgctctcacaccaagacaaagaatagcactggcatctcccacctgaagtttcacaatggtctacttagcctttctcacccacaatcccacaccaactcagggaagaaagaccagctgtttgttttcctacttggcagaggaggaaactgaggttcagagtggtcaagtgacctgcccagagtcatacagcaagtgaatgagaaaggcagaattgaaacccaagactcaacactttttaccatctttgaatgaaacagctgaccctaagcaggatgggcacataagaggcacctctcatgctgtgaatggcatccctgaatcaagaacgcttcgggacatgcagacatgcagctgggcccctaactggttgccacttatcagccgatgtctcctcactcctgccacaagcctctcccagtcacagggacaagggaatgatggttccttacaaggaatagctgtcaagaggcaagagaacagacatctctttttcctgaattatgttagagcccaggagggatgttcaatcttcaagggcatgtgcggacctacctaatgcaacagcaatggaataactaagaattcccaggacttcccacctcccaaagcccaaactattgtctgtgctgatggtaactgctcgctccaagatgaatgggcagaagctgggatgaaaggcccagacacataggactgataaagcaaacaggttcagtgtccagcatccgtatggaaactccataagaggcaagggccaacagtcctctgtcccttcctccagtgacccccaaaagacaggcaggcactatcagatctccaggataggctcaacaatactggaaaacaggtgtattgtccccattttgcagatgaggacatagtggctcagagagatgagttgaccagtcccagggtcattttaagacccaagctgcattacttttggaagcctccccgacattctataaaatttatcccttgctgaatgtaatattttgctggaaaacaactatacatttaaaagataattttgtttttgaagtgattttcagtgagtaacctgtagtatgaatgatatgctctgatttctcagcagtcattgtctgcaatcaggaaccttggcaaggtgaggcatgctaacccccaaaaggagggctgtttctataaaaactaaatcatacaattcattatgcttgagtatattaactaaatattaattttgatgagcagttttcatattttgaaaccaaacctttttcttttcatgtctcaagcattttcatgagccctcgagaagccacatgggcccatggtgtctcccgggtaaatcaaacccgggatggacctgagatttgaacacaggtctacttccaaaaccagggctccttcctcaatgtctggctgcctccaagagtcaaggcaccatctctaagttgtaacagggaaactaccaaatagaaccagcaggcaagcaggcatgaagggggctggaagtgaggccctttgagaagctgttacagattttgtagatgtttgatcataaacagccatggcagtgggtgacgtttacacacccgctcatgttaagtcccacagttacctccttttgagcgtggaggggttaggaaactcccagtgtcacatagatagcaagtggcctcaccacgatttgaactgggggagttgtgctctggagtccaaaatcttaactgctctgggatactgggacactggagcagaaggatttggggcaagtctggagaggcccaagtgcaatactgagacatctagaacaataggagagaggagatcagttcttttggggaaggtcaaagatagaggacaggtgtggaggctggcaggtctcagctgactagagagaagaactttcttaaaaaaggcagagctgtcgaacaatggagggctgccctaccctgagtgttgagtgcctggtggctggcagtctgcagggaaaatgatgcctctgtgctgggcatgggggcaggggctcttgctgtggtagagggctgtacatatggactccagagggcgtaagtgataatcctctcttcctttctcagaaccacctttctacaggctttggtgtctcagcgcgggaggcacagatggcgaggtctgcctttggccaggtgtgggcgcccagtgttgggggagaagactgcaggcacagaagactgaactcacaggcaggtccggagatgcagagctggtgttcactgggtttttctatgtgctagttactggagcttcacgtgtgtcatctccttctctcctcacactctctgagggtggacttcctcccatctcatagatgagaaagagcctggggcccagagaggctaagcagggaacctggggctgcttgggatcctagggcgatctgacagccacctcagcttccccaccacgagggatgaagccgggaggcagccccttcctgtgcctgacccctaccagctgggaaatgtggcccaggcaggcaaggcctctggggatcccaaagtggcagcaggcagtgggagctgagcagagaggagtaggggtgggctggggggacactgccagacggaaatgaaagtggccttgagaaaaaggaacgagggaagaaaagcagaaactaaaacaagtgacaaagaaaacgagagtgtccagaggaagtggctgaggggcgcggcgccgccggaggaatcccccgcagaccggtgtttcctctcttctcagaggcctcggggtggaggactagctgaccaactgctccgtcactttgggccagaggcagcccgggtgactttggcaagcatggcctcatcccgccagcctaggaaggagcaccagacacagagccccaagccctgggctggagtcgtagtcagctacttcctgctgggtcattctgggacatttattagacctctctagtacccagtttcctatctataaaatgggtataaccatcctgagcccaccacactgctggaaggatctcctgagcaaatgccctcatccagggcctgacgggtgcatgttggggtaggtgggctgtgcacacagcggcagggtgcaccttcaggatacctggggaacagacagggagagtatccaccatcttattgttgaacaagaatgcatcaacgcttgctggtccttaatcaccctaggctttgtcaggcctgggaacaaagggctgaataagggccagtctattcccaattacagactctgcatgcaactccagttccttatcccagctctcctacttggtagctgtgcaaccttgagcaagtgacttgacctctctgagtatctttcttcacccataaagctagaacaataagcatatctgtcttctaggttgcaaggaataaatgagaccacactcaatccaaagccaggcacaaattcctcagccccagcccagggagtgcccagcctagaggggagctggagtccaaggacatgagcaggctgtaatgatagacggcacccaggcctggggcactcagtgctgggcaggggatgcggggctggttctgccaaggcgacagagcagggggagtaagggggggtgaaatgtaatcccaaggggacagcatgagcaaatgtgcaggggaggggccaaaggcgatatgcttgggatctgcagagggtggatgaggccagacttgttctcaatctacagccccactgacagttctcagactggccctggaagtgatacgggcatgccactggggatgctacagtcagctcttaatgcagggctggcttctagggtcagcttctacagccagacttgcctaggctgcagtttgtctccagacagacacgggaattcccccaaggggtgggcatggttcttgtgaactgctgtggcctgggactgggcttagagtacaggcagctgctgcggtgaaggtgtcagaaggcacaggctagggtcccagagaggtttaggagggggtttctctgctgggtgtttgctcagtgctggatggtgggtgctgagggcctcatttgcatagggagagcagctgctgtcccagccacactgctgcccacaatctccacgtggctgcaatctcgctctcagtcaccatctcccacatggactaggggttacccaggctgccttggccacgtgcttcccccaacacacagccatccaggaacaaccagaaatcagactactgtctccgccaccctcaggggttccattcagggagtccacctcccaaggtggctgtgggaataaaacgagatcctgggggaagcagagagcccagtgcacaggggtgatcagtaaccggcagcccctttccctgcctttccctctacttccaacattatgttgtgaagaacagggcagacctgggcccatgctatctctcaccctggctctgtgacttgaggcaactcactccaactctgtaaatcaactgctcatctgcaaaactggcaagaaactgagaaggcactggttctcagattggcaaagctcatcgtcactgcctcactccctcaactctatgtccagggaccacgggtttcccagggttcccaaacttgctgttggcaaagggcctgatatccgtcactgacctttttattctgaatgggtccccgttgactttaaagctggaatattcttagaggaattctaaactcctcctttccaactccctactcattttacagaaggagaaagtgaagagaagagagggagaagggccctgaccgaggccaccagcttgtaagtagcagccctaggcttgggaccagggcctcctgaaggtgacagtcctttcagccatgtgtccttgttcctctagttacctccaattaactctaggtaacccagcccagtctttgattctgtgttgaaaggtgcgaggtgctggagccgggaagaggtgcgttcttgctctcgacaggaagtgtcatgtgagtttccggttccctctcctccactaccactctggatcctcacaccagcccacagagggagacaggaagggaggcacaaaggcagggcagggaatactgtgcctgttttccagatgaagacacgaaggccaagagagggaaagtgagtcggccaaggtcctccagctagtcggggttgagcgtgtttaaccttaggaaacgtgactgcagagcaaggggctttcatcttcctgtgggaattcgccccctttctcacaggggccctcaagagactaggcaggctcctcctgcaaaggattcctctttgtccatttgagaggcctcaccccaggctctaggagctgacatgattcagctcaaggaagactcagtatgaagggagaaccaggaacctgggcctctgcccctcacctgtggccttgaacaggtcacttctcccctcaagccttggtgtcctcccctgtagagctgagggggtgaggagtagatgagctgatccttcagtttgctgccctctttgacccggaagtgctgggcctgcacaaccctgcatccctggcaccagtgctcctagccccaccctgctccagatgcccagtgcctgaagagccagctccccatcagcactcagtcctggggcagagccaggcctggcaatgctgggggagaccctggaggggaacatcatgggccaccaggggcacgctgcaaatgcagcaactaatgcaccaggggcgccagggtgcaatctatctaagcagttctctcacgctctttgcacgttaataatgcatgggcagccggtgtgggggccatcacaggcccaacgtcaggtggcattaggaggcctctaatggtcctgattatccggtgaaggctcccagtgggatgtgggcagcatgggcaggaagccaggattccgggcacttagaccccacaggtgggaggctggggggtggggcaagaggacagcttccataggccagggtcctattcaggggatctaatgggactagctgaggcttcctgtggggggtgaatttgtttgtgaagaggagcaaggacgcaactcccacagccagatcacaaagaaagtgggaagtcagaaacccagggctgagtgaaacctcttaaaatctctcctctgtggcgtctctgaccagtggctctgcagcaagtgcctctagggacaaggaactcactacctcctagagtgacacatgcccattctttgaacaagtgtgactgccgggaaaaaggtgtactgcgtacagctgtcaagaatgcaaatgccactgagtgttgggggcatgggtaagttggataaaggggctgatttgagagacagaggtgctgggttctaatactgaggattctccttgtcctcaggcagctccggagccatcaacctggccagtcttcacagcctaccccagtggcagaccccctgaatccaccccagggccccagtaagcccccgtgaacctgtgaactttgcatttctatgctcaacactcagggtgagcagtccagaaaaaacaacccatgcacagcaggtgctgggggtagtcaggcttcaagatgcctccaaatggttctcatctctgagtattcacactgaatggaactgacctatgtaactaacaggatgtcgtgggaatgacaggcatgacttccatggctaggtcataaagagattgtggcttctaccttgctctctcttggaccccagttgctggaggaagccatctgccatgtcaaacagcctatggagatgcccatgtggggaagaatggaggtcccctgccaacaatcagctttgacatgccaagcctgtgagggagccatctggaaagggagtcttccagccccaatcaggccttcagatgactgcagccctggccagctccttgactgcaacctcatgacagaccttgagcaagaactgctcagctaagctgcttctgaattcttaacctacagaaatgtctaatgctttaagaagcaaagtatggggtaatttaccacatgcaatagataacaaaaccatgtgcaataaatactggttaaacaagtgaatgattcccctgaccgagtgtttctctatggaagggtctggcatggaaccaggccctctggggcctatgggggatggagaggaaacaaaagatgaggacatggtcctctaggaaggctgtggcatgtggtggggaatgacaggtgcagaccagagggagcagtgtgagagctttggatgggctagactatgtggggaagatgaggaaggagttctgagagaggggaccacatgagccatggtgcagcttgggccggacggggagcatcagcagaggcgggttctccagtggctctcatcttgactgctgtatccctagcctccctgagacagctactattatcatctcaattttgtggatatggaaacggagattaagcaactcgcccagggtcaaaacgctgggaaatgatggagccaggatttgaactgaggagaccatggaacagaaaactagcagagggcggtcttaacaaggcccaaggagatgaggctccccagcagggtgactgaggggagggcacacaggtgctagggaaggtggccaaggaaaggccactggggctggtactataggagcatagaaaggcaggggaaagtagccttggggtggggggtgacaaaggccctgcctgagttgaggactacatggctttgtacccaagccactcttaccccagctggagcctcatgtctctcccaggatgctcttgctgggctctgtgcctgggctgaccaactcccttacacagctctgcctactccccatcatacagcacctggaccgcgacgctctatccccgaggacaaggcctgccttcccccaacagaaccccaaacacttcaagctacagtctccagagactctcttctccagagggccctgcagggatcagatgggactgggggtcggtaggagggcagaggacaccaggtttcagtccccatgggaggcaggagcatccccagcctgcctagtccccaggatctggttcacccatgtccctaggacccagccctgggcctggtacacagcaggtactcaatacatgtgcatggaataaataaaccagcagatgcagaactccatcctgcaaacacaaagcagttcagagcacactgggaaatcacatggaggaaatgttctggccatgaattttcatgctggtccctgataatccaggtcttttctgtcattgcccccagggactgctggcatcttcccggctgcactgggcaacactccatatggggctgtgctgagacatagtgacagagtggagggggtggggaagatgagaacacaagcaggggcagagccaagggatgggatgtccttggattctgaaacccgagtgctgacagccaatgtccaactcccaggtaccaagtggtaattactgtgaaaagcagacagcttgacaatggaggatgtagatttcacccaaggccttaccttgaaccctcccccagtcacatcacaggccatagggcttgtgggaagggtccttagtggccatccagcctctccctatatccaagaggaaactgaggcccggccaggagccgagaccctcaaagctcacctgagagttggtggtggagttagaactggaagccagagctcccatctcctattctgtcgctcaccaaacatggcctggctcttggggcgttgccctgggagacaagcctgtgctctgagggtccactgtggctgagtgacttaggggaattggttctgcaaaagaaagtgccaggcagggaagcagcaaccaagggactggaaagaggaaagggatgtggggaaggctctgggacaggcctccctggctcctcactctctttgtccccctgccaccttctcagaagcactctcagcatcccaggccagcctccagcccagtccttctcccaggctgttcctcggctctcaaggcctcagctcctccaggtgtcccactcctctcaacctccagcccctgcacagaactcacactccccgccctctcccccagcacaagctcacagtccccactccctggtccattccccttcctgcctggctgctgtgcaaggtgcaactcagccctcaccccctccttgctctattctccatgcccccaaatctgctgctgttcccacctcacccctcctggcctctccagtcagtgagcagaggctgcacccaccaggcctggggtgggctctctgaggctcatgtgcattgcagctgtctctgctgcactgagtggatggtgcctttggcttcagagccccctgcatctgaattgagttgctgccacctattctagctgtgtggccttggccagccagtaaacctctcttttcatctgaaaaacggagcagacaccttctgcacaggttaactaaagaaccagctggcacgcacatggcccagcgtttggcccagggaaggcgagagatagacatacattcagtgactggactaactcggcaaatgtttccagccaccccctcccatgcccagggtccaggctggtgttgaacatagtcaatggccactaagcatttcactgactgattcattcttgctgctgaaaggtgttcagccaaggagcgatgggccactgggtgatttagaaaggccctttgggctgccatggcggagggcagtctgggaaggaggggacagaagccaagagaccagagaggaggtgactgcagctctgtaaaggagtggagggctgggcaggtgggttgggcagtaggaagtccagccagagactcaggagcaggacccacagcagccagccccggggcaggacggcagttgaggactggggcagaatagaggaaaatatccaccaacgtgggtggctgcttgatgccattgggtgagacatgatctaaagaggaaaggcaggtttagggctgttgtctgcagcagtgaaaatgatgaaatgaggaattgggttttgcagtgttaagagagtgcttacagggtattcagggtgttgtctgtggggtacaatgtttgcgacaccaaacacatcccttcttcagtgccaagatagtgccccaccaacatgctctgcaacagcaaatcatttgccagtaccatgacttttttcaagtaatttatgtgcttcaacacatttgtcttcaacaaccctttgcagaaggcactataattatcatctccatttcacagataagaaacctgaggctcagagaggtggaatcatcttgcccaacaaattatcaacaaagcagaaattggagtcagttgcaaataatttctattgagtgcctgctgtttgggagatctcttcctacgtaagggcacgtagaaccatgtctagcacacagcatgcatattaacacttgctctgatggtgacgatggtgaagaagatgatgacgatgaaggtgacagggatgaggatgcacttctcacatctgattgaatccatttgacaattctaggaggagggcatgagtcccccttgtctgtggggaaaatgagccacaacagtgtgggagtttgtggcagtatgagggctgagctcaggtcacagaggtcagtgtcacccagagctcattcactgctctaaaatagaaccatccaggctctgctcactcccttcccccaaattagcaactttctaccactctgcctttctcccctatggctggcaggctggagatatgtctccagcctggagatttgggactcaggcattgctggggaattaaaccctgctctcctcctccgtcagcacaggcaaactccatgacaggcggatggaggatgtctgcctgctccctggccacccacgtgctatctaaattcactgccagacaaagccgcctctcgatcttggcgcctccctccctccctgccattcatgcactgagagattgcatttccagtaagtggaggctggagagagaaggaagcaagcaggagggtgggggctctgggggaagaaggaagaggagagaaaaaggcaagaacactgaatcaggcccaagagttagccccaccatcaaagtgacaacccattaaaaaaatgatttgtgggtgtgcaggggagacaccacctctgaagagccaccttttccatgctcaatgaggcagcatctgcagccagtgcccgcccagggtgtctgggagccgatggttatcacaacagcccttcacgctcccacttaggaaggaatctcgagagttccaatgttctgatccctccccacttttagaagcaaggagtgcccgggcttcatgcctccatggcattcgttctgggggaaacctgaacgaatttccaattgcatcccccgtggtgttcagatctctccctcctgcagagccttggcaggtgcattctctgtccataagaaaacagaccaagctcctttgacaagctacagatgctcagctccccgtggaaggggttgaggggccaagaagggtgggtcctggggccctgacaaggcttcctggctttgggagaaggaaggtagggccactgctcccccagctccttctgccacagaaaacagcctccccaggtaacctaagcaggggtcttgagaaaagtagccatcctgggtcctggctgtcttgtctgttaactgagagggctgcaccacatgccacccttccatgccccagatgcaggatgagcattcactgtgggcagatgcaggccaaggaaccagggcgtgcatttctggcttccctccgcaaactttcactgccttccagactctgtactggatgcctggggattaaggcacaaggatgatcacatgtgtgtccttgggtggctcagagtcccaaggaagaaacagatggagagcagaggccccatcatgaccggggcaggatggtggcctgtcagagggatgtggcctgaaggaagtgttgaaggaccaggaggagttctggctctttttctacccagagaagctgacacggttggccagggcactatagtcactccagggctgactcttcaggctccagccaccacctaccccttcttagaccctggtgcctactactcctgccccacctccaggcaccagccacaaataatgttcgaggtcttctccgccctttcctttatctgctgagaaacatggctcccctcgttccccgctcaccagtgggagtgcccactcatgaacatagacttttggatctaattggccagggtttgaagaccagctgagccacttacaagctacgtgggctcagaaaagctgcttaacgtatctcagcctggtttcctcatctgcaaactgggatgaatagtactactggcagggttgtctgggggactgattaagatactgtgtgtgtaagcaggcacttgaccgatactcttgccgttcccactgcccacagtgcctccaacccctgcagtcccatttttttgtgtctggctgtggtcaaccgtcatatctgagatgagacctctatctctgccatgaagggtccctgactctccaagactacaggttcaaaggatctgcttccccaaaaggctgagcatacccctgtcattgggtttagtgtcctgggctaccatggcccattgaatcatctgttgtcccaccagctgctaaacacctgaaaaagagtcttatttgcagtaactcatttgctccttagcatccttggtttacagatgaaggaataaaggctcagagaagagaaatgacttatcaaggtcacgtggttaattaaatagaaggtggggcggggaactcagtctggcactttatgtaagaactgtgttttaataagggtcatcaacccaaggccttggtgatgatgaggacctcaggctcatgacaaaactgggcagggagatatatttggaaagggagattttaatgtggaaacggcttacagatttgtgaggctctgaggccctaaaatacagcaggtgtcacttaacctgttctggcacatcctacttgccaggccctgtgctggggcctttgctgtacctgttctgttctgtgtcactgaaattctgaagaaggatatggatccatgccatgtctatagaggaccatgaagctcagccatgtgatctgtccaaggccagagctggtagcactgaaactcaaattcagcattggccacctctgggagggcagggtcctcttccatcctgctctggccagtgggagggacaccccatgtggagaaggcctgccccaggccttggcctctaggaaggacgagcgggaagcagcgtccccagagacatatagacaagcagctgggtctcacaaactctggccaagcccttgtactgcgcagaaatcgcaggcactgtcgctgaaccagtcctcagaaatcagtaaagccctgggtttctcaatccaggtggcggcctcagcacggagccatggggtagcggggcatcttctcagaccatcaattctacttggagatgtagggaagaaaacaatttaaaaattcctaaagtaagttctgatacatgctatagcataagaatgtttaaaactcaaagaaattcattgactcttctctgtggaaaagcttaagaagttttgagttaatccaaccctcccacaaagcagaaagatagtagagtctgaggcatcaggtgacttgctcaagttcccatgatccatcagctcacaggacctggactcaggcttggaaaccagcggctttgtggtcaggaagccctggattccagtccaagctctgctgctgtgtaactgtgctgttttggcttgatcaattcctttctccatgccttagcttcttcaccagtaaaatggggcagctgtcttggcagctatagggattcctgggcccaccataaatgcccgcctccctgtctgcctctttccctacaaacagggtaaagaaacctatggagagaaaactcccacatcagcactcacatccccaagagggtagattctaaaatcttttctccgttggtaatgaaccatggcgccattagaccacaacatttcacgtagtttctgaaatcatcatccatatgaagatattgtgcttggaatcatctcacagtcaccggaaggctgaattccctcggccacccactgctttttgcggaggaaacagaaatgtctgaaaatagaacgtgaatcgatgcccccgacttgctgccgcaaagtgtggcaaagcccaaggagcccgcgccgcctctgcccctgcatggccccagacggctgggggtttccgggcagcctggagtaggatttcaacatctcaagctggaggtcacgtgcacagagcagccggtggcaaacggggaactccaggaagccaggctgtttcagagaagtacttggagctggggggcatttaggcaggagccgagtgaggtcagagggtcggtggcagccgtaggcctaacttgccagagagggaggcccagtctcagtgggtcactccttccaggagcagaggaacagcgtgacagcccagtggcggccaagtgaccgcccacagagcactgggcacccacaactctctttgcagatgggaacaccgagactcagggagggtgagtaatgtgcccccaggagttacccagctcagcagagaaaaaattggggttgcccccaccccctctgcctctcttggaaggaagtcttggcttcctcaggcgctccttccactccacccactgtacccacccacctaacatctaccaagcatgtctcaaccccagactcccagtatcatcttgtctgcttccagataaccctgtaagacaggcagggtaatcatgcccacttcacagatgagaaaaactgaggctctcagagaccatgtgacttgtttaaggcagaggctcaagtccaggctgtctggcccacctccccagtgtgcttcagaagagagcactagtaacagcacagtggccatgacattcctacatgacagcatctcagcatttccaaagtgttttcactgccaccctagcacccagccacaaacagccctttcctacccacaaccacggcataaccaggaagttgtctatccccattttagagatgagaaaatgggatgagagggttgaagtaacttgcccaaagtcacacagctaagaagtggcagatccaggactcaaacctaagtcctccaggtctccccatactcaacctacccatccacattgctggccagtggacgggatgaagatgtgggcgctggcaatggtgtggccactgcctccccggccaccaccaatgctctgggccctaaggccctgcaccccttttctctgatgaccactcagtctccaaggccatcctgaaagcagcttattgcaagacctgctggaggctgggcagccagagagtggatgagttaatgtaggtgggacaggacacccctggcttctctgccgctcttctattgcctatacacagctgcaccatgcaaacctggtgtgattgggcgaggagggaacagacactgggaagcccaaaggttctggaatgacattgcctgcttttctctccagtgctgtcagggcaagcccatgacagcagttttgggtgcaaagagtggggaagaaggtaaaaactgccatatacagagaggctggctctggggcatgtgtccttcatatttattctacaaacgtttaataaacacccaccactacacaggccctggctaggagctctcacacttcctccttcactcatcctgacaaccaacgtgtggggggaccccactctgtgccccaccaccatggcagacaggcaagcaaaatgggaacaggagcactgcacaaggagtctgcagtcatgggtaccagccctggctctaccattcatccacagatgtgtgacccaagcaaccccctgccctcagtgggcagaagcatggctggggaggacagccaggcctatacgaggcagggaggaacagggacagctggcagggggtgggggctcagtttcctgtgtctggccagaggctggtgcttttctgtcctctcatcagacctacccagagacggtagggcaggaagagaacgatttcctggactcctaccatgtgccagccctggccaaacattttcacatgtggtatcttgtctaatttctgtaacatccaagtgaggcaaaaacaggctcagagaagggaaatgacttgccccagatcacacagctagagcagggaggaactgcaagaggatagaaacacagatctgtttgctttcaaaaaaggaggggaagcttccccttcctttttcttctcccgggtcccctagcacctttgtcttcctcctccgcttagctagaatgtgttagcactggaggagcaatggaaccaagaggcaggtgtggaggaactcatctgcttcccacctttgcattctcctagcagggccggggtcccaagctgtctttccatggtgggagtgggaggtgctctcctgcggagtcctgacccatccccactctcccacccaccctatctcagtgactaatgggccgtgccgctgactaagctgccctcgcagggtgcacagtggaaacaaacccaggttccttcctctctaatcctcacccccatccttggcctggggtctctagccaggccctgtgttacacagagaggtagcccatgatacaggtgagtcacgctgaggctgcagccacctggatctgctgcctaaagaagtgctgccctatccatctgatttcccatggggcgtcgggatgagaaggggctgtggaaacgaacagcctgaattttcatttctggctcaaccactgattgtgtgaccttgtgtctgctgcttcacctattggagcagcctaaacatcccgatttgtcaaacacagggctgttttgaaaactagaagccatcctatctgtaggatgccagaaacatagtaggtactcagcaaatctgagcttttcccttcaactgtctaagatagactgagggctgaaggccaaggcatttgtttacattgattgtccaatgaaatgaaatgttttcctattcctgacttgatttgtggcaagataatgctttttagaattgattctgacttgtagtttagccctgaattctacaccattgtgaattggaccctgaatatatccagcctctacagccagaagttcgaggtggggctggtaccaaatcttatccacccaaccatctgtccatccatccatccacccatccacctgtccatccatacgctcatcttttcttccattctgccatctatctgtccaaccgtctatccatccatctgtccattattccatccacccatcctttcattcatccactcatccactcaatgattgaatccccagcatatgccagccacagcaagggctccaaacaaaaaagagcttcaacagcttccgcatactctgctgctgttgactcagacacacatcacaggcagctaataattacttttccattggtcggatgtggagaggaagagcactgcctccctcccagcatctggcttgctcgacattgcctttctctgttccacatgcaagtctcccagtgactatctttctcgtgaatacttattccttgatgaacagggtattccccataagagcagaggttttcactaaggtacatatccctaatgtgcacatgtatatactgcctgcctcatagttctaatggggatttagggcctgtgtggggcttgcagttgattgtactgtgtctatctgcccactgggtcagcataaggctttacacacaggacacacttcccactttagcttctctccctctgtcgcatcatcttgatccattttcaccatcactcccctcactgtctagaatttgcagtctgtgttggtttgagaatctgtgtaacaggggagtgaggagtgcagtctctaaagctgggcccctaggtttcatatccatcactctaactgtgtggtgtggaacgagttgctaaacatctctgtgtctgtttcacatctgtaaaatggggatcgtaacagaactaatttcatggggctgttgtgaggattaaatgagatcatgttgtttttctaatggtgggcaataccacatcatgagggggcatttttaactgtaagtggatattaggggatgttccaaaggctgcggtggggtatggggtatggggtatggggtatgggtatgccactgacagcatgaggcaggaaccagaggtgctaaatcttgcaacatgccacacagcctgcacaacaaaaaactttcccctcaaaatactaactgcacccctagtgagaactcctgtgaaaagggcctcagcagggcctggtacaaggtagacacccaccaactgtgagcttgccaccacgtaagctttgtaagtaaaggaaagaaccttgtctgtctctttcagtgctaccaaatccccagcacttaggacagagcctgacatctggcagacactaggtgaatgaatgaatgaatgaatgttacatgttcagtcaatgactggtgagtagctgtttggtgaaacatgtcaaatttaatcactactagtgtttgctatgcagctccaaaccacaggataaggagatggtgggggaacagctgcccctttctgaatgtcccgtcctatccttccttcaaggcctgagacccctggagatgacgctcagggactcgtcatttgtccttcactggtgaatactatctgactcataaaagcttctctcttctccatgactagaatgtgggggtaggatctgcctctcttccctctctggtcctgggtataggggacttggtccctagcaggctcagtagacttgtgagtggttgcattgaatgccggccatcaggcacctttgcgtaaatgtgggcaaacctggtcaagcagagtaattgggaaatggaagggaaatgggggagggagggactccctggatattctgagaagaggattcaccagaaatctcgatttctacccgtgtcaaaaattcttccatccttaggcacctcccctccttggtaacacatagaatctttcccttctgacttgagttcagaagccagccagcatttttttgttttttttttgagacggagtctcactctgtcgccgatgctggagtgcagtgatgcgatcttgactcactgcaacctccgcctccaggttcaagcgattctcctgcctcaacctcccaagtagctgggactacaggcgcctgccaccacgcccggctaatttttttgtatttttagtagagatggggtttcaccatgttagccaggatggtctcgatctcctgacctcgtgatccacccacctcagcctcccaaagtgctgggattacaggtgtgagccatcacgcctggcccagccagccttttaaaatttatgtcactgaacttttgctaagtgcctactgcatgcagtggaagagctgaatcaaactagttcctgcatgctggaggtgccagtctttggcgggtgccagtctttggccatgatcagggtgtgctggccagatgggagacttaggagtttatgtcaaatggggttgagttcctgatactcctcagaagctatgttttggtatttaatgtctaacggaagctcatgttcttgctggattttcttgtttgatttgcttttgtttttctgaaaattctactcagtcgatgtattgatcagtgagattgcggctaagcgtggttttatagggtgggctcattcaaggggtgaacaagaagacagttcaccttctcatggaacttacattccaacacatacatatctaacatattacattccaacacatacatatctaacatattacattccaacacatacatatctaacctgccaggtgcttccaagtgctgagaagcaaaccaagccatgtttgaggataacaggagtagaaggcagggggcagggggaagggtgggagaggaaggtctctgattaggtgccatgtgaacagaggctgaggaagtcaagaagccagtggcgtggatctcagaagagcttggatgtcagccagtctcaggattgtggttctggaaggtgtaagctccagccagaacctgggggtcccagcactatcaagggagagagatggttcctttccctcagtttcttctctctggactttgggcccaaatgactcagagatggtgactttctctaaccctctcaaaacccatactcaagacatttcccctttctctaacctaagtctgccgtgtcctttctcaccccactgggcaggtggagcacaggaggtcactgcccccacagatcacatggtgaaaaagcagccctaaggtgggaggatgctgaaagatgtccctcagggaactccagggacatccccaaagcagtccccataagccaaaagggctttagtctcctgtttgatcgttaaaagccatgcatgtataaaattctgctttgcaatctatgcatgtatctacccatgtggtaaaatatacatgtattcaattattcacctgaaagatgggccaggtctacactgaagatccactaggcctccaacactctgctctgaccctggagacaagggcatccacagtcgagagcacagggcagaggagacccctggaattctaatcgtgacttgctatagacataccacgtgtctttcctcgacagagggaggggtccctgtggctcttgggccccctttccaggcagctgatgtctctgaggaccccagtgaagggcaggatgacgtggatgataaaagcctgaattagagcagggttgtgggggtgggaatatgggaggaatgttctggccagaggctctcctctttccaccggagggaatataacacatcccctgagaaagcagatgcggctgtttcacaggcctccttgctgaggcttcagggcctgtcagtgaatcctagcagatctggtccctaccatgatgcctggcatcaagaatcctcaatcagtatctgttaaatgaataaatgaaggaatggtcaacgaatgaatggctaagtcacaaagcaccagcagccagcccctggctgagatgattctggggcacttctggccctaatcatgcattggcagtgcctccaccacccttttgttccactctgaagcaatcatttgatggactgcctgctgcccccatggtttccctctgtggctaatgcagtaaaaagagccatagattataaaccactaattgtatttagagaaaaaaaaatcttgccataataatgggtaccaaatgactgggtctctgctaatcacctcgcatttattatctgtttacttctcacaccaactttccatcaaccccgtttgcttcagattagaaaccaagggcttcaaaaggtgacatgtttgctggggaaatgggactggctgtgaagtcctctctcttctttgcttggcacaggaagaaagagcattggggacttgctcccctccccatttcaacttcccagtcacattccttccaataagaagaatctaaggcacttaaatgctatttatttatgcctatgagcatggggtgcaagagcttctgtccagggaagctatgcatggggatggcaggtcccaattgggcttcggtggctcctgactcaaggcacttgtttctaggctgctgtaacctatgagtggtctggtgtggggagacacatggcatggggcaatggcacttagctaagccaaactgcccaggtctgcagcagacactgttggagcttggccccttcccctgtctcttgtcatttccttgcactccagcctgacctcttggcctcaattttgcatgcacagaggactggaagttcttgggaattaatggctgccactatcactatctcagccgtgggccagccctcaggtaacggctgctgggtgcagggtataaatgccctggttccctcgcaggtgcacagagtagagaatgagcaagtcaggagggccagcatgtgacctggtgtaacagcatcacccccggctcgaggatccatgggtcagggagcatgaaatcaccctggggtcctacaaagtgggcactatgactcccattttgcagatgaggaaactgaggattcccacctgtgagaggcagcagcaggataggaattcaggcctgtcagatttaaaggccaaacacctgctgcaggagagaggcaggggagagggtaagaagctaagtgccaataggcagacctcagggctaggaagaagggcagtgagggtgaggggtggtacgctgggccagcacaggcattttattctgagaacatgttggggctggtcagtacctagagaggagtgctgcaggacacccccagctcccaactgatcctgccagttcttgccatgcacccatggcagtgccagtcacccaggacccaatctggcagctgcctacctccaaagctactggcaactctcacctgcatttctggcagggggatgaggaaagtggaaagaatccattttttcctgattataaaaatagtacatactgtgaaaatttcagaaagtataaaaagaaaataaaaatgacttatgatcccatcctagagatcaccaccattcacatgtgagtgtccttctggtagacctttttctagacacatatgcagtttgattttagtttttacatctatcagctatactacttttttcttttattgatatattatctgtatctttcaagtcattgaatatacacctatgtcaccatctttaatagctgcatagtattgtgttgtgtagatggctcccattttatgtaaatcaaccttactgatagactattgctggttttacagtaaacaatgctgctatgagcatctttaaaatagtgtctttctggggtcaattaagaacatggatcaaaaggcttaaaaggataccattccctttgacccagtgattccactcggaagcacttgatggtcttaaggcagtaatcagatggaagaaggccaccagcacggatgatccagagaatccagagaataggaaccagacagcaatggaaggatcccccattcttgagttaaggccagggcaggcacatggttcatatataaacattatatgtctttcagtcttgagtgcctggtgtggactaagcacctaataaatgaaaggtgagactggtcacaaatgcaaggtgggaagcccgtcagaagtcacggcagggcctttccacaagctggattggtgctacaaccctggaatactggctttaggttcctctgggtgaggaacttgtccctctcttgtccacccttgttactttccctcagcttcagggagagtaaatgaagaagccaggggctaggaaggtgaccagaaaccctagtttcatggaacaatgacataccaaagccacacatatctttgttctgttcatgaccatggagaggtcatttcctcatctctgccccacctccttcaactattgaatgggaaactgtggtccactcacctgcacaaagcaatcagggggcagcgctgtgaacagagactttagagtaacatcatcatgactgtcatcaccatcatggcaacaataagggcggttaacatttactgagcacttgtcacctgccaggtactgttctaagtgcttaggctatgctaatcttcatgctagctctatggcgttgatactatcacagtcaccattgcatgatggaggcaggaggctcagagaggtcacccagctggcttgctgaattgttggggtctgaacttagcagccttcttctaagacacagatattggtcagaatgccacagaccccctgccgcccaccagcggggtccttcaggcttcttatttggcctctttgaggcttgagtttccttgtctgtaaaatggggataccactttccatctcattggctttgaggactctcaggggagcagtgcacacaggaggaccaccactcagctgggctcagagtgtgtgtgccttccgcaagcatctgagacaggtgccacaaatgagggctgcttgctgcccacacaaagatgatctgcccccagtcaatatacacttgtctctctcttgtccaccctgttagagacagaacaaggggtctctattttcagtcatgacagggattccttctaaccctccaataggctgcagacagtgaatgtcacccactagaaggtataaaggcataaaaaggtatgatgggtgtaaaaagaggtttgtttgaaatttgtgacttcacacttggcactcctggtagggatgggtcaccctctggcatccatgaccatttacccatgagcccctctcacttcccctgggtgggtttcagcaaaggcaaaaaatgcatatgattcctgacctgagggtttcttccaggattcaaaggctctctggactctctgaaaccttagaaaaaattgtgtgtgtgtgtgtgtgtgtgtgtgtgatggagagacagagagaaggagacagagagaatgagaataattctagagagagggcctgtagctgtcaagctgtcaacatagtttcactgaggctccttcattcctaagaaaatttagaaatgctatgacaaagggttttccctgtgaaatgtcattacatagatcagccgtgtgctctctggcgcgaaatcctcccatcccctcaccccacggaacagagctcacctggggctcacatagccctaactaatttggtcttcattagctatgtgatcttggataagacatctcgctttctagcccctgttcttcccatctgcaaaacaaataagttggacttgtgagtggcttcagcatgtgctctacggagctccgggggcacaggggagagtggtgtggccttgggggtgaaatgtatgtgggggtcacctctgtccaacaacagcagctctagctctcacagaatctgcatgaaatgttacatgagcaaatggctctgtagcctaaagccaaaattgaaacaaaaccctggcccagttgatcacttggaacctttctggcttgtgaggtctgagccctgagcagcaccaagctgctctggttctgtaatccttagaggcggtggagcctcctggttaagagtcagaacctgggtggaatcttggctctgccactcattaagcgccatgaccttaagcacgttgcctaaaactctctagcctgcttcctcttctacaaactgcacacacctaccccacagggtctctgtaatgattaaacaaattaataaacctacaacacctcgccagatccacagcaagcacttgtaagtgttagcagctatcttctgtcacaacttctaacatgagtccacaaacatggaattcatcaacaaatggcagctgaataaacgagggagtgaaggaatgaatgactggagtccaaaattccattagttgattctctaagtgagcccactcaaagcattaatccaaggcttcctaagctccagtgtgtgcatcatctgggaaccttgttacaaggcagaatcagattctgcaggtctgggctggggctgggccttggcatttccaggttccaaggcgaggccattgctgctggactgagtagccgggccttggttcattgccactcatattcattagcttgtaggcttcccacctgcagttaccaaaccactcaagacccttgaaaatctctgtagattgggcactctttatcacctactgagctaccaagcccagtgcacttttttttttttttgacacgcgtctcgctctgtcgcccaggctggagtgcaatggtgcgatctcagctcactgcaacctctgcctcctggattcaagtgattctcctgcctcagcctcccaagtagctgggattacaggtgtgtaggattacaggtatgcaccaccacgcctggctaattttgtatttttagtagtgatggggtttcaccatgttggtcaggctggtctggaacttctgacttcaagtgatccatccatctcggcctcccaaagtgctgggattacaggtgtgagacaccgcaccgcacccggcccccagtgcacccttggactaggttcgtaagaacggacatgggcatccgtgttaaacccgaagttcatgtctaggctctaccatgcaatgaccggccaagtccctggtttctctggggctcagcatcctcacttgtaaagcaagatcagcaacaccctccctgcccagcccatagaactgctctgaggataaaaagtgacaacagatgggaccatccaggggccagaggtcgtgattaactggcaggctttatttccaacttctcctcttcaccctttgaattcatcccgagggaaactgacacacattttttttttttttttttttgcataatggcatgcaagggaagaggagaggaagtcagcctgctaaatttagcagatgcttacgccccctcacccagggctcagcccacgcatttcaccatgagtaggtgcctttctatatttaacttctgcctgcaccttccccttgagctctgacaccaaaaaccccaggaggatgtggtgaggagggaagggaagttcacgaaatgagcagggttgacatcacatgaggccccacctgcaccttcaggtgtgcgttcttcaacctttcccctgtccttctcttggagcttaagactcacccagccaaagtgtgaccagagatgctactgccctttgggacaacagcactcagtggtgggcaagggaccatgaaaagcccaacagaagtcatggcgaggcaggagagtgtctaatgcttcccataggcacagcactaggcccatctgcacaagtgaccaaagtgaatccacacaaaagcatcacacagatggtatcatactcaggctgccgatgagcaagtgggggccccaagagagggagttgtccaaagcctgtgatgggtggagggtccaaagcctgtggtgggtggaggatccaggcctgttctccaacatgaccctgtccatatcacatttgtcttctcactccaccttctttatagaagactgctggggaggtgatgggttcaagtcttacctatgtcatcactcaggggtgtgactttgagttagtccctctccttctctggttcctcactgcacaacaagtccactggactgcctttctgtttgatttccgaaaatcttcttgatgacatcagaatccaacgatcagaggaagtgagaatgaatccggatgactgactttcaaaaccacagggtgacctctgtgctgcacctccctggtcagcacacatggagtctgtggcagtcacccacggaggctccgcaatagctcctcacccttctggggagccctcactgaatgcctctgtgccaagcagctcagcaggctctgggtggactgagatgaaccaggggcctagaccagggtccacctccaaagaggggaaaaagaccagggaagactgcggctctgactgtgatgtggtcagcacggcgatggagctcccatggggcacaggggctggtgcctaacccagcctagggggctgagggaaagacccagtgggaggcagacaaaatacatccaacactccaggccagcagttctcaaagtatggttcctgaacccggagcatcagcgtcatctgggaacttgttaaaaatgcaaatccctgggcctgtcccagaccgacagaaccagcagtctgtgtttgaacaagcccaggccctccaggtgattctgaggcactctcagtttgagaacccttggcttagggcaggccttagaagacagcaaaaccttgaactctgacctctctgggttctattcaaagcttggctaggaaaagtaacaattcaggaaagtgttctaaataatctggcgtcccttctctccgctggacaatctcagtgctcactttacaaagtgttaggctcagggaaagatccacatctgagtctggctactagcctggctgctgctccactggctacatcgctgggcactgcctttgggttttattgagcgtgtttacaaccacagaaagactgtctctgagttgctgtaaagcggttgtattctatcaagttacacaaaactccttctgtaaaaactcacgtgagaacagtggcaggtaacttggcaaagactttctaaaaatgacaagacccagcattggtgggagtgtagggaaaaagacacagtcacacatttctggtaagtatggaaattgatactgcctttctggagaaatacctgtcaaaagtgtttttttaatgtgcatccccttgacctagcaattcaatcttagaaattaatcctaaggaaataatcatgactgtgtatgagtaattcactccaaggatattcatgttagcattgtttgttttaaaaattggaagcaatgggccgggcacggtggctcacgcctgtaatcccagcactttggactttgggaggccgaggtaggaggatcacttgaggtcaggagttcaagaccagcctggccaacatggtgaaatcccgtctctactaaaaatacaaaaattatccgggtgtggtggcatgtgcctgtaatcccaactacttggaaggctgaggcaggagaatcacttgaactcgggaggcggaggttgcagtgagccgagatcacgtcatcgcactccagcctgggacacaggagagaaacgccgtctcaaaaataaataaataaataaataaataaataaataaataaaaatagaaaacaatggaagcgtttctaatgaggggctgtttactaggtggccgttcattttcattcattcaggtatttattgagcaggcatcatgtgccaggcagtgtattagacattaggcatacagcagccggtgaatgaatgaacaaaatctctgtcctctgggaggggagacaaccagggaaccagtaagcaagtgcaatatccgttgtgggtcagcgggtggtgggggtaagaggagaaggcagcaaaggcaatgctggaggtgagtgccgatggagactagagggaaggtgaggaagtgagtgagctctgtggacagctgaggaagacattctgggcagagagaactgtcttccagacagaaggaaacagcaaaagagcaagagcacgcggcattctgggtgggtctgaggaacagcaaagacaccatagcggctgccgcagggtgacccagcaaggagagtgggacctggccatcagggtcgtgcaggaccttgcaggccacccaggacctttggctttcactctgggtgagaagggaggattttgagcagaggaggacccctgatttgtgttttagaggcaaccctctggcttctgggtggtgaagagactccactgccctttgagacaagagcacaggagacaaggatcagattgcaatgctgttgggaggctatcacaacaatagtctttgcatgctagagatagcagcaagtgagccaaggtaatggcaatggaggtgagaagtggtcaacttttgagtacaatttgaaaatacgtttgggcttttctgcagagcgatgcctgcctgccgtacgtgtggctgcctggacagacgacttagtctccagaagctgagatgagcgacaataagcaaggaagagagggtgcaatataccttcagagggaaaaaggagtcagcaggggtcgccacacaaacctgcctgctcactctgttggacatttctgaaacctcaaatgtgaatcttgatatcaccaaggtaccaaactcttctactcagatctgggggcactggctgcctgcttaggttcaaaggcaaccaaagaaatgcaatttaaaataaggatgtgaataatttttcagttatcagataggcaaagattttttaaaatgataacagccggggttggtgtgggtgtatggaaacaagcgcccctacactgcagcggaagtttaaattagtaccacctttcaggagcagtttggtaatacgttatcacaagccttgaaaaagtacatgccaaaggaaccagaacactgaaacaattttgaaaaaagaaaaataaggtgagaagcatcactttacctgatgttaagacatgatatagctacagtaatcaagaatgtgtggtattggcaggacagatacataggtcactggaaacaaatagcgaacccagaaatagttccacatggctacagccaaccgagtttggacaaaggcaaaaaagcaattcaatgaaggaagcatagtttttttttaacaagcggtgctagaaatattagctatccataaggaaaacatggacctcaatgcaaaccttccactttatacaaaatttcatccaaaagaggtaatagatttaaacataaaatgcaaaaccataaaacattcagagataacacaggagaagattttcaggacctagagcccagtgaagagtctttaggtgtgatatcaaaagcacaatccataaaagaaaaaaaatccacaaaattgaatttcatcaaaattaaaaactgcttcgcataagaccctgttaagagaatgaaaaggcaagctatggactaggagaagatatctgcaaacaacaaatctgacaaaggactcatatctagaacatacaaagaactctcaaaacacagcagtcaaaaaaaaaaaaacacccaaaacaataaacaatctaattagaaaatgggctaaagacatgaatgaacacttcaccgaagaggatatacagatggcaaataagcacgtaaaaagatgttcaatgtcattagccattagggaaatacaaattaaaactacaataaaatacccctacatggctattaaaacagctaaaattaaaaatactgacaataccaaatgctggaaagaatgcggagaaattgcatcccttgtccattgccggtgggaatataaaatgatatagctacactgaaaaatattaatagtttctcagtttctttaaaaaaactaaacatacagttagcataagacctgacagtaatactcctgggcatttatctcaaacaaatacaaattgtgtgcacgtaatctgtacttgaatgctcacagcagccttgtttgtaaaagccaacaactggcctacaataggtgattagttaaacaaattgtacacccataccagggaatactactcagtgattaaaaggaacagactgttgttatacagatctcggataaatattaagggcaatatgctgagttttaaaagccgatctcaaaaggtcatctaatgtatgattatagagatagaggacaaaccagtggttgccaacagtcagggatgactgggggatgggaaaagtatgactataaagaggagcagtaagaagatctttcaggtgatggaatagttctgtatcttgattttggtgaatctacacatgtgatgaagtaacgtgataaaatgacatagacctgtatgcctactacaatacagtatcaaaaccacggattgattcctggttctttttccaaattccacttttacaaacttatcctaaggtaatattaaaaaggcaccaaagagccctagatccctggataaacaggatcatttcaaagttgtttataacagtgggaacttagaacaaacctcttcatgccaataattggttaaatagactaggataaatatatccaatggaatattatacaatcattgaaatgatgatgtagttctacattcgttgatatggaaagactttctcaatatactcttaaagggaaaagattacttaaaagcaccatatggttctttaaaaaataaaaagttatatgaatatatagactgcaagctccctgagggcaaggatttttgtccgtatcatttactccagaatccctggatctcagtatagtgcctgacagaaagtaggcactcaataaatatttgttgaataaacaaataatatacacacacatttgcaaagtctagaaagttattctgcaataaaatattagcaatggttggctggggtcagtggctcatgcctgtaatcccagcactatagagggcaggatctcaaagaggagggcggatcacttgaggccaggagtatgaggccagcctgggcaacatagcaagaccttgtctctaaaaaattattattattattattattattattattattattattttggagatggaatctcgctctgtggcccaggctggagcgcagtggcgtgatctcggctcactgcaagctctgcctcccaggttcacgccattctcctgcctcagcctcccgagtagctgggactacaggcgcctgccaccatgcccggctaattttttttgtatttttagtagagacggagtttcaccatgttagccaggatggtctcgatctcctgacgtcgtgatccacccgtctcggcctcccaaagtgctgggattacaggcgtgagccaccgtgcccggcccaaaaaaatatttttttaattagctgagagtggtggtttcacctgtagtaccaaggaggatcacttgagccaaggagtttgaggctgtagtgagctatgctcatgccactgcgctccagcctgggcaacagattgagactgtgtctcaaaaaacaaataaacaaaaaacaacaacaaaacccaaaacaatggttatctcagaataggggaatggaggaattttggttgatttggttgattaattacagccccttcagtctgtttatattttctactttgtatttatttatttatttatttatttatttatttttgagacggagtttcactcctgttgccctggctggagtgcaatggtgcgatctcagctcactgcaacctttgcctcctgggttcaaactaacctcctgcctcagcttccagagtagttgggattacagggatgcgccaccacacccactaattttgtattttcagtagagacagggtttctccacatttgtcaggctggtcttgaactcccgacctcaggtcatccacctgcctcggcctcccaaagtgctgagattacaggtgtgagccaccgctcccagcctactttctactttttaataacaattatatattctttatggaatatatatttttgaagtacacaatcacaaacaaagtggagaatgtgctgtggagatctctggcctgattgggcaaaggtgggggtggtgcagttggatgacatccaaccaaggctgccttccccggacaggttttggtggggtctgaagaccattcccagggctctggtgtgagggacactatgtctggagtgagaaccctcataagagatcttcacaatagtgaggccccctataagccagagagatgatagaatgatgagccaggtacacagggaatggggagagaaggcatcagtcctggtccaaatctcctctggagaggggctgggggaggacacaggacagaaacctgcagacacatctatccaccagggcctatcttatgcacagccttccacgcttcaatggaccaaggtagtggttcccaaaagacctgtctgaagacaggctgcatcacaattcctaggaagctttataaaatatagatttccgaccttggaacccaagtctctggggaccagaacccaagttctagagaccattgaacccaagtctctgggccgaggcccaggaatgtcattttacaaattccttgggtgattgtgatacattgtggggtttgggaacctccaggcagtgggcataaagccaaaacagcatcatgttggacaaactggtagtagttatgccatttgtgatgaaaggatatgggaactagcagtgattgatttgtaagattttctctgaagcactcagaaaaatttaaagacattgctagaatcttagacacctcccttttaggagaatggggggtactggccccactgctcccccatagtgtactgtgaccaatgactccctcactcccatcttttttaaattgtcgtaaaagatacataacatttgccattttaaccattttaaagtataaaattcagtggcattaagtgctttcgcagtgttgtgcaaccatcaccactatcaaggtccagaactttttgatgactcaaatggaaattccataatcattagcagtaactccccatttccccctttccagctcctggcaaccaccagtctgctttctattaggttggtgcaaaagtaattgcggtttttgccattacttttaaggtcaaaaactgcaattacttttgcaccaacctaatatctctgtagatttgctcattttgggtatttcatataagtggaatcacacaatatatggccttttgtatccagcttctttcacttagcatgttttcaaggttcatccatgttgtagcaggtatcagaatttcatccatttttatggctgaataatattccattgcatggatatattctattttgtttatccactcatctgttgatggagatttgggttatttccaccttttggctattgtgaatagtgctgatattgtgaatagtgcagatatgagcattcatgtacaagtttttctttgaatatctattttcaaatctttggggtatagacctaggagtggaattgctgggtcatatggtaactctatgtttaacttattcaggaacctccaaaaggttttccacccacactcactcttataaggcatctgatacctcagtctgtgctctggcacaggcacccaaggcatcccagtctgtgccttggaagcctgtagcagagtcttagggtttaaaagatctgggtgtaggtcagactgtgattctacaagctgtgacaccatgggttggtcatttctttgtactttggtcatctttgtgctttggtttccacataggacctcacagggtggtctaaatattgaatcagataataagtgagactatggataaaacgagaggtgccatattagagtagtagggggtaagggctctacctggccctattgttcagtgatggtaaaaccttggtcaatttcttatagcctatgcttcagtctcatctataaaatggggtgaataagctgggcatagtggtgcaagcctgtggttctagctactggggaggctgaggcagtaggattgcttgagcccaagagctggaggctgcagtaccccatgatcacacctgtgaatagccactccatagctctagcctgggcaacatagtgaggccctgtatttttaaaaatgggatgaataagagtacctgcctcataggactctagtgttaaaacagtcaattcatggaaagcattcactggaaagtggtaccaacttagctactgctagaaaatgcttagcaatactggtgggggccgggggactggtgctcacattttcagcttgcacctgggttcctgccctccctttctcaacttctctacttctgtctctgggcttctctgctgggacccttctctctcacgtccacaggtcaatgcccagcctgaccccttggttaatccctcttctgtgctccatgccctgcagagcttactttgctgagtttgacttgagtgtagactctggcttgttcattttatggatcttctctagggcctattatacagtagatactcaatagatacttgctgattgaataaatgaaagaaaacatttctcttcaactggggaattggctcatggggctgatcacagtacagggccctggggcttgggggccctctccacaactaagccaggagcatgcccaaatgctccacaatgcctctccccagtttcacagtctgccaaacagcacagtgagaggtcacttcaggatctaggagtgagtggggcagagcagtgacaaggcccagccacctggtctccccagccttcctcagctatcttgggctcagaaagtggtgatgggtaggcatggactctcctcccatgaccctcaaacatgtcccgtctgtctccccactttacctgtcctctcaaatgtaggccatttgagcctacactcagctcccttctcttttttggaaataaaagatgctctgagaagaagtgtacattgccagacatggaggcactgaggcctgccagtctggtgagagagactacagggcagagagattacagggacatttggaaggaacattgctggtgaaggggttctaaccaagagcagtccttgagctaggtgtatgcgcatgcatgtgcatatgtgtatgcacctatgtgagtgcccaggtgtgtatgcatatgtgtgtgtgcacatgtgagtacatgtgtatgtatgcatgtgcatgtgtatgcctgtgtgtgtatacacctacgtgagtgtgtgagtgtatggttgtgtatgtgtatgcatgtatgtacctgtgtgagtgtatgagtgtgtatgcatgtgtgtgtgcatgtgtgagtgcataggtatgtgtgcacatgcatgtgcatgtataagcatgtgtctctgtgtgtatacacctgagtgtgagtgcatgggtgtgaatgtgtatgcatgtgtatgtgcatgtatgcttgtatatgcatgcacctgtgtgagtgtatgagttcacaggtgtgtatgcataagtatgtgtgcctgtatatacatgtgtgcatgtatgtgtgcatgtgtgtgttatgcttatgtaagtgcatggatgtggctgtgtatgcacatgaatgtgcatgtacacatgtgtatacataagtgtatgagtaaataagtgtgtgtgtgcatgtatatgcatgtgttcatgtgtgtgttatgcctatgtgagtgcatgggtgtatatgtgtaggcacatgtatgtgcatttgtgcatgtgcacttatgcacccatgtgagtgtatgagtggatatgataatggcaggaggcagacaaatcccaaggcagacaggggcagatccctagtgaaaaactgactttcaaaccaaagacagtttaaagcctgaaagccgagttacaagtcccaggtaaatccatggactggattgagaacctctctttccatttggcgtgctttcctctgattgatccccactcctcacctattttacacatacctacccttccctaattggttttttacactgtcatgctcacctttgagtggtgcctttgttttagccttttttgcatacccacaaaccaatcagcatgcactgctccattctgagcccataaaagccccggacccagccacattgagggagagagaccacccaacttcagatgggggaccaacctcacatcccctctctgctgagagctattttgtagcttaataaaactcttatatgcccttctcacccttcaactgtcagtgtaatctcattcttcttggatgtgggacaagaacttgggacccactgaaggtaagtatgaagaaagctgtaacactgtaaccctcccattctccatcagcagagggcagccaccccatgcagcaggaagcagtgtcagggtcaggccagccctggatccgcaggctggagcagggcagtggactaaaggagctgttagcatgctctaacacctgctctggggcttcagggttgtgggcatccccgtttgggtgccaccgcattcccctcatctggaggccagagtccaccacagcagtcggtcatgacatgcctggtccaaatgcaagccccacacaaagcctgctcctgtgctggcacttggagcagctagccggaccccacacttgcttgctcacacacccacttctgccatgggctgagtgcgctgtccttgtggccatgggatctgcgctggagtgcaagccaggcacagcctggtggtttgagtgagcaggggcatcaccagccatgaaggtctctggctggcaaagcggcactgaaaatatcctgcattagataggcatgtatgtgtatgcatgtgcttgcatgttagggggctgagctaggggaataggtggaattggccactccttcctggatgcccaccagcttaatttcacatgtgcagccaggtctgggcagctgagcctgcaggcctgccaaggtgactggggaatgcctgagagtgtgaacactaatacaaaagccagatgccaagtgagaggagagttcacacatcagagtgtcatggtcaccttgggcaagtctcttctctggggctttaatttcctgcccatcaaataacaaaggggtcagagaccctctttttcacattgcattaacatctctgctaagagctgctccagcatgctcaaggagacatgctgctgacagtccacccctctctcccgaggctctgtttgctgaggacatgggctggcaactgaagagagcctggaatcctggggcaagcactatgcccagctgccgtccccctcctgccctcctgcacaggggtccccaaacctttccccaactgccacactccatctggctgcagcagcagccatccagggagtgctcgtcctctctgagacctgcctggctctcatgcttgcttccattcaagttggatgccccacccctgggaacagccctgacttcatgtcccctacagcctaagcaccgttcattcactagactggtagtctccaaagtatagtatacaccattattgagcataggaggaaaataccagggctactatttctacttatcacatccttctgcaaattcctaatttatatgtgtatgtgttagtatgtacaaaatatatcatatagtaatgctggagtacgttctcaaaaatacttttactggaagagtatgcaattaataaagtttggagattgtgttagtggaggtaaaatacacagaatgacgataactacaatttggtgtttggtgacaaatgtcacaatagaggtgaaggttaaatgctgtgaaagttcaagaaaggatgtaattgctactaactaaagtgcaggagaagaatcagtgaagacttcatcagaggattgagtttggggctgaatcttaaaagataggatgtggccatgtggccatgggaaggaagggctctcccagcagaggtcatcacataagcaaaagcacagggctggagagcagacaagcacaggacagatgcggggcccagagccctggtgtcccagctatagatgggaaaagcagtcggatatgagatgggaagggtgggttggggacaaatgatagagaagggactctgaataccccagggatgtgtggggaatgtgcacaaaactgaaaaaaaatgaggggagccaatgaggattgcttaggagggaagagacatggcccaactgtgtttggagacttttaatctaggaggggagtgtaagattggaaaatggaaggtgaccatcatagcccaggcaggagggcctgaaatcaatcagaaaagaaagggaaagaaggaggcaggtgtaagaaacatcgtaggagcggatttaactgagtgccttcactgatgggacaaggtgcgggtggggggcatgaggacaggagaagcgaaagataagtcaaccttcaatgctcagtgaccagagggacagctgcagagggaaacctgcaaggaaagttcaggttgtgaggtctgtctccattgtctagaagtgacaattaaaggataagagtctgggtggttggttgattttacaaaaaagatgaattcgccaagggctaaacctgtctgcacttttgatggaaacaggtctttatcttcatttgacaaacatttttgcatccctcctacggggaaggcatcatgccaggcactgggaatgtagagaggaaccagaaatactgcccctgtcctcaggggccctcagtagagaagggaaactaccacacaaagaagtttttgacaatccgtcagctgagtgctccaacaagaggccagaggagggttcatggcagtgacgctctccctggctcggcagccagagccatctcctgagaggaattccaacctttcttcacaactcagggccatcatcacaggtgggggtggcatgggatagatgctaggtgcccatcaccttgcatttttagagaaaactgtcatgtcaactgtgtcaccctttaccaagcaagccaacctcagagtgcacagcaccatgaatttggatcttgcaatctcttttattcttgcctcttgagcttctttgacctccctttatttttggatttagggggctcccagaaatttggtggagaggagagctctagatttctgagtgtactttggcttattttaattaattaacgttttccctcctggccccatcagccttgttcctttttcagacttcctcatctccccagctatttataaacccctgttcccttggcctatgactttgttcctttctcactgttgaatattcatgctgtaaggtctccccagagagggaggtccccattatctacccaggctcgtctgatgttgtttaaccccgatgtgtcctgaaacttggcagagtagaaacagcacaagctctcaagtcagccagatgtcaacatctggctcctcccctgttgtttgagtgtctttgggcaggtctccaaggatcagcatccttaagaataggatggttcaccatactgttccctctttgtttggaagttaacctttagtgttgatttattttgtatttgagtctcaaatactgtattggtaaatttaaggaaagaagaaaacagaaattagcctgtaagctgtaagccttagaccttctaagcaaggtctaccctatatattatcacaccaccttcccaatcccctggtacaacacttggcatacagtaggtgctcaataatgtcaccccctccatctttcctatcccattgactttccccccacctgtttgatggttttcatggggtccatatgtcacagaatgtccctgccctcaggcagtagggacttcatgttgtggcctctctttgcggggagcacccctgtctggggtgtgcctgctccttctttctctccagctgtctctctgagcctgccctggcccacgctggctgacatacacctcctgcactgataactatttgctgctgcacttgcccctagctgggcttggccgctgctgcagagggccatcctctgcctcacatcctctgatgagtcctgggcaggttcaggtgggccctgggcctgagccatggtatgtactctctggctgcagccccaccagaaaaatactcactgtctgaagaccagcacctggaggctctggagttagtgcagtgctttcaactgggggtgtcttgcttcctctgattcccaggggatatctggcaatgtctggaaacatttttggttttcacaactagaggttactactggcatctagtgggtaaaggccagggatgttgttaactatcatacaaggcacaggacagccaccccacatcaaagaattattcagccaaaaatgtcaatagtgctgagatttaaaagctttgggcagtgtcattaaacataacaatacctgccattaattgagcacttgctgtgtgtcagaggctgtgctaagtactttacatgcactttctcatttaatcctcaccaccacggtatgagacaggcagtgccattttcccattgtacaaatgaggaaatagagagactgaaggtgaactcacttgcacaatgatgcacagctaatcaatggtgtaggcagggtttgctcttgtgtgccgctgggcacatctggacagcacctgcatcaccaactccctctctgctgtgttggctcagtccagtgggcagtgcatctactttggttttcctgatgagcactccattctccactaggcttggagtctggccagatccacttaatggactccaacatacctccaaacactctcagccttgtggaagccatgtcaagaatgaacagtctcttggaagtgtcacagagctccccatctgtctggcctccttcctgctgctaagcagtgccccaaccaaccccgcaggaggaaagactccccaaaattgtcctacccaatggatactctacaccaacccgcactagactacagctttggcagctggctgagatcccagccacagttccactcagccccagatcccacttcctctgccccatctgggtcctgtgtggtccacaatggttcttactcaggtcctgaacctctcatcttctgtctgacacccacatctcatcaaatgcatcatctgggcatccttatgcaccctgattccatctcctatttggactcctccctctgggccccaagattccttccacattttatactcagttccactcaaattctgccaagctttcactaggaaggaagcactgtgctggggattaaagaggacacagaatcaaagcagatacagctcccccaaccgctagagctctggtttcatggcgggagtgaattttccacaatgggatcacagtaaggtaggctcccctcctttagggacatgcacagaggcagaggtgtggttgacctgtgagcagctgaggcttcccagaggaggcaacactgggaagaatgagggtgtgggccccaccagttctgatactggagagttccagggtccttctgcagccctgcctttgtcctgagggcctggctgtcacctggctctgtatcaggactcatggaatcttagcctgcatttttgctgtgcttcccagagctgaaggactctcccttccaaatacccgcgaacaagcacactgcttgacctgcttctccctcactcagttcatgcagttgacttatctgcatatagtgcctgttttatgtcaggaacccagcagcagctggagtcacagattctctgagctggcagggcttttgttcatctggcccaaacttgtccatccttagtacagtttctttccactggatcgtgtttgtcaggaaatgaacaagaagcctcaggctgagtttgctcaggattcatttttacctcgttcttcctagttctgcatttgttccttataacaatccttcatgctcatgaagccatgatggattgtagatgtagatggcagacatcattcattgtcatttacagatgaagaaacggaggccaaaacactaaaagcactgcattccaggcctagctctgtggctggctgctctttcccctcaagctgacaccatctgtattagttcattttcacgctgctgatagacataactgagactcggaagaaaaagaggtttaatggacttacagttccacatgactagggaggcctcacaatcatggcagaaggcaaggaggtgcaaatcacatcttacatggatgacagcggacaaggagagaaagcttgtatggggaactcctctttttaaaaccatcagatctcatgagacttattcactatcgcaagaagagcaggagaaagacctgaccccgtgattcaattacctcccaccaggttcctcccatgacacatgggaattgtgggaattataattcaagatgatatttgggtggggacacagccgaaccatatctccatctaaggtaagcttcttttggagacccagttagatagttctaccaatctgtaaatttgtggaattataaaaaggtgctggaattgatcttagcagtacagcagctagctcctttgacgtatatagacccttgttaaccagcttcccttgttggggtgtgaaacccccttcgtggggataagaggaactcttctcgcaggctgggaggaaatctaccagtccagaagaggaactgccttcacctcctctacactgaggagttgctgcttctggtcattcacagagaggaagctgagggttttttgcctatgctattccaaatttaatgtaaatatttcactgcaagtctaaaacccgccctgttggctttgcttggcctaaccagaagtatttcagtgcaatctgatctctgagctcagggctgttcctcaggacctcaggccgcatccggcaggtctccccacaaggcttccattccaacccttacagaaaagagtggccttgtgatattatgaagcctgccaatctcatgtcccttgtgctgcagaagcacttggccagcgtgttgcaatgcaagcgctttctgatcaatatctgttagcatcatggccctaagcagctaaaaatcacacaccaaatggttcccttttgtagcaagaatcatttcatttgctccttgactttcaggtaccttggacactaaaacaacagtgtatcaaaagccagccacagaaatcagcctttacacttgcaaagcattgtccactttccaaagcacgtgcacctccctcagcccatctggccaaccctacggggggttagtgactcagggttactgctacattaagcaaagggtcatgtagtatacaatcaaaaagtaacttcacttttatctccccctgtcccactaaatgtgtccagaagagctggctgttctctgccctttggaagaaatctagggcacatcccatgatgttttccatccctctttaggtaattaaaagtcttctaggaaccaagattccttagagaaagcactgattctaaggctagggctcagaaaatacaagaccagcctggagaaacttgtagtgccagaaaataagaaagaagtaaaaaaagaagttaagaaggaagaaaggaacaaaggaaggaagtaaaaaggataaaacctctaacctgaaaaagcttccaatgatcaaaacatccaatgactgatattccaaaggtagaacaatttgagtaacaaaataaacaacaatagcattgtattatgactcaaagaataaaaatctttgggtcaatactaatgtaaataatgtattgaataaataaataaatggataaatggggagaagggacaactctttcttacaaaagaattctaagtaataaatgaaaaattgaggaaagtagaaaaatcactcttagaataccacagtaaaaatggcagcaggcaagattcactgataaatgctaaaattgttttttgtttgtttgtttgtttgttttttgagacagagtctccctctgttgcccaggctggagtgcagtggcacgatcttggctcactgcaagctctgcctcccgggttcacaccattctcctgcctcagcctcctgagtagctgggactacaggcgcccaccaccacgcccggctaatttttttttttgtatttttagtagagatggggtttcaccatgttagccaggatggtctcgatctcctgaccttgtgatctgcccacctcggcctcccaaagtgctgggattacagatgaatgctaaaattaaaaggtaaagctttaaggagaaacaggatatctgcatagcctcaacgtatctcccccagaatattttctaatgactgtggtagttttaacacgtgtccgaaaatgatttgatattcctccctgcagcaggtggagcttcgttcccctgcttgagcatgggccggatgtattgactggcttctaatgacagattatggagaggggacaatagtgacttcgcaatgaacccggcagataccaccttagccaagtgattaacataatgagcaataaatattattgttgtcatgcgccccccaatataatgcaatgagaaggggacagcacttctaccatattttccctcaaagtccataacctcagtctgctcataagaaaacattacgcaaacccaaggtgaggaatgaacattctatagtatgcccgatcagtatgttccaaaagtgtcaaggtcatgaaaagacaagaaaagactaactgtcacagaatgcaggacactaaggaggtatgacccccacccccaaatgcaatgtgcaatcctggattggatcctgttccgggatgctgttgtgctaatgttaatttcttagttctgacacacctaccacagtagctttgtaagatggctacattaggggagacagggtgaaaggtacaccagaactctctagagcatgcattgtcaacggggcatttctcccccaaggggagaaaattgtctgttgggtagaaaaaaaaaatcacaatggtttgtggccctctaaagggccacagtacataaatagatatccagcatatctgtgggactaaaattttatgggagaaaaatcatagaaataaacacctaaacagactcctggggtgggagtggagcaatgatgaaaataaaattggttgagaaatcctgctctagaggtaccatctttgcacctcccttataaatagaagattatttcaaaaaataatttcaattgctgtttctaaaagttggtctgtgaagaccttacctccccacctccccccacccccaaaaaattaatttactaaaaaataatcctctggtcacttgtacctgtaaaacagtttcaatttagtaattaataaggctgacctggagtaataataataggagaaaagaagttaaactttagccaaattaaagcttctctcctccggagctcaggcctgcctcaagctggcccctgcaatgggaaagcagtttaggttgacctcttctctcctctcctccctgccccgcgtgtctacccctccttgctgggctgccgctggctgctttgtggttttggcaggaggggctggaaggggtaaggaagcaggaggagttggatttgactgttgctctcaggaactgacagtactctcggggcttggcaggtttttttgttttgttttgttttttgagatggagtctcactctgtcgcccaggctggagtgcagtggtgtaatcttggctcactgcaacctctgcctcccaggttcaagcgattctcctcagtctcccaagtagctggaactacaagcacatgccaccatgcccggctaatttttttgtatttttagtagagatggggtttcaccgtgttagccaggctggtctcaaattcctgatctcgtgatccgcccgccttggcctccaaaagtgctgggattacaggcgtgagccaccgcacccagtccctggcaggttcttaagctgactctccctctcttgggtccagtttgggtttttcagagactcccacttgccacgagcggcctctacctgcagctgctgccgcgagtgatgccacctcaagtaggccatgcttgacctcctggttctagtggtcactcttaccagaagccactaaaaaggcacccagggttgtgcattcactctttgcaccaggattcctctatacaccaggaaatctacacttgggcatgaacagggccacattcagtcccatttgccgtcaacaccttccatcttctaatcatgtggaatcctgctgagaggagaacgagagctgggatgaactaatctcttcatggctttttggggacatgagatgtgccctccttcctggtgcatgacaggcacatttccacacaggttaagccagctgcaggtgggttttctggcacttgcagccaaatgcatcagagctctcaaagctaatactatgatgcacgggagaggtggcagggaaaggaacaaagaacaacagaagagggaaggaggtggcagccatcagaagctaacagtgaagaaaaaggtggaagaagccatcggcatggtttcagcagacccgatgtggagatcagtgacaacagagaacaaacaaagaataaaatagggccaggcacggtggctcatgcctgtaatcccagcactttgggaggccgaggtaggtggatcacttgaggtcaggcgttcaagaccagcctggccaacatggcaaaaccccatctctactaaaaatacaaaaattacccgggtgtggtggcaggtgcctataatcccagctactcaggaggctgaggtaggagaatcgcttgaacctgggacaggttgcagtgagccgagatagtgccactgcactccaaccggggtgacagagtgagactctgtatcaaaaaaataaataaataaataaaataggacccatttgtgtacttactgtctaccaggcactgttctgaacactgtatgtgcactgcatatgccccacagattgacccattttatggagtttacaggaaacaggttcatggaatcagtaagtggcagggctaggacccaaacaatatgatcaagttcagatgtagattcaggaaacacctactggtcagccagatgctgtgctgggtgcttccctcacaaggccccatttcatctaaatgccagctttggaaggtgtggactatttactgcattccacaggtagagaaactggagcacacaagagtgaagtcacttgccaagtgactggtggaactaagcccagaactcaggtcttgtgattcgcagttcaatattctctctgctgggcaaggctgcctttcctcatctgcaggaatgtgaataaaaacatcacacagggatggcgttcagtagggatgtgctgaaatgactgtactggttgtgaaagtgctgaaatgcctctgtaccacttggtaatcagccaccgctctgagcatcctcaaacgctgccctggctccttcttcccagacaccctcccggaatccagtatctaaagaattttaactgaggcctccaagatgctgttttggtgctctggcacacatccacttcagccaattggtaaatgcttggaatgtcatctctaacaaccatctattcctctggtgcttcattccttcctaagcactcttgtactgttacctcctctgatgtgcacagatgagaaagctgaggcccagagaaagtaaaaactgcccgaggttgcctggtgatgctgagttgagctaggcttaagccaaagtcatctgacttctggttaagggctgtctccattctccagcttttagtcagttaaatagaaaattttatactaggtagagttaagaattctaaaatagataaaattagaacatgtcacagatgaaggacaagtctttgtgaatgagatttgtcaattaaagacaaaatcaatgctactggcaaagattcagtaggcctgagttaaatgtaacactcttgcccattgtcatgtgacctgcctgagcatcctaggagcagatgcttctggctttggacttgaccatatgacactttccaatgagatgagaggggatgtgctgtgtgctgggtctgaggcaaagctgtttctagtgattgtgaggttcaggacagtcactcctgcacctgcctctgcaacaagagaacagcgtgtctcgggtttggctgcaccttctgccaaggtccctgaataggaaggcatacggggccttcagagcccagagatgccaccatcctcacatcatgtgagtaagaaaatacatgtttattttcataagttattaacatagtgggttgttttttctatagcacaagctgactgatgcactgggaagaaagaatgctttgaaaatttgaagaataaaaatgatttgagtttaaagtgttaaaggactctagcttctaattaaacatcattttgtgagaaagaattcaggcacataatgggcaagtacttagaagatatttcgattttccagaaatacttttacatacacatatttcagaaaggcttgtaatcaataaatcctgggccatacatattatggaactcctagggctatctgtgcagattactcagaaatagaaaataaatcacatctttcccaataaaaggagttgctcaattcacaggatgattaaataatacattttagagtaagatgagatcttaggatcactgcttctaattaaagtcatgtgtgaattttcacttaagttttcacaagcatcttttattttatttatttatttatttatttatttatttatttattttttgagactgggcctcactctgtcactaggctggagtgcagtggcatgaccttggctcactgcagcctcgatctcctggactcaagtgatcctcccacctcagcttcctaagtagctgggactacaggcatgtgccaccacaactggctaattttttctttttgtattttttgttgagatggggtttcacgatgttgcccaggctggtcttgaaatcctgggctcaagcaatcctccctcctcggtctcccaaagtgctggaattacaggcgtgacccaccgcacccagccacaagtatccttatttactatttttggtaaactgaatagccacatcacattctgttttctggtgttgaaacatgaatattttgaaacaaactccctccctccctccatccattcgtccatcatattctggatacaagacaaacatcaaaagtctctcctcttagtctttgtggaagaagacatttctgcggagcatataaatttgaatggcaatatactcccttaagagggacttcagacactatgctgttctttctagcagagctgttggcttcagaatctaaacaaaactcctgagttgccaaaaacagccttgcattcttctttcagatcacctcaaggctctaagaggatggaaggagtgttttttgtttgtttgtttgtgtttttgtttttttgtttttttgagatggagtcttactctgtcgcccaggctggagtgcagtggcgcgatctcggctcactgcaacctccacctcctgggttcaaacgattctcctgcctcagcctcccaagtagctgggactacaggtgctcaccaccatgcctggctaattttttatttttagtagagatggggtttcaccatgttggccaggctggtcttaaactcctgatcctcatgtggtccacctcccaaagtgcagggattacaggcatgagccaccgcacccagccagaaggagtggttttgatacctgagcttccaacatggagagtccatgatttcatggattcactgtatggcaaaataagctcctgacatcacacccacaaaaaggccagcatcctactctgcagacaacccaacagcccagcattctgcctagtcagttatgtgcagttacatgtggacacagttatgtgcctccacatccatttttatgtgtccactgtcagtgaagaatagatcacagaagatccactgcaaggggaaatctataaagatttgggtttcctgcagctgaaataacaataataaaagggatgagctccttggcatttaaacaaagccctcagtcagaacgtgaacaaaaggaaagaggctgccaagcaggccctgcccgtgcagtccataaaagaaaatcttgtggaccctagagtttacaaaggcaagaaacctgttcttctcattgatgactgggcccagaacttaaacactggccacatgtccatgaagaaaaaagaaagagccttctcttgagacaggtttgaattcagaggcagagacgttccctgagcatgccctctgtgccaggcaccactggccttgtccacgcttgagccagtgttttgggcagtggggtgtgtgcatatgctctgggggcagggtcaggctgactgggtccttgagataatctctttccaccagtggccgtgggacatctcggtctgtctttgggtctgtctgcttatgaaaggtggccctttgtccttatgcaggtgaagatgaggctgcagaccagcctgtgacacccattcaggtgggtgttggcttttagccccccacttcactttacctggatttcttggttttacgatatagtcttcaggggtgggggtatgaggtcatagctgttgtctgctttcagcaaagaaggtgtttccctctccatttctgactcttgttcattctggaggcttcagagaaggaagttctgaaaacaggcactctctctgccatctttctggaaaccccttcagctgcttcaaaatatttagggaacacctgctattcctccctcccttcactcttacagcagatcttcactgtgagtgtagtgggtgacaggcagggaactaagctctttctctgagctcccatgacagctctgggagggaccagggaggagaggttaagcaacctgcccagagccacagacatgagcagttacactggacttcagcccaggacttggactcctggttcaggttctcttcccctgggttactccccgagtcaacaggagggccgtgggagaaaagaggtcctggcttcagctgggcagcctagggtgctggtcgcctgccaacctgggtgcagagcctgatctggggctctcccagaggctctccttggctggcaagcaggaagctccaaatgctgggctgcagcccagagggaaaggaaaggggcttctctatgcttctgattgtccccgtgactacccaggaacaaagcggggactcacactgcctcctgccaccagcctccacccagctgttccggccacgcagccccatctcttcagcctgtctgcaggaacactgggcatttgtcagctttcagaatcacggctgtgtgcccagggctctcttgaccctccagctccaggcctcatggggcagaccaacagaggcacaggccctctttcaaacccccaaacccaccacccagtgaagccaagtccctggtccacggtatttaactattatatagcctaacaccccactggggaggttcacaccctgatctgattaagctaaaactgcatataacagttcacatgcattcgctttccgtgtgtgcagaggaaagagctttgggttaaaagtcaaggcagttcatcggttagacctcaccaagcctgtcatcatctctcaaatgggaacagtagctgccaattctaaaagcaaacatctgctgggggcttcttagtatcaggcgctttcctacatcccacgtgtgtcatgcatttaatccgcacagtagtccacccagctccttgccctctgggaagagcgcagatgttgctaatggaatcttggtaaaaggtatcatgtggccccagaatagtggtatgcatcagattaccgcgtgcttcacgcatggtgtggtggagcttgcaacgtcacactttcaacaaatctattcaatcggcgggggttcttggcagcaactatgtgccagtcactgtgcacaaccaaccaaatccctgtcctcctgggggtgttgttctggtaaacacagcaaaggctcaaagacagcagatgatgccattagttgcacgcacttcattgaccgaaaagttgattttctccttatcttcggtaatgaacgaaggaagaggggacaagcagagggggtgcttgtcatttcctggcgtttgagtggatggcatctgctctgccccagcagtacaaggtacctcctgagtggccccatttgacaaggcaagagagtagaacttgcttttctcttgtagtagtgcagaaactcagtgtcccagtgtagttcaggtggctctccaggccctggtggtagggttcctgacactcaccatgagcctgcccggcttggcatatcacagtcctctggctaccacgggtccctgataagagcacctgaaatgacattgaatacctgggagtgcagctgggactcactggtccccaggtacaggctcagccttgccccaggctcagggatccaatcttgttgctggagggcggggcaggtcagcctgacagttgatcccgttctgacatagttttaggggctgagctctcgcttcattcatttattccctctgtaaataatgtttattgggcaggactatgagccaggtactgtcctggtggctgagaaaatcccagggagtaaaacaggccaatctctgtcctcctgggagcttatgtgctagaggggaggtgaattaatatgtatcatctggcagtaagtggtaagaagaaaatacaacagggtaaggagatggagcatgatgaggggtctatgttacatcgggtggtacggaagatctctggaagaaggagatatctgggcagagataggaagggtgagagggagaaagccaggcatgtatctgagggaagagcatcacaggtggaggaaacagcatatgcatatggcctggaggcaggaacgctgagagaccagtgtggctgaagggcctactccatacctcataccttcatgccagcagctgggcccatcagttcctcctgcatctttgggcctgggcctcagcttgctgcttcctgccctccaacccaagatggtgcccacctgcctggatcacttgccttcctcccaccccctcctgctgtcccccaaccaggtgcatctctctgttctccacctctgcacgctctccttgcaccaatgagaggtgtctgcagtggagtggttaaagtgctgggctttggagtcaggctgcctgggtggatcccaactctgccattccctacttggggaagcctgggtaaactgctcttggtgactcagttttctcaactggaaatgaggatatgatagtgcctatcacaggggctattgtgagattaaatgagttacatgtgcaaagcacatatggaatagtactcagcaaatattcatgaaaaaatattaaggtgacagaagccccttctttttcttttcttttcttttgagacggagtctccctctgttgcccagcaggcgggagtgcagtggcacgatttttgctcattgcaacctccacctccagggttcaagcgattctcctacttcggcctcccgaatagctgggattacaagcataaaccattatgcctggctaatttttgtattttttagtagagatagggttttgccatattggccaggctggtctcaacctcctgacctcaaatgacctgtccaccttggcctcccaaagtgctgggattaaaggcgtgtgccaccgtacctggccagaagcccctccttaccaggaagggtgaccagaattgggtgcttgctgcatggggagaaagtggaaagggcacaggctttggggtcagacagatgccgatgtgcaccccagctgtgtgttcttgggcaactaacttagtctctctaaacctcatttccctcacttccacaaggagatcatgatctgtcccccacagggtttgaaaaagggtaaattaaatgacaatgacaaatcacggagagattggcccaggacaggcagcttcactgatgggaagaaccaaccttgctagggacgaggttgcagatcaatgatcagggaggagagaaccaaagtggagagacaaaaagactggggagcagacgctcagggtctcaaagtgggggccaaggtgggccacagccagttcatgttgtgcagaggcccaccgcagtgaggggagagctgggccagtcgtgggatttgtggggcgtgggggtggggccttggccactctgccaaggctgggggcaggggtgtcaagtgccaaagggagcaccaggtgctgaaagccagtgccaaggggtagtgaagaaaagagagtcaggacacccatggccaaatccagacaagtcagacctgagccaggtgagtgctgagccagagcagggcagggcaaggattgttctgaggctgagttggttgtgctggtttattctggggatgctccttgcctgtcttaaagtggccatggtcagggcccacctcctaaacctgcagattggagcaggccccttgacatccctgcaggaggctctggggaaaggataaggcaggaccttcctgccccacagaggtcaaaccagtgaatagacacaaatgcaggaccgaactggaggtgccagctgacccaagggaggcaaagctgcttctgtctggggctcgggagtctgaacagcccagatcagcaaccaggtcaaatctcacaaacatgcacctaggggcttctggtgagcaaggaggaaggctatgctaagccaggcatggaaggtagtgcaggcctgattcctgagacaagaacaggaatgacctccccagaggccaccaagacaagcatttgagaaagaaaagaatgctactgacttagctccactgacatttgaatgaagagcaggagtaacaaaaacagagaattttaattacaagttcttgttcccccattgttcgtgattttgttaacgtctctagatctcccagtggtaattggcaataaaatctcttaaaacaaacagggttgtgcagtaagtggagaaatttcatttggttttatagctggctgaccagaggaatgagaaggccgtgtgcatttgggtggattgagcacctctttgagcttgtcttcccttttgagtaaaatccatgcttggaccagaccatgcctgaaggggtccctatcttaccagtgtacacaaccaggtggggaaagttatcattgtgacaatgtacaatgctgtccatgttagaagcctcagagtcactcccagctcctccctcctgctcattccacactaaaccctaaatgccatttcttaatgatctccttacccagctccataattgctgctgaaatgaaataagtccatcacatccaaatggctcctgggtcctgtctattctacttcctaaagggctcttgaaatggctgcctcttttctagccaactgccatagttcagacgctctttctcactagactgaggcaacaatctccctctggccttctagctggagtctttctcacttgaagaccatcttccatatggccacagaaggagctcttctgccttctaaaggctcctgaaaaccctaccatggtttcccagggtcaatgggatagagaaaggtgttctggctcttaatgatgggccccatatccactgctcctcaatacgcctccttgactgtagccaggcctagctacttgcaggcttggaagaaaccaagattttcttgcctctgagcatttgcacatgttatttcttttgctgccatgtccttctgtcacttgtcgctcttcaagtctcagctctcctgtcacctcctgctgttctaaggtgtctctcctctgctcccaggtgatctctatgcattataaggagtcagccttccacccataccagaaacccctcaaaagcaaagaatgttctaggcactgggaaatgcccaggatggagaagagtgtgacacaatagtcaaaaggcaagaacaacccaggcgtccaacctttgatggatgaatcgttcaaccaaatgtggcatggatatatgcacactccagatagcactcaaccttgaaaaggaaggaacttctgacatgtgctacaacatgtgtgaatcttgaagatattatgttaagagaaatacgccagtcacaaaagaaggacaaatactgtataactccacttatgtgaggtacctagagtagtcaaattcatagagacagagagcagaatggtgattgccaggggctgtgggcagaagggaaagggaatcactgtttcatgggtacagggtttcagtttggagaggcaaaataagttctggagctggagggtggtgatggtcacataatgatgtgaatatgccactgtaatgtatgcttaaaaatggctaaatggggccgggcatggtggcttacacctgtaatcccagcactttcggaagccaaggcgggtggatcacgaggtcaggagttcaagacaagcctggccaacatggtgaaaccctgtctctactaaaaatacaaaaattagctgggcgtggtggtgggcacctgtaatcccagctattcgggaggctgaggcaggagaatcacttgaaccggggaggtggagattgcagtgagctgagaccaagccattgcactccagcctgggcaacagagcaagactccatctcaaaaaaaaaaaaaaaaggctaaatagtaacattttaatgcataccacaattttacaaaaagaaaagtgactacagaggagtttaagaccacaatataatgaatgaatgaaggaggagttaagcaaggaaaatcttaggagatgatgtgaccaggtcagaacggaggagcctggaggctggggtgggggccacaacacctcactccccccacactccctgtcaatgtcactccttttcagatcagcagcggggcttcagggtgccagggctgtggttttcaaacctggaaaccaaaccaggttccagggctcctgggttcctcccaaaacaaaaggaatctttggggatgcagctgactctggtgggtgtttgtcctcagggcccctgctaagttctcctgggaaccgagtacagagtcaccaatgggacagaatcacaggagaaaaggagaaacatggtaagcccttggcagaagctggcacggactagattgttgtcgggtgtgggtgttggggccaggaggagcagtgagaagccacaggaggaaggctggcagagaggattcattccgtattcattcccctagtgagccacacgcttcggaaggatcacattaaagagatgaatcacacactgactcaaagagagggggtggcacggttgtaaatcagaggaatggcttttatttgtcagaatgctacaataaataacctctccgtgtgccacttaacaaaaggagagtgggagggagggaagcaatgtggcataggccggagggctcgcagggtgatgggagggatgcgggcaacctcacagctaccagggcccttcaggacactcttgccagtcactagatactctgtgctccttcacacacacacagagacacacacactcgcatagatcatctttccctcaaactttctgagagcaccagctttattttatacatacaggagatgtcttgctggagatgacattcgtgggtattactttttcagaatgaaggggccagaaaatcacccagggcccctcgagggctgaaccccgctcagaaagggagaaaggtaaggctgctccctagaatcaatgaagttgctgttctggcaatggtctgttaggacaagtggtcatgcagcaaaatcatggaaggaaactcttccaaaaagggtgcagcagggtggcggtattatctattgtccattttcttggggtggatttagaatcagacttcttgggtcgccaggagtaaaagtaaaacgctttaaaagtaaaaagctgcctggctctgcagggagtaggtagggaagaaggatgggaattctgggtttgcagaggggcagacaggcacatgacaatcaggcaggagggaggcagctgtgcttccagggagagcagggttcctgggggaagcccagggtcccacctcccctgccctagagcagggctacaggatatggaagccactagccacttgtggctattgaaatgtggctaggccatattgtaaggtttaagcacatactttatttttaacatgtagtatgaaaaaataaagaatgtaaaatctgttattaatttttttaatattggctacatgttgaaataaccttttggatatgttgtgttaaagaaaataagctattaaaattagtttcaactgtttctctttgcttttttaaatgtggctaccagaacatttaaaatcacacgtgtggttcacatttgtggcttgcattatatttctactggacagcattgctccagaggagtcctgggacccagaacagggagagcaattgctcttgacttgctgcttttatacctaggtgagtggggagcttacacttatgcactcagggatattttgggatacaggagcaacaccccaaactgtgaggggctggggcaggcaagctggttacacaccccatgggacggaggctggagagtttccatgacttactcaagtaaattaaggagaagagcttggcctagaatcaagccttgtaaattctattgtagtcttcttacaaccacatctccgtttacatagaaaaatgctcttttgtaattattagccacaaaacaggtttctggtgagaatgtaagtttttacatttttttttctggcagataatttacaaatttttatcaaaaccatataacctaaataaaactggacctaaatgcctgtctccacatggagatacacccaaaagaaacacaaatccagttccccaaagttttgaaaaatactgttaattgttgactgagatcccccaagagggcagcaaagggaaactgtcctgcacaagtcacggaaaatcttctaaaaggtctttagacatagttctctcttttacagaagctgctcaaatcactctctttcccctcctcaaacctgccctgacttccttctttagttccctctctcctctctggccaagctcttctgagcccctcttctctctgggatctgttctcttttctcttatttccatacctccaaggcccttctgtatgagaaaagttgttttcagttttcctctctgcccatcatctgatcagtcccaagaaatcctaaaaccaactgagtaggcagagaatggggagggttgcatcggaattttacatacttcgagcaaataaatccacttacagggatttaggatggatcaaaggagcaacagaccaaaaatttacatacaaagatacttatcatagtattatttaacataacgaaaaaactagaaatgacctcaacatttgacaaggaatagtggttaaataaattctgacaactctataaaatggaatattgagaagtcactaaaatgtctggctttgaaaatatttattggtgtgagaaattatccatgataatattaaatgagacgaaaccaagaatataaagctgtatacaaattttgatgctaatttcctctcaatttatatatgaacatagaaaaattcttctctgggctgggtgcactagctcacgcctgtaatcccagcactttgggagaccaaggtgggtggatcacctgaggtcaggagttcaagaccagcctggccaacacggtgaaatcccatctctactaaaaatacaaaattagctgggcatggtggcaggtgcctgtaatcccagttactcaggaggctgaggaagaagaatcgcttcaacccgggaggcagggaggttgcagcgagccaagaccgtgccattgcactccagcctgggcaacaagagtgaaactctgtctcaaaaaaaaaattaggttactaaaccccacctcataagggtgttgggagatgtagtgagggaaaaaaagacagcatgcgagaggtggcactgcatgcagagtcacagccggctgcctgggcatggatcctggctcagcttacactgtggtcctaggcaggtcacctggccccacattgcctcaatgttctcatctaaaaaatgggaacattaatgatacttgcatccaccctaatacaggcttgttgacgatgacaggagtcaacagaggtgaagcatgtgaaaaatgcctggcacacaccaggcactcagtagagatgagtttcttgtcttgtgatctttctagagggcctttcttaccctatcctctgctcagggcctgccccacttctcagcctagccctgaggctgctcatctcttcctcatcacttctgattttacagtccattactggttggctgccattactctagactaagagtctgcaaactacagcccacaagccaaatctgagatgctgcctgtttctgtaaataaagttttatggcaacgcagatacacccattcatttatgtactgtccctggctgcttcagccctacagcggctgcattaagtagttgtgagactgtatagccagcaaagcctgaaatatttactactacctggtctcttaccaggaaagcttgccgacccctgttctaggccaacactgtccaaaaaatgtataatataagctacacatgtaattttctttctttttttttttttttgagatggggtctcactctgttgcacaagctggagtacagtggcaggatctcggttcactgcaacctcctcctcccaggtccaagcgattcttgtgcctcagactccccggtagctaggattacaggtgcgcaccaccacgtccagctaatttttgtatttttagtagacacggagtttcaccatattggccaggatggtctcaaactcctgacctcaagtgatccgcccacctcagccttccaaagtgctgggatgacaggggtgagctaccacacccggcctacatatgtaatttcctagtagcaacattaaaaaaggaaaaagatacaggtgaaaataatttttatatttcctttaactcaatattccaaaatgctatcattttattgagtaataaccataaaaaactatgaatgaggtaccaaaataatgcccgtgtctgatgcatgcactacgccgcaacagtatctgacaggatgcaaaggtgaaagtgaactgcagtacttcccaaacagtgcaactgtctgtaatggaaacatattcctcactgctttagcttttaaatgtaaatgtaaatgaaaactaaaagttcagttcctcagttgtaccagttacatttccagtgactaccatactggacaatgccgatctgggcataccccctccctacgtatacttacgccccttccatgcacacagcagatgagttttcacatggcttcattgacatgcaaagtgattttctcttttccttttctttctttcttttttttttttttttttaatgggattttgctctgttgcccaggctggagtgcagtggcatgatcatagctcactgcagcctcaaactcctgagctccagcgatcctcccaaatcgctgggactacaggtgtgcagcaccatgcccagctaattaaaaaaatttttttttttttttgtagagaaaaaatagagaaaactatgttgcctaggctggtctcagacttctgggctcaagcgatcctcttgcctcaacctactaagatgctacaattacaggcgtaagcctctgcccccagcctacaaggtaattttcaagggggagggaattttaggtgaggaatgggggcagagatagtgaaagaaatatgtggggaggggggtgtggatgtccccaggttcccctggtgggttctgagcccctggggagagagaagtcagagacagaagccaagggaactcctcaaagggatttaatgtgactttgggctcaagcaaagctgctctggggctcaggtgacccggtgccaccctctgtctacccagcctcccacctctgtccagagtcagaactgccctgggcctgaggactggaggcttcagactatccagacaacccaccgcaaggagtggccaccccccgacagtgaggacaggagcgcagcgtctcccagcagcttccagggcagcaatgtgcctcagtgtgaggcagtgcaggaacgcaggaggggagcagacacccatggtccctgcggctaatggtcctgtttgtgggcatctgtaagaccgcttagaggactcctcagaatcactaggagccagtctgggctgcatccagatgagcataggctcagagaggcgaagtggccacccaagaccactcagccaatgacccctagtagaaggtcagcagccaggagccccagggaaggaaggagagagaggcctgagcaggagagagagctcaggctattctccctcccagccgggatcaaagcaccctggagtctgctctctgatgcactctgggacccgggcaagcccatttgctacagagcagcacaggttaggcacaggcatcctgctagcagtcctgggacatggtccaggtaatcagtgccctggcctgtggatttctccatattgtatctcatccaggagagcaaaatttgaagaaagctgggaatggtaaatccttctgctaggaatgaatgcttaatggaataaggaaaactccaaataagtgcccaggaacatccccgtggaaaggaggggtcatgtcagccagctccaagaccttctcaactcattcctccttctcaacttgcttggtagctgagcccagctttcttccctctgaggccaaatcctacatcctctgccacccctgtatcctttctatctgtggttcttcccagctccatggaacgtgagagcgaaagcctgcagccatctcgccccctggctcctcgtccctctaggtacccagtgagtcaggacaaccctgtgctctcctcacctgctcctcacagcagctgcaggcaccctccttggacaccgctgtcttccctggaccaaggtcatggctggtctgttcatctcacagctcatatgaccacacctgcagcagcggaggtaggtgtagaattgtggcacctcagatggagccaaagtggggagcacttacctaaaacaagactgttttaggtggatgtagccatatgattgtgggcatgttatgtaaccacttcatgcttcagtttcctcatctgtaaaatggggataataaagcatctgcctcacaaagtgactgaggaggggaaatgagttcatatgcgtacaaggcatgagttcaacgtttgtgagctaccattgtcatgaaaaccaattttagcattttatttgcagctgtgagtttattttacacttgatcttagccagaatgctaagaagtgatggttatgagtttattttaatatgacctacagaaaatttaaaatgacctacggaaaattacaatcaagctcataatttggcagaccttattgtttaggtcaaagctaagtaaacaaatcaatgtaaacatatttaaagaacataaataaatactagtgtaggtgataggctagtgtgtcatgaattgccaagatggggcacacagactatttgggagctattgatctagtctgagccctctagttctataaggaggaaactctaaacaggaagtagtgagctgagaccttggtcaacaatgtagtcaccggctgggttgggaccagacagttgccccatgccctgtcctccctgtcctgtcattctgccccctcaacagactcatcaaggtcacatttaaataagtacacacaaaagcagcttatgcatagacagcttgtcatcagacaggatcacacgtaacacccaggtcaaatcctctgccatgtcaaacaagataatcccatggagtaaaagcaactcctttacaaaacagggtcaggtgctactttctgactccagggtcagagaggctggtggaactggcttctctggctctgccacttcttaactgcgtgctatgatttggatgttcattcccccaaatctcatgctgaaattggatcccagtggtggaggtaaggcctagtgggaggtgtttggatcatggggtggatccctcatgaatggcttggtaacctatccctcaagagctggttgtcaaaaggagcttggcacctcccctctctctcttgctccctctcacaccatgggatctctgaacatgccagctcctctttgccctctaccatgagtggaagcagcctgaagccctcaccagtagccagtgctagtaccatgtttcttgtatagcctgcagaaccatgagccaaataaaccgcttttctgtataaattacccagcctcgcatattactttatagcaatacaaacagattaacacaccatgtaaccttggaaatgttgcttaatctctctgtgcttctgttttcagatgtacaaactgagataagaggtggtaaatctagtgcacagaatgtgaggattaaatgtgagtttcctttcttcttcctctaagagcaagagcaagtacctcccgccaaagatatgggagaatccttacgtaggaagctctttatctatctgtgagttcacccatcactctctgactacaaaaccttcagccactccctgtttcttaccactgcaaatctgcaggcctcaacaatgtggccccttcccatcaagccaactttatctccttggtccctaacacttgtcctagcatatcccatgctccctcatggccccatggacaagatgcatccatactgactcccaacccctgtaccattttcttccccacattggtgtatagactgatcttgcaaaaacccacatctaattaaccttcctcctgaaagcctctgcacaattcaccctttcctgtggaataaagtccaaactccctaccactgcagtcacagtctctcatcatctaaccccattccctctcctgtagtcatccttagttatccataattctctccccacagcacaggcacacatgtgtacacacacacacacacacacacacacacacacacacacacacacgagtctacactcaagccagtcaggtccgctcactgttccttcaatagcttgggctcctttgcacctgcatatttgtgcactagctgctttttatccctggaacactgcattcctttctttgctgggtaaatgccttctaaccccttagcactttgctgaaacagagcattttgttttgcaaactcccacctccactcatcccttgcagcttaggtgactaagtcctggccaataagatgtaagtgaaaatcactgggtggaactaccaagaaggctcattgaaaggagcacagatggctgcatggcctttccacctttttctagtttttttatatataatggatgtgatggctggtgctccagcagccatcttagacacaaggtcaccttcagaatgaaaatcatgctctatggatggagaggccaaagagagaagttgcctgggaatgctgatattgtggtgctaccatataccaaggctagactggctccctttggttcttttatgagagaggaagataaactcttatgtgtttaagccactgttattttagtttgttgttatatgcagaaaatcgaatcctagccaatataacagacatacaagtcatttcctgatttggctcctacacacctctctagccacacatttcccctccccacccccaaaccccatactccacacctactaatctaatttcagtttcctcaatgcatcatgcttttctcaggcatcacacccttccccctctcctccatatccctcctcagaccacctgggaacacctgctcagccttccagacccagctcaaggaacacctcctccgtgaagcctttccagatgcactctctatacttctcccaggcagaagtgaccattcctcccactccgtatgcccccaaatatctaccatgaaccctctaacatgtcatcatttagtcatccacctgtacctccgaggtcctgagttgcttgaggcaagagctatttcaatcatctttgtctccagcatgtagcccaggacctgggaacactgagcacaagtaaagttgttcagggaaagttcccctgaggcaaggtttcatctgggattctggcccaaggggcagggctatgtccttgggagaggatgggggctcctgcagggcaaaagggcttgctcttgagcatattctgccctaggaggcaccaggaaatgtctgttgggtgggtaaatgaatgtgcaactcaacctcccttcaagcttctctctctaggatgctgacttcctccagccgtggtggtgctgcctgtcaccatctgaccctctctgcttcccttcccctgccatacttagcaggcactcacagctggaggcaggaggctctcaaagtgaagggaaaaactcttagctgccaccatcctgaaacctgccctccccacagccacaaaaggccaaggagcatggaaacagctgctgcaaggagaccagtgagcaggaaggtggggcagcctcacaggagctgccctgactggggccttccctctagcagtgaccttgacttagagaaaggacaccttccatggccactcaaacatacacatgacagtttccctccaccttcattgcatacactgaagacaactggacagaaaataaagaaagtaaggagaacttccagaaccatagccagaaatgcagagtaacttaaagtagctctgttttaatatattgcttgcttcccccaaggccctgcagggatggaagctgtatccttcaagggcaatgggatgaatagtggggagaggagaatgttcaggggatcctggattctgctctttccaatgtgaatggccaccatatggaagaacgattgggccactctcccagaaagctaatgatcagtgtagcatcagcccacacaggagtggcctgtcatgggaggctcatacactgtgtgccatgaagcagtggacatactcagaatcacatgccaccacaaagacttcgggttctgggaacttgggacctcctgccttctggggcttcttggaacatccatgcagtctggccccaagaatgccaattgctcctgatacctgagccaactttctgggctccccctgtctcatcagggatgctctctatctgcagagcactacaagtggctcaagcctggttctctgactgcttcaaaggtccttctcttaatctggtttacctcactcttctgcctgcttcttggagctcagcttcctatgactggtgccacaaaagttcctagggtcacacacagaggggcagagaagctgatccactggagaggctattagaacaggtgggaggaggctgcactgtgaaccagggtctggggccatgcctttcccaccacatcataagcattaattcattaattcattcacaaaatatatatttaatgtctactacatgctaggcataattctgggaataaagcaatagaaaaaaaacatgtgatgaaatatattcagggaaatatattttggtttaccaaagtagaaagatttctgtcctgcaggaaggactcagaatttttactatgtcagccacaggtactgtgacttgcccagaagggtcttagcatataggccctttgaggaagaaacatcagtgtagaaaatttgaaaaacgtagaaatgcacaaagaagaaaataaaaattactggtaatccaaccactcagaaaatactcttataaacattttttgtgtttgtcactgaaatatttttatatacacatctataactgcatagatgtacccaccataacttacaaaaccaattcccacattcttgtgtatttagattgtctccagtctcttaatattgcaaacaatacagtgaagagcatccttgtaagtaatcctgtattagtcagttctcatgctgctaataaagacatacccgagactgggtaatttataaaggaaagagttttaatggacttagttccacatggctggggatgcctcacaatcatggtggaagacgtaggaagagcaatgggacggcttacatggtagcaggcaagagagtttgtgcaggggaactcccatctataaaaccaccagatttcgagagacttattcactatcacaatgacagtaggggggaaaatgcccccatgattcaattatctccacctggccccacccttgacacgtgggaattattaaaattcaaggtgagtttgagtgggaacacagagccaaaccatagtagatccttatccatatcagtgattattttactagtataaatccttgaaaggggaacttataggtaaaaatgtagaactatttgcttttatactgccaaaatgccctttggatatttgaagcaatttatgctcttaacagtggttgtttaccatgcctgggtcctcacaccctaacaaacaaacaaacaaacaaaaaacaaaaaaaccctaagtatttggtttttatttttaaaaactgccattttgataggtaaaaatggttatctcattattgtaacttgcctttcttattactaggcaaactaaacttttcccatgtttattaggctttttgaatttctttctctattttatatttattttgtccattgctggggaagaatttttttaacttttaattttgcaataatcttagaattacaggaaaattgcaaagatagtgcagagtttccatatacccttcaaacaatttcatctaatgttaacattctccataaccatggcacagttctcaaaactagaaatttatttatttatttagagacagggtcttgctctgttgcccaggctggaatgtagtggcacaatcatagcttactataacctcaaatggacctaagactatatagtcatgtgctaccacgcccaggtaaactaagaaattaacactggtacaatacaatgaactaaactctagactttatttggatttcaccaatgttttcttgactgtcctttttgtcttccagtatctaatccaggatctgacattgcatttagatgtcacatctccttaactgtcctctggtcagtgatggattttagcctttccttttcatgatcatgatatttttgaagagtcctggtacagtattttgtatgatgtccctcaatttggatttgtcttatgttttctcgtgattaaacaggggctgtgggtttttggaggaatgtcacagaagtgaaatgcccttttctccatttctgaggtcacgtgataccaacaaggtgcattactggtgatgttaaccttgaccacttggttaaggtgatgtccgccaggtttattaactgtgaagttactattttttccttgccatactctattatttggaagtgagtcactaagtctagcccacactccagcggagggaatttaagctccatctgctggaaggggagtagtatatatctagaattctcctgtaaacaagatttgcactttcttcccttatttatttatttattcaattatttatttacaacaaatgtggtcagattctttgggttatagttcaatactatcattatttatttcggtgctcaaattgttctagttttggctgttgagagctctttctggttggctcctgggtccttcagacatcctaccatctttttttgtcttgctttgttttttgtttttaaacacttccttactttctggaactacaaaatgttttaggctcatttttttgtgtgtttgctttttgtttttccctgcccaggcctggaatcagtcatttctccaaggagttctggttctttttactagagaatggtctttagagactaagatctgggcagtgagtgtgcccatttctactagggtattattggttctaggctctttcagcggacagaactggaaaatatatgtgtgtatactaatccatgcatatctctacttctgtatacttctatctgtacgtatattaaaaatacatgatatttttgactctaatccagcactatagagttcattcgagcctttctagggcaaaaatgttaaacctctaaagcacctctgaatactgtctggaatctccatttcccacccaattctgagcaaaaattaaatcaagtagagcattgattggctatgactgatcccacggccatctgccgggaccacacgacagccccaggatggctccagctctgttcctctgggcctggagaaagcaacagaggacagagaactatatgaggacaaagaataaggcagccttgcccagagttcaaatcccagccctgccactaactacctcctggtcgattctttttccgtaaaatgaggggttaaattagatgctgcatagatctggtattctgtgattacagaaggcactcgattcatgttggctgagtgaatgagtgggtaaggagaggagtttggcacatgccagggcccctctctagttcaaatccacggtccatcattatcttgagcaggtaatttaccttgccaggcatcagcattttttattttattcttggtacttctctgtattttctagattttctacaataaacatgttattttatacttactaaaagaaaacaattagattttttaaaaaaacacaatagcatataccatccttctccctagaattattatcagtaagtacttcacaggctggcactgaggagcactgtgctcgtgtggatgaacttgaacccatgcaagcttcaagttcctgccataaagtaggtgttcaacaggcactagtttctgtcctttcttttctctctcctgctgatccagaagctacattgtgaaactggtggaaaaagtcttcctctcccttttttccctagtgtgagtgtgatggccatggcaaaaaaagtccctgtcaaatgagcccctttctttctcactcagagttctccctccctggcatcctccgtgaagggcctcctcaaggtgtctttgcagaaatgtggagtgtccaccatcaaggaagatggagggtccattcccaggtcccacacctggctgaacacgtctcccagtccagcatgaagctaaggagcttatgctccaggaagctcctgctcattttcaaccagggcccagctatggttgctcccctgagccctcattatctgtgctgaagaccttaggttgcagggtttgaagcctcacagagagcagagcacagtatgtgagcttcaggctacaagcctccaccccagcagtcctggcttaaattctgtttctctgcctaagatgaattcctccaggaaactattcccttccctccttctgagaggagggaggaaagacggcttttaaattacatgcttcttcttatttaaaaaaaaatgatggagaatttctggtaggaggaggggaaatattttgtacttctagaaccaagaaggcacagacgttccaccacgacagcaaaagtcccaagtccggaaaagctagcatattcagcaaaagcaaagggaactgagggcttctcatgaaaacaaatctagaaatacttgaatttgttttaaaaaattaggtcaggcacggtggctcatgcctgtaattccagcactttgggaggccaaggcaggcggatcataaggtcaggagatcaagaccatcctggccaacatggtgaaaccccgtctctactaaaatataaaaaattagccaggcatggtgcctgtagtcccagctactctggaggctaaggcaggggaatcacttgaactcaggtggcagaggttgcagtgagccgagatcgcaccatggtactctagcctggcaacagagcaagactccatctaaaaaaaaacaaaaacgaaaacaaaaacaaaaaaccatcattctcagcaaactattacaggacaaaaaaccaaacactgcatgttctcactcataggtgggaattgaacaatgagaacacttggacacaggaaggggaacatcacataccggggcctgtcgtggggtgcggggagtggggagggatagcattaggagatatacctaatgtaaatgacgagttaatgggtgcagcacaccaacatggcacatgtatacatatgtaacaaacctgcacattgtgcacatgtaccctagaacttaaagtataattaaaaaaaaaaaaagagagaaacactcttttccaatagggattccaaaatccaaatcgtggtcccttgtcagcaccattgagttcctaaccatacctggagggaatattacaagtccctttgcactgatgccaagcctcaaatttgtctgctttctgtattcatactgaagtgaacataaagccataggctgatgccacaccaggctgtgctgtcagtgaaacccctgaagaagtataccaacaaagatacaacagaataataaaatcaagcttggtcttttctccaaaaataattttaaaacctctgggtagctggttctcttctgctgccttttttttctccccaattaaaaaatgtatttttgcacctacactcttaatgttttatttttattgtctttgctttgttaaataatctattgtgtgtttgcatttgttaaatcactttggtccattcaataaatgtttattgaagaaaaaaaatcagcattttgtcatagagctcactttccacatgagctaccttcctttctagtggatttacaacccagacccctgcttctgatggggctccttcaaaattattaaagtgcttgactcttgtaatatcatgtagggttgggttatgtctgccccaatgttgacatgaagaaattcctccctttctaaccccacggacagacagcacttagcatctctcacctggagcatcacttcagcctcttgacttgtctcctccctccttttctttactgcagaacttctcagaacctttaatatcctgatgatcttccaagagggaaatacaacacaaaataatatatgtatttcctcaacttatttagtcatgaaatcttttattcaaagaacatctgttaatgcctctcaggccactaggttctaggaactcagtttgggaaaccccaccctctaaaatataatcctaactcctcagtaggcatgtgagcccttccattgtctgctgtctgcctccctccccaggatcatttttcacctctctcttatacctctgacattcgccctagaactgtttgtggttccttaaacatgctgtcttatttcaaacttcagtgcctttgcatatgctattccaccagcctagaatgctgttccctgctgtcctctgagttcaacactgccaactctttgaaatgtccccagctccctcaggctgacaaagtcacaccagccccaatgttcctgcagtgctagctttatgcttatcagcacttccccagactataaatgtgtttctcgcctgtaaatcgtcttgcttcttgctctctcctggcctaattcttcagctcctatcaatcccattagattcccatctccctttaatacatttcctctttttttaaaaaaagttaccaagaatgagtttcttagttgcatgagatcaaaaaaatcctaaattctacactcagaaagaagagttttaaaacacttttagtccaaaaaatgcatgttaaaaatggcacccccccttccccccaaccccaagcatacaggtctcttttcatagggggaatcatgttcacagggccccagggaaaaatgcagcaggatctgcctggtgcctgagaagctgcacactatgctgactcagatccagagagacagcattactcaggccaatcagaaaggtggtacccacatccctaggagcagccttacccaactctactctgcaaatggcctcttcctgggctttggggcaggcagggacaagagcatcaattcctgaacttcctgaccatgccacgttcagaatgcttccttagaagccatttcacgaaggtttccaaaaggaggatttttatctttcaaagtaaatgaaagaggatatagtaaactattgctaaactgtcccaggccctttgcaatctgactttgcccctcctttcatcaggggtggagtctatttctccctcccctgaatctggctgggcttgatttttcctttggtccaaaggatgtggcagaagggatactgcaccagttctggcctctgccttaagaggcatggcaggcttgcttccgcattcctggagtcctgagcctgccatgccatggaggagctgggtctggcccactggaggacaagaggtcatgcagagaaccaggctgctccagccaagagctggcaccaggcccctcgatgtgagggaggctctcttggacctcccagctcagccccaccaccagctgaatgcagctgcaggagtgagcccagccaagaccagcagagaaccacccagccagaattgtgagaaataataaatcatgattttaagctacagagtttgagtgtagtctgttaagccagcaatagataatgaaacagaagggaaggctcagaagccagcagggaactcaaatgtgtccagtgatagaggatgtgggaagtccccttgctatagaaaatgcaagagcaaggcaggtgcccctttcactatatatgcaaagtaccaagggtatcagaaatgcaagtgatcagatgcctcccacatagagatgggctaggatatgcccttcctgcttctcccataatgttccagacagggcctattaccctgagacaaaggaaggaattcgttacctgcctacctaaactccctccctccctttcgtctacattatctggccctgaaccatgactgtgcagagaacaaactacaattaatgctatcttttacccacaaggagctacaattactaagtggagttaaataaagtcacaaaggacttaaaagcaggtacgatgaagggaggtcagaagacaggcagtgtaaccgtgggcttattagggcccagaaaagaagaagatgcaaggctttttgctgaaggaccctctgtgctgagcctggaaggaagagaggtccctgcaggaagagattaagtgaagatattattaaggttgagggagtagcaaagggatagcataagagcaacatccccctcccttgccccaggtaattcctcccttcaatctggtctcccttcttccctttccaaggttcctcaaggccatgccacctaggctgatgggttttcttatctctctactccctcctgcacccagccctaggttgagttaattgggaatactaatcatttgagaagagctactaagacctgagaatgccccccaggtagtagttccagccttggtaattttaagactcttacaagaaattactgatacttttagcatctgttgattgagaaaatacacatgtgaaaatagatatcagttctccttataataatgcccctagggaatcagctgggcatggcagcatgcgcctgtagtcccagctactcgggaggctgaggcaggagaatgtgtgaacccgggaggcggagcttgcagtgagccgagatctcgccactgcactccggcctggggcacagagtgagactccatctgaaaaaaataaaataagataaaaaaaaaatgcccctaggggtccaggagcaggttgaatccaccaaaaaccactgatgagaggaaataatcagccaatgaaacagacccatgcttttagaagggccttcgttgctttgaccccaaaagacaatgagggaattgcaggatctgaagctggtatgtcaaggagtggggggcaggggagaggcatacccttggcccacaggtcctactgggacaccactatccagctgctctgggagagaagcaaggtgtccaaatgtaaatgccatggcggctgggcctggcttgcctagccacaagttcaaactctgctcaatgctggactggtatcatgtccctgccagtttagaaagcatctaaggcagtttggaaaagcagtagactagaaaccactagttaagtaactttcagactcagctactacctagctttgggagtttttccaagctttttgtttttgtttttggagacagagtcttgctctgttgctcaggctggtgtgcagtggcgccatctcagctcactgcagtctcaacttcctgggctcaagagatcctcccgactcagcctcccgagtagttggggccacaggcatgtgtcaccacacctggctaactttttatttttcatagagatgggggtctcctgatattgcccaggctagtctcaaactcctgggctcaagcagtcctcctacctcagcctcctaaaatgctgggattactggcatgaaccattgcacctggccccaagcttttttctttttttggctttcatcttcaataaaaaggtgatggagggtgggaataggagaggaatgctgaacttgctctccaaggcattgccaaagtgccaacatcctgagcaaatgattctagtcgacttactgtttctgagcctcaggcttcttacctgtaaaatgggaatgacatgtaacaattaaatgagatacaagttgtgaaaatgacagtcacatagcaagtatcaattaacatgggtttttctctcttcctcccttctgtccttacaatgacagatggttctttcttcccagtcccatccccctgctcttactgagttgctaatttgacctctgagtataaaatgtgtccacttttagtgacatgaagctagtcctcccagagagaggcattgccaaagtgagtatgatgacttcaaacacgctcagaaaccctaggaagcagctggcagggtgcccccactccctgcccctggcaatgctgggttcctctttggcatttgtacagaagggaactggcccaaggcagaaggatgggcctaggctggtgaggccacctccctccaggcctggccaaagccaaggcaggcacagacagcaacaaccacccattttgcaacaaacaggaaaccagtttaccagcctcaaaaatagaacagacaaaaaccccaaaatatgaggctctgacagtggggcagctcagctttctcacatggcttcctgacaggctgcggagtatgtgttgttattgttgctttaaatttcacaggcgaaaaagtcttgcaatgtctttataaaggtgaccagcctctggggcccaagaccagcaggcagcccagccaatcatgcttcctgcactgccaaggccccaccttctcagtctctgatccagctactaatgaccccaactgcaagggccacagaagccttgattcctgtcatgtcctaacaggattggccctgacatgtctgcaaagtgagtcttccacaccccagcattgcttttcctgtggcccctcacctggtgccatgccactcaccccaaaactgcttccataggtacccagaggccccactgggccacatggtccaagagccacactgacaataggcctgcagacattccctccacgtgaagctggactcatgctgtcccctctgccaagaacagtgttccttgcctggtacactctcctcagaagcaatcatactggaatgacatggttagaacagcaatgttgctaaggactatgtcacacaaactccccttgttgagggatcacggggaaaatgtatcttaggtcttagccccagggaaagctgtgcacatcctgggcactgggtgcatttttaatcctctggacatgatgactaagaaccgcctatcgattatgttccctttttgtcttcattgttaggaagcacagtgccaaacctgttcatcacctctagcaggtttatgtcctaacctgtccatggctttattttagtttctcctcttattttcccttgcatattatttctttattaaatttattttaccttaatgtagaatgtatatgatctcaaatctttatttggaataaagtgaggtatacataaataactgagcaaacagctcctacttactctgtaaaacccacttcgaatgtccccacctccgatttctgcctaacgactccacaaaggtgggcttccctccccagtggtcccacagcccctgcctgtacctgcctggattcacactcacccacagttctgtattttactgttttcatggctctccccaccaaccgacagaaggttcctgtgtgaaagctaaaagcccgccctctgccaaaatctgcccagtgctgcaggcacacgggcttgtttaatcctcaagacaaacctgccagataaggctggctgtgcccattttacagctgaagcaactggagctagccaccaccaggtgctcattcaaggtcatgtactattgagtggcagaactgatacagaaggcttatctccctaaggtcacccaagacatgaaaaagagtttttatgtgaaagagagaaaaggagagagagggaagggatttagatttccttagattatcaaatcattcactgcagatgtcaaagtcatctgcatcactggaaccatttaaaatatggcttgattcataacaatttatcctctacgactatctagaaaaatctacatgtatttaattgtggcagactcatgctgaccctccaataggctggtcagagcaagtggattagaggagttactcacatgctagattgttttagagcatctcctatcctcactccctcacccactgtgtatacacacatttttaaatcctggtaagtagttacaggaaaaaaaatatatactcagaagacaagagctaattctgcaagaagcttctaggagaaaacaaagcctactttcccggtaggcaagtgcacatgacccatgaggccaatcattaccctggctttacagtgtacagacaattaaactacatgaaatggccgggcgcggtggctcacacctgtaatctcagcactttgggaggctgaggcgggcacatcgcctgaggtcagaagttcgagaccagcctggccaacatggggaaaccccatctctactgaaaatacaaaaattagccaagcttggtggtgcgtgcctataatcccagctactcgggagactgaggcaggagaattgcttgaacccaggaggcggaagttgccaggagccgagattatgccactgcattctagcctaggcaacagagtaagactccctctcaagacaaatttaaaaataaaaaatcaactacatgaaacaatttttaatattccaattgagaacccacttggcctgaggcctttaaatcaaagtggccactggtatctacacgtgcccttccatggaatgaggaaggcaggacaacagaggctgctagggtctgggttcaaatggccttgggcaagctgggggctctccctctgcccctcgtttacatgcgtgtgcgtgggagatgataatgacaccacctcttagggttgcagtgaggacgaagctggcacagggataatgttgaataaatcactgcatcccaggcaagaggatacgtgaccaagagctggagtcctctttgtagaccttgtgttcttccattttaaaatgagaacaagagccagagagaagggaataaggcataagctatgaatggacgggaaggagaaagatttctgacccacctcttcacaaaagcagcccttccatcctgatggagagcacctcttttgggggtctgatttgtgtctctcaggccaccttacgccttgtgttctgtgtgtgtgtgtacacgtgcacgcacacacatctcctctgtaaagctcatgcacccaggtcctgagcctgattccccccactccctcccgtgtctggtacgtggttgagatcagtaagcacaggttgagtaaatcacaatggtagaagcagtaccagctgaggcacagaagggatcttcaaatgtcagttctctttgtcctccttgccagatgaggcccccagagcctgccctctgccttccttcctgaatgttccagggactcccctctgctctccagacaaacaccctcactctgccaccaaggcccctctcagcctgcaccagcagccaccccccagggctgcccccttatcatcccctctcttcctgttgacagccttggatgacataaccttaggagacccagccacggatcaacctgactacacagcgtgggcatggtaggggaataggtgattcaaagatttcctgggtgtggtcccctgccctctcccttcaccccctctgaagcatgtcacagtggttgacagattgaaggcccagccccggcatggagcccctgctatgccacttacactcttctggaccttgggaagacaacttcacctccataagcctccatttcttatgtgtgaatgggggtaagaagagcatggatgcatttcacctgcctctgaaggttgtcactagaatgagaagcactgatctccacccggcacatggcgagggccagcgcaggtggctccgtcccagcaccatgatgagtaaaagctgagcaggaagggggaaactgtgcttcccctctgtggcactccagtgggcaaggaggccttggaaggcgcagggccggggccagcgggaccactcaggctcacctgggactccagagggaaggggcatctcaggacgactccacagggtagggggctcctagctcaacatcttccctgctttacccaagagaggtcaagacgacaggactgagagtatgatgtgctcgccaccccttgccctcaccccacgccccacccacacagcccctacaccttcaggaggatgggatgagtcatcattaggtcactgggtcatcgagtaagcagtgggggccacagggtgcagtttcctcccttcctccccgcccagcccacctacggctctcctcctactctctgcccccgctactttcctgtgctctgatgtgggagggatatcgctcattgacaggtttcaaaactaaaagtagagcgcatttagtcttctcctgtggctgagctcagctcccagctcccagaactttgccatgctgctgcagggccggcatgccccctcctcaccctcacggggagggcccccatggtgttagccagggctcaagaatgaagctaggacaggaggggcagaagacgatgaagggaagtgcaaacatatgaccctgtcatctgttaggccttgaggtagatcctgggaccccagacgacagaagagtggaagggaaatcagaaaccagcatacttcacctgtctggagtgccagaccctgccaggtacagagagagagacagagggagtgagggaaggagggacctgtatggagactgaattacagggcagacacaggatccctacagaatcctgccaggcagttgttccaatgtgtagcgataagcagtgacagggcagaaatgggaggcgattttcccagcctgtcacctccagcaaggtgtgagccagaatgcacacgcaggcctgcgtgtctctggggctgatgacagagtcacaaggaaacagatctccatagcacagcgtggaaagggccaatgctgttgggtgaaagatgctctgggaggtcaagagaagggccaattaaccccatctggggaagcatttcatgacggttgtgatgcttgccctggatctgaacagcacatgcatgggaataggtcaggaagtcaaggggacaaagatcagggcaaaggcaccaaggtgtgtagtcatgatggggggcagggggaaggcatcaggaggctccagccaaggaggaggctgtgaaggaggcactcagcagcccatgctgactttccttataacttggaccccagaagtcactgctatttccagaaaattagagtcacaaatctgataatattatcaaccactaacagggcatccactatgggctagacattgtcctaagcacttcataaacactacccccatttaatcttcacaacaaccctataaagtaagattactacccccatttggtagagatcaagaactaggcccaaagaggttgactcacttgcccaaggcacacacctctacaaggggtggggctggacttgaacctgaggctccagagggcatgctctcctgaccactcagctgggttgccccaaagaccacaaaatgcctttcctgctccccagaaggtccagttcatcctctccactaggctgcaggcatctccagagcagggctgtgtcctctcctccttctattgagttcccctacctgagcctggcctttgtaaagaaatttgacaggcacatcatgacaggcagaatccaggggaagaaagcacttgtcacagtccagtttgggctgggaaccaacaatttgttgacttaatcaggcagatgcaaaaaggtgttgtcatggtggcaagctttctattccaggcggccaggccataattaaatgtcctgacctgcacacctccaattacagcacaagagctggtttcccaggcctgttaactagcaattatagaaccttccagtgaaattccaaatcacttagtaaaggtcaacttcctttatttatttttcagatttgggggtagaagtgaaatggaattattgcccaaattatgtgtgacatccattacttaaaataggtttattcaaacggcccatatggagcaagggatggagcctgcagttcttacaagttgttataagggatctcatttatggagcacctgctatgtggcaggcaaaaccacagtggctttaaatgtgttctatgatttaattcttataataaacttaagaggtaggaattactatttccattttgaaaaggagtaaactgaagatcagaaaagttaagtaaccttcccagggtcatacagctgatgcttcagaattcaggatttacagccaggtctgtctgcctctggacaccaggctcttcccattactaggtggtctcaagctaagtaacacaatttggggttcagagcacagctcctatgtgttgtgcaaggagtgctgagacctaaaatattcccttctcctggcctatccatgaaggcacagttgaggcacaggtctcttccagcctctgggatggttaccatgttagggttaataacccttcattgttgacggctcagacagctttttatattgataagagagacttggaacagtgtgaggacagtaggccttcagaacagaaacaggtggtaccaaagacacggtcttcatgccatcacttgccacgtgatgcccatggcaggtgccactaatcaacagtgaccccaggctccttctcaatacaggtgattcttccaatgcattgaactggcccaggagatgcaaattgttttctctctctgtcttagatatatggtgaccatattttctgcatgcaaaattctgacatgtaattcaactgaagattatttccctgatttatgaatttatttatgctttacaaaagctaaagtcaaatcacattcccccatatatttaacaaatcacttttaatgaaaagaataaatgccccttaatcagaattgtcccagatgatctaggccatatggttgttacagttgactgtgggtgcagatcctgggcctgtgcacaaaaagacactcagtaaacacatggggaacaagtgaatgggaggagggttcagatgaaagaaaaaggggaaggtccctgagaataaatctgctgacatcaccatctcgccgagtccatgcttgactggggactttcctgaagctataaattacttttcaatgtctcattccaggagagaaatatccaaacgacatgtccatctgatgaagagaacagtgtacatgcacacaccagatgcatgtgggtgcagctgcccaaattgcagccagtcaagttttatacctgactggcataaaacttaatcaggctccagtgttcagggccaaaagccacaacaaacatttcaaagtcaggcctcaccctccatctcacagatagtcccccagctgcccacaagacctggactgattgggtaattgtagaaatccacatccaagaggttgaaatggcagaactgctatgaagcttgtcccagtttttcgattctgccttcaggcagcaacaatcctttcagttgcttatctcaaataactaagtcacctccactgaagaagtgcgatcaaccacttgtaagaaagcaaaactccacaagcatcctagcatcagggcccactagttgactccaggatgagtgcaatgatctctcctgggtaccaagaagactccatccagagagagggcagataacaaatgtccatcttaggtcccttgccccccatccaccatctcctagtccctgggacctccatctaagaggagaagcaccagccttggcaatggaagcccacaccagtaggggctggccccacactgatcctggtaggttcatgcttatgcttctgcctcatgctgaactagtgcatgcctcagccctttggaaccccttggagctctccaaggtactgaccctcattcctggctgggcccctaaaaacagtgtcatggtgaaatgtggttattttgagtttatatatggttacagtcttttaaaaagaatcaattcaaaataaatttggcttcactgttgtacctcattttaagaagtagttttctaacttttcacctccaatttatagtgtggatctctttaagaagccaggtggcctatgtggcatgtggcttatggatttgcctgtaatggccctgaagcctttgacatcaccaagtcctcactcctttggatcttgcctgtcctatttcttggccttgtgcccttcccaatcccttcctatcaactgcagactcctaggatgcccttttccagcccttacagggcactatgattgtttattgaccagtttatttcccccattggcctgagtcctccaatgaccagattttttttttttttgtacctaatgcagggtttgtgtcacctgggtcctcagttggtgtttattgcccagtgggcagctagtgaatagtctcctgggtgtgacccaggagatcttccatctcttaagcccttggcttttcctactccccaaggcccactctggcagccagccaggtgtgctgtcctcccaatggtaggaacagtggtctgtgctagtctcctgctcataagaaacttcaggatccatgtcttctgcttgcttgtttgttgtatttcctagaggaaaacagtctggtgttaaccttgggttttactggctacctcaccccatagaaacacaacaataacaacgaatgcttctttgaacaccatttttcactattctaagcattttatatgcattaattatcagttacatttgctgttaggcaaatgctaccacatcctctttttacagataatgaggcagacagagaggttatgtgactcacttggggccgcccagctggttagtgacgggcccagagcaccctccagagacactgtcctgaaccatcgtgctgtgctgccacccactgagcttggagcaccacggggagggggtggggaaaggcgaaacgtcaggagagggtgagaaatgggaatttggaggcataaagtcaggaaaaggttgagtcctttttataataaattcctaaaagagggaatacgaaaatcgcagttgctgtagttgtacagatgagtccttatctaactccatacaattaatataaagaaccatataattaatttacaactggaaaaaaaaatactttattctaaagatgagcaagcagaggcccagagaagcccccgagtgcccaagttacaaagaagagtgtccagaggcactggcttaagaagacagaaggcactcagttgaaccatttttacaatggtataaagaacccccaaggtgatattttaataaacaaaatgacccaggtcattaatctctctgctgctttgagacatacacaggtgctcccagggctgaggctgtggaatcccagccagctatcctctagggggagctagaggcagtccttccctttaaacagggccttcattaagcaaacttaacaaacacgaggagcacaaacagaaacctctttctcagcttgcaacggacagatgtttaataagatgccatgggccgggtgcagtggctcatgcctgtaattccagcatttggggaggctgaggagggaggatcgcttagggccaggagttcaaggctgcagtgagctatgaccatgtcgctgcactccagcctggagaacagagcaagactgtcttaaaaacaaaacaaaacaacaacaaaaacaaaaaaataaataagatgtcatggatatggaataaatagaggataaagcccactgaggaaatgcctgaattctagacaatctcagcagctttcttgcattcctctggaatgactgggccacatctgtattgtgttcccatctggacacttcattttaagagtgatagtgacgcatttatcctgggaagggaaattagcaaataccaaggctggtagggggtggggggggacctgggctgctcaccccagagaagactggccagctgggctgcgaagccaccactccaacagttccctgtctgtgaaaaacagagtgtccccttccctgagggtgcactcctccttgggggtggggggacagataagttagaactgccaaggttctctgctccttaaatgcagcctagcaggatgggtggagggggtggggggcggtccttgcagcactcagagccaagcgctttctggacctggtaaagtgcctatgcactctggggcctctgagactcctacagcaagaaggaccttagctgtctccaggccctgatccaaccacttcatttcattttatctattttattttattttatttttgagatggagtcttgctctgaagcctaggctggagtgcagtggtgcgatcttggctcactgcaacctctgcctcccaagttcaagcgattcttctgcctcagcctcccaaacaaccccttcattttcgagatgagggctctgaggctctgggttccatggccagtaagaagcagaagtgggactggagtccagtcatgcagccccccatcaccctatctagtcctcttgccatttggcccacagcctccaccagcaggagcaacactaggcgccaatcttgccctgtctttctggtgatctggaaacagtcctatcatggcagctggaaaacagtggctcacactgctgccaggcaatgttcaccagctggtcctcctcccaaacacactggcaagacctagtgacacacagggtgcctgagagactgtgcacccacataccgccttgcaattgtccatccccagccattaacaggtgcgacttctctccgcaggaccacagtggatagaaatctctgtggaaatctcctcttggctgctagccatagaggacagatcttctacgccaaagggagaaggctgagaaccataaagccatcaagtaggagggaccatgcagtgctctctgatgcccaatatgtaaccataatacatgagagaccattaaaggagaagagctggggaaccccacccctgccccatgccatacaactcttcctaaacacagggtcttcacagccagcctcgacaagagacacatgtagaagggaaccatgactagccattccacagaccagaccagcacagcctgttgtggtggagacagtagcttcttccccaaccattcagcactgcggcctgggcttcctcacctacagatgtctagggctctgatgccttcctgtagttacccacagcagcccacagcactgccctttctcaatctcagcctcctccccacccctacacggtccatcctccagtggtgggggcttcatctcctgatggtcttgaccttgggcactcttatcttgctgtccaagggaaatccccagaagacactgagtaatgagagctgagagaatgggaccttgcttttaggccatgggtgaaattcaagccccagtacgtcatgtctgtgaggcttgtggaaagctggcttctgagtgagtgtccctcagccagcactcagcagacatttatctggcatgacctctgcgctcacactgccagggctggagtgcagagccacaggagagtggggtcacgtggggacagttcttcccctctccctaccctgtgctgtatgaactatatccatcacctcttttagctctcatgccaccatggtggttggtatgttcccattccacatatgagtaaatgtagacccatgagggttaagggaatggcccaaagtcacatggctaagatgcagaaccagaacttgaatgcaggcccggcttccctaaggctagtgcctgccaccagattatagccatgaatcttgcataacctgggtgaaacgcttttccaaactctatttcaaaattatgagttggcctaaaatatgactcccacagcatgctaatcttgtaattactattcatttatgaccactctccattgcatttgcaactgaaagctttattatgcattagtgtgtttcggttccacaaatatttatgtttccattccacaggtaagaataggtacccaagaaattcttttccccattttaaaatggagagttgctcctttatgaaagcattcctttcagtgaatccatttattcaactgcccattgattcaaaagcatttactgagtgtaaaaggcatacacgttatatgcatgatatgcaaaatcagcactgctctgggttttggagatacagcagtaatcaggacagataaggttcctgctaaaatcaaacttaggttctagcagaggagacagacagtaaataagtaaataaataaataagatggttcaggtaagaggtgctatgaagaaagtaaaacaggatggcctggggatgtaataagaggtaacatctgaactgatacctgttacctgctgactgaaaagaagtcagccatataaagattaggtgaaagaaagttctaggcagaagggggtcaggtgcagtggctcatgtctgtaattccagcattttgggaagctgaggtgggaggttacttgaagccaggagttcaagacctgcctgggcaacatagtgggaccctttctctacaaaaaataaaaattagctgggcatggtggtgcatgcctgcagccccagctattcaggaggctgaaacaagaggatggcttgagccaggagtttgaggctgcagtgagctatgatcacaccaccgcactccagcctgggtgatagagtgagaccctgtctcaaaaaaagaaagaaaaaaagagaaaagaaaagaaagttctagacagaaggaacaacaagtacaaagcccctgaggtaggaatgggaatggtcacagccagtgttaatgggacctagacagttcaaagggaagcaggggaagatagggaggctgacccataacaggcctcagaggcccatggaggaggcttagcttttatcctagtggcatgtggagaaccaggcatgaaaacacatatcatgaatcgccaacaagtgccgtaggaatcgatgcttttttattgttttttttttttttattgttgttgttgttttttgagacagaagtctctctctgttgcccaagccggagtgcagtggtgggatctcggcccactgcaacccctgcctcctgggttcaagcaatcctcctgtctcagcctcctgagtagctggagaaccacatccccaaaacttagaaatcagattgccttcagaattaaaccactgaagcccacgtgccgttgatgcaattagtcacctgttggttctggagtaagtccccaaagagctgtggagcatcctaaactaatcaaggtggccttggaagcagggccagtattagtatgtagaaagtggcagtaccagcatttgaacccagttcagcctgactccacaatcccaagtcttgtccactccagcctctcagtagcttccataaagcttagacacatagcacacataaagataacatggagaactgttgccagcattgaacagaaagcacattcttgtgtggcattttgcttatggcacaatcggggtgggtacatggaaggcagccatggagtaggccattcaaacctggtgaaacaagaagtttaagtgtttctcttatttcagatcaaacccagaaggcaaattttcattaactaacaactaaaggcatctgttacggctgggtgcagtggcacactcctgtaatcccagcactttgggaggtcgaggtgggtagattacttgaggtcaggagtttgagaccagcctggccaacatggtgaaaccccatctctaccaaaaatacaaaaattagccaggcatggtggcgtaatcccagctactcaggaggctgagacatgaggattgcttgaacccaggaggcaggagttgcagtgggctgagatcccaccactgcactccagcctgggcaacagaaggagacttcagcctcaaacaaaacaaaacaaaacaaaacaaaaacatagcatctattcttacagcatttgttggtgattcacgatatgtgtttttatgtgtggttctcctgcaagccccatgagaaagaagggctacaaacttgcattcctaacacaccacttgcttcatcttgccatgctcttgccctctgctagcactgtccacctggaaaactcgtccccacccttccagattcagctcaagtgtcagctcccataagatgtcttcctgaccatctctacccacttttaggccaaatcaatcacttctaagcacatctttttgatcaactcatcacactggatgcatctggtggcttaaatgtctgccccttcctaaagtgagcaaatgaagagcagggattacatcactcactgaggaattgctggtgcccatcatagcacttaacacatagtaggcatttactgaatgcttattgaggagcccgctgctggctgagtaaggttttcttgctactgctgataaatggcaaagctgagacccacatccaagccttagaccacatttttcggccatgagaaatggctatataaaagtagctaggtcaggacaaaggtgatggagacatcagacagacaataatttggggtggagggaagtgatgcagagaggaggatggatcaaaggagttgcaatgaaacctgacacagcagggaaaaaaggatggggccggatggggcaggacatggcagaaaacggggtggaagtgagccagaggtgaattacctgaggttccttacgtgggatgctggagaaatgaggacactgcctgctgcatggctaggctgagcaggggatgtgggcacactgaggaagttttcttcacatattcatcttgggttgtcagtgggatcccaggtcaccaggaggacctgtggttcaatgctccatttagaggtatgtttaacttctgataattacagccaggaaggtgacagttaccccttgctaaggtggacgaggagaaatgagagcttccaacagctccagaaaaggtcttttacaaatcacaaatcctcaccctttaggcatcaacatggcttctgaagcactactgggaggttaccttgtgcaatttctggagatgcactactccctctctttccaaatacccacaggctgccttgactgagtgcagaactgccctctttgaagaaagcaggtggggagggaggaacactatggaaagagcatgaactcctgagggagactggcctgggttccaatcctgattccaccctcttgagctgagtgactaggggccagctctactgtccagtcaaggacacctcagcaatgtcacaggcatatgaagactgggagaaggcatctgcgatgtctaaacacaacataccatcaatttctagaatatacaaggaactccagaaagccaatcagaaaaggacaggaaactcaatttaaaaaatggcaaagcatatgaataggcaattcatggaagggagaatccaagtgggtaacagcgtatgaagagaccttcaaatgtactagtaattcaaaaacccaaactaaacacaacaaaatactaataaactcccacaggtaaatattaataatgcctgtgttggtgagcagggtgcaaagattcctgtttcttcgtgtcctgctggtgggagttcaaatggattcagccgttctggaaaacagtctgcagtatatagtatttcttctttgtgacccagaaagctcactcccagatgtaaatccctgggggcgggggcattgatgaagaaatgtgttcaagtattgtttctcttagcaaggactgaaagcaacccaagtgctttagactaggggtgaggataagaagaggttatggggggatgtgaaacaccattgaaacaccacgcagtcattggaagcagtggcctgaaagtacaaggttgtggggacattggacataccataccgaatgaaaacgaacccagtcagtagcagatgatattattattcccgtctataggaggaaataggtattcacatttagcacactagcccatgcactgtggagatttaataaatgctggttctctcccccttgtgcattccaacctctgccccttcttcattccctccccacgcttcctgagtggcatcccaagctctccaggtagtttaagcattgctgtggaaggtgagggagaggtgttaagtaattctggggcaaccttaactagagaaagagttttaaaaatcagagtgaatgaatccttgtcctgaattcccagagcctcatgaaggaggcagtgtggaggtatgggccggaagctattatcacctccattttaaagagatgcatttaagtaacttgcccctaagatactcactaataaattgtagaatcgttgttaaaattcaggcagtttgaattcagagcccactctcccttttttttgtttatttgcagattttatttcatgtctgtgtgtgtatgtgtgtgttgaaatctttcaaatatacagaaatgtacagagactaataaaatgaatacacttcgcccatcacccagcactctccagtgctttgccatttaaccacaaatcagtttcattctcagtagtgtctaattgttccatttgtcttttttttttcttggtctgtcttgctaaagaattctttatcttttgttttctgatttagttgctcttttctattgtctctttattttctattttgttaatttcccttctgctactttctttgaatttactcttttgttctttttcttacttcttgatttgagttcttctttaccaatataaatatttacagctatacatttcctctcagaattgttttagccatttcccactcattttgaaattcattcaaatatataatttccgctaagatttcttctttgattaattatttcgaagaatttttaaaatttcagacttatgggggattagttatcttttaattattgatttctgattgaattgctttgcggtcagagacatatatgatattgggggtttttcttgtagttagagatgtttatgatattgggattttaaaaattagttgacatttgctacatgattaatttttgcaaatgttcacatgtacctgaaaagtatatgtactctttaaaaattgttaagagtcaggattttatataaatgctttagatcaggggttagcaaatgtgctatagtcaagactttcagctttgcaggccatacagtctctgtcatggctactcaacctgccattgtaaagcaaaagcagccatagacaatagccatagaaaataaggaaataaatgaatggggatgtatttcaataaaactttattgacaaaaacaggtggtgggctggaactggcccaccacctgttagatcaagctttttacttgtgttgataaaatattccatatcccccatacattttttgtctatttactctgtcagttgtagagagagttatgtttaaatccccctttataaaaacgtatctgtccatttctacttctcattctgccaatttttgctttatttattttgaagttatgttattaggtacaaacaaggtcagaattgttacgcttcatgaacccctcttatctctatgcagtgatctgttttatccccagaatgaccataggtccctgtttgcctgagatagtcctagttaacacatgctgttctcacaggtcttattaatagcacctcttatattaatacatgttgtccccatagactttactaatagcatctcttttaactctgaaaagagtcctcatttgaacaactgattacatggtcacttttaaaaaatatccttaatgttctctgttctccaaggataatgtagttatttcagctttcttttggtagtgtatgtctgagaaatagccatccatttaaatccaaatgttttaaataattgttttatatttacctgtcccttgaattttctactgtcttttaggtaacagtcctgtggtcactaagacacaacatacaatatcaattttaaagtgtctagtcctagatattaatccattaaaatgttagctccacgaaggaggatatttttatgtattttgctcacggctaaatccccagtgtcaaccaatacctagcacagagtaggaactcaaatatttattgcatgaatgaacacttgaatcttcaattcaaagtaagaaatcctttatctctacataggcaagttgcaagtggttcctaccctccctagctagcacctgtgacaggtgggaacttggggtcagggaaggaaggtacagtgtgctgattttcccctttcccctcttgccctcagattatgaagcagggctccaagctcctgaggggctggagcccagagaaggaaaggaagcagagccgtaaagctcttaggtggctgctgactgataggtgactccagcttcagagactccccagttgtggtctggctgcaaatcccctggggtagaggctgtattctatccctccagctttcccacctctcagccccagaggtcctcatcaccggtcctcactccgtcttctcaggcaggtcttagatattagggctcccatctgacttggcataatctgcctctcatcaatcaaatgtaggcatgcatcccttgtcttgctgtagtgggaatggaggcacttctcaaatgccatcctctatttcatcttccatgtgtcaaagaccactcgagctttttgggcctatgtcaagcatcggagcagatatctctcaactgcaggacacaaaaccaggctctctgagtcattctgctgaagggcttcccctactccaccccagccccaaacatactataagttgaactgagagatgaagcaccatctcacctctctccacaatccaaaagtcctcctcacaaaatcctctcttcaaaatactcacccagatccctttttacatattggaaagaagccctacttcccttagttcccaggcactgtctgaatccttcccttagaacaggaactagagagatgggtaatgggtattcatcatttgtccagtctggtcctttggctgcctgagcaaggtgagagaatggggctgggccttgggcagcctctgtctacatcctagtcttcagggtctcacttgctttaattgtgttgatcatgctgcaacaggacattcccttgggtcaggtatacatccagcctacgtggagtgctggcatcaggatgcacaggccattttgatgtgaaggtcctccttcatttatccattgctgcctaacaaaccactccgaaatgcagtgtcttaaaatcatccttttattgctcccaattctgtgggttaggaattaatgtagggctcagtgagggcagcttgtctctgctccatgtgttatggctagggcagtgtgactcaggttggagggtcccagcggggcactgaggctgttgtctgtgtggccactctctctcttcatgtgatctctcatcctccagggcctctctccctatgttgcctctctccagtaggaaaatctgggtttctttacattgaagttgggttctgaaagaacagtagtataagccacgaggtctcaaaaggtctgggcctagacctggcacagtgtcacttcctccaaatcctatggacaaagtgagtcaaaagccagcccaggttgaagggaatctgcttctggatggaggagcagcatatgcagagatggatgggggaactgttgactgccatccagaaggactgccactgtccttctttgattgatgctcatattccttgctaattgcttagaatttttttcccatccttttcacagggatgaagaaagaataagagtggttagaggttcttctggcctaggtctcaggatgcaagtatctgtcacggaagaagcttcaagaaggcagttctgcattttttcccagtccagctataccatgacagtccccagatttgggggttatcagtgtagtttctcaagctttcctatatttgctttgcatcacacaaaactgcttggtctgggaaggggacctctccatcaactccaagcgtcttcctaccatttgatctgcattgttctggatctgggaaatggctgttgacagctgcagaatgcggcagggacccatccttagtttcagcattcatgttctagtccttgttctttttactaccttttgattatattgtccaattccacccttcatgacgctatggactgaattgtctgccccacaaattcatatgttgaagtcctaactctcaatgtgactttatctagagaaaggctcttaaggaagtaactaagtttcagtgaggccataagggtggggccctaatctgaaagggctatggccttataaaaagaaggagagcaagaaggagatctctatctttttccaccatgtgagtacatagcaagaaggcaaccgtcagcaagccaggaagagagacctcatcagaacccaaccatgccagcgccttggtcttgggcttctggcctgcagaactgtgagaaaataaatttctgttgtttaaaccatgcagtctgtggcatgctgttatgacagcctgagcagactaatatacccaaagactgcattgtatgcttaatctcctcacaagaacaccaagatgcagatacaaaagtccccagctcacagatgaaagaaatgagacccagtcttagttagactgacttgccccaggttgcacagtgagtagcagataagaacccagttcatccagctccaaagcccatgttctgtgccacatgccaagaggctttttggccatctccttgtaatttgcagtttggaaagaaggcggagtccctgacttctccctggctgctggctgtttgctcctggctctgccctctacctcattctacactctccacaggcataagcgatcccagagtggtgacctcaaggggaggggcagggtgcagagaggaattctgcctgggctgcacattccttcccagcctctggggagggcaacaaagaaacccaattagcacaaagtgtgtaggtgggtggggagacagccgcttttgtccttccttctggtgtcactgggggtacacacagcttcgtttctaggcctggatcattccaggagggcactaggactctagcagactcctgtcaatgacacaaaagcactgaaaccaaatattttaaaaatccatttatttctgtcttggcacataaaagtctggttacttgctattttagagtaggcagcagaggcaaataagctggcttgtggactctgataacagaattaagctgtagtggaagcaccattgtgtaggacttttcagtgtttcaagcactttcatactaatctagctttatcttcatgtcagaagtcaggggagtgagtgcttgcatatcatattcccatttcataggtgaggaaatgaagacacagagaatgtaagaaactggtcccaggatacaccaagaatccccccaggccttctcattctgaatgctacactcttttcatccccaaaggctccgtcaccctggagatgcatattgtctttcccccaactgcttcaaatagtcatttccaccatttactttccacagttccttctcttgtttgatcaaaatttcaatctaacattttgaaacttaatacaatctaccattttgcaatttaataataacctagtctagtcagaaaggtaatgcctccttttcagttcaaaacaggatcacacagctaacgttgtaagtggtccggaccccagccctggcatttttccttgtgacccacacaacctcgctgtgcactgacaacctcaacaacccagttaccacttaagaaccctcaaacatccaagctgtttgaacaactggaaaaggtatgtttgtgtctgatctatactgtttttcgtgacaaggtagtccctcctaggaacacaaggaacattaactcacatgaacaggaatcagagttaacatttatatcaccagataccaagccctgttccaagttaaatatatatatatatatatatatatatatatatatatatatatagagagagagagagagagagagagagagagagagaaagagagagagagagagagagagtttatatatagagagagagacagagacagagagagaaagagagacagagagatggagttttgctcttgttgcacaggctggagggcaatggcacttctcagctcactgcaaactccacctcccaggttcaagtgattctcctgccttggcctcccgagtagatgggattacaggtgttacccatgtctgtataagagaccacctgaccaggcttagtgtgagcaacaaggctgtttattcacctgggtgcaggcgggctgagtctgagaaaggagtcagcgaagagtggtgggattatcattggttcttataggtttgggataggcgttggagttacgagcaatttttgcgggtagggggatggaagttacaaagtacattctcaaggcgggaggatgttacaaagtacattcacgagggcggggagggcatattgtcacaagggcagggaagaatgttacaaagtacattcacaaggaccaggaatatcacaaaatacattatcacaagggcgggggaatgtcaccatggcttgaccatggtagggccagcttagaggaccttacaacaggtgctcgccaccacgcccagctaatattttctattttcagtagagatggggtttctactgttggccaggctggtctcgaacccctgatctcaggtgatccacctgacttggcctcccaaagtgttaggattacaggcgtgagccactgcacctggccaaagtgagatatatatatatatattcatttaattctcactatatatattttttgaaacagggtctcactctgtcacccaggttggagtgcggtagtgtgatcacagctcactgtagccttgaccaccccagactcaggtgatccttccacctcaacctcccaagtacctgggactacaggcgtgtgccaccatgcctggctaagttttgtatttttttgtagagacggggtctctccatgttgcccaagctggtctcgaactgctgggctcaagtgatctgcccacttcggcctcccaaagtgctagaattataggggtgagccactgcgtctggggagtctcactatttttgacctgacctcctgggaccccttggccccatgagcaactccacatccctgtagccccaagagagtaatgagtaatgagccatgatgtgaagatgttgcccaaaactgtgcagtgcatgacctgtgcaactggacatggctgccctgctggaattgtcactgttactcccttgctctgacataggactatttgcagtctcctctctcataagtggggccaccctgcttcttttccagaacctgtgagccattagcatgtctattgctcattaaccgatattttgtaaaaggcttatttctcttgtatataggtcactgtcacagaggtaaggggctgagaactgcctgtcactgggagaggctgagtgaggaatttagggtctccaggaaatgggggatcctaaacagcatgcttgattttgcattagtagcagtactcactcagcgcttcaagtgtgcttgcatgggtgtgagatgccctgggtgttttgtttgtttgtttgtttttgagatggagtttttgctcttattgcccaggctggagtgcaatggcacaatctcagctcactgcaacctctgcctcccaggttcaagtgattctcctccctcagcctcccgatgtgaactggacagtctgacttccagtgggggccctcacagacagggcacggcttaggaggaatcccaggctgtgagcattccaaggcccagtggccaggcttttggcatttgaagcaaggaggaggttttgaaggagcccctgggaactgtggcttggatgttctgaaggttttgtatgctggagacgtggttgtgagttgtcttacagttcattcattctataatgaacctgtattgctttaataaaatcagggagaaatgttactgacttcaaaacctgcttgggcaatgtggactggactaatagtgactgagccctgccatgcacttggtacccagctggccaccttaactcactcattcttcaaaggaggacttattactgctgttttacagatgaagaaactgaagctcaaagaggcatggcctcttccccaggtcccatggagcccacattcatctgcttaactctaaagtcccagctctcttctctacctggagctctttgctgcctctatggtagctgaacaggagaaacacccaggaagatggtcaccacgctgccccagagcccaggggaccagggggctgctgacggccataatcagggtattcttcctgaaacaggtaagcgacatgaacctggcccaatggagaggcactttcttgttccaccacaaatctccattaaaatcgccttttccatagtcaccaacagtaccttattgatatccttctggcatcacctaaaacctaaaaacagcctgacagtttttgtgaatcagtttccattcctcatcctcttggctggcttggtgacacctcttccctgctgctgtttgccaactttaccaatttaccatcacctgcaagtgaatgaccctcttatgcctagttctagattagttggattttacattgtttcaaggtatcatagaggttccagggaagatgcctgaggcactgctggggagggggtgggctggggacagtgaggaatgggttgagtcaatcccactttcccctcccccatcctaaccaaagcagctgtttccatctttgggtgaatactgccctttatttgagaagggatccaagtctataggctgataggggggccacagatgtagatcattaataaatatattaaatgctccagtaattaaattattccagtagaaccacatcatagtgaagaacatgaagaagattttttttcaaggctgcacttacaaatcattgatccaaattcactgggcaatttcatcaggacctcccttttccacaggcttcttgggaaaaggatatgggcagggcttggggggcatggggtaaagtagggagagagagtcaatagaggaggaccccagagggacaggaggcagggaagggagggaagagggagaggagaggcagagaagtcagagtccttgtcactcctaggacagctctctggcttcttcacacactgacatcaaagaacacctttgaaaagtgaccattattttatttataatttcccaaccagtgaagaacaagcttctgccagcaggagttcctgggatgatgccgggcttcccctgcaaccccagtatggaagcagtcactctggaccctagtaaaggagctggtgtagttaagagtttagagggtccttgcaaggtcacagccctgggtggccacccagtgtccctgctggacagcaggactccccgctgcccctcacagctgcatcatcatgtctgcaattcgcagatgttcacaatgatctttggaagaaactgccttcctcagagccaagttctaaccacaccagggatttactctccttatttagaactcctaactcacttttttgggaaccgtccaaatggcattagctacttcagttgataaactttgccttttgactgtttccaaaatatgaccccctcctttaaaagatgaatggccttccctggggatttcttagacaagaggttctgaaggcatttctaagagatactttaagccagtggttctccactttggctgactgaatcactgggaccagaaatttatgtatttggtgctgcactcagatggtattaggtacttccctgcacattaggaaaatctgtaagagcttcattgtatagatgaagaaatggaggctgatagtgaacaggtgccttgcccgagaccttagggtgagaagtgccaactcaggctcctcaaatatcatttgtccagccccctgcaccctggccagtctcctaattctccatccagaatccctttcattgtgccagggcttgcacgtagtgcagctctttaaagtctagttcatggcatgttttatctggcatacacaatattttataaaagcccaagtgagtcagctaaaaatcagaatttacagtaaaaatctgtaattctggccaacattgcccaaccctcctgcaaggcagagttcacctgagctggctcaggggtggcctcccttgatggtccaggctctccaggagccacccctctcccaccccacccctatgacccactggcttggcctgcctggccaggccaggcactcacatcagtgacccggcactatatcatgaatggagtggaagcgtcacaggggtattattccatggaaacaatacccacttcgatatggcatgcttactaaaaaagtctttgcttttatctaaagacactgcaatcagacctgacacacatttatagaagtccagatgatgatgacacaccaaaaatatcacattgatgtagtgttttatcactttccaattactttcatgtatatcaatttatttgagttagaaaatccagagaattcatcctgaccttccctctctgtctccaccctacctctgttgcttatcccaggccctgaaaatggcccagatataaatccagaccagcggccattagacagacaaacagaaacctctgtgcatggaagtcattgttctattgcttctcagaaatgcagaattaaggggcggggggaatgtaaccccaacatataataaatacaattataaataaataaattaaataataataaatataacaaaacagcagatgtaaatgacagaagcaagcacatacaaacctagcacatacaaactgataaaaactatgaaatatattcatatacattgaacaaaggtcaaaagtaaatttgaagagtccatataattttagacttgttagccttttttaaaaaaaaatgttgccttcatgttcccagttaaaaaaaaaaagctcaagaattcttaactttctcttataatttcctcacctgtaaagcggaaagatctgtatgtaattttcagaacagtataagcattcaataagtattagttacttttattatcatttgcatgtacaaggcaatctttccaatttccctccttcattttcccagaaaaagctaatcaaatgggtttatcagcttccatgatctctgtgcattgaatgaaggtgaacatattcaggtgtgatgcacttcatgtcaaggtctcattgaccccgtagatttgaatgctgaagtgaccatcatatccatcacagaagaagtatttttgtacaattcatcagctggaagagctacatggaaatacatgtctaactatctctctgtctacttgtgtctccacaaagtcctgcaagctccaagatgggaaatttgcctaattcatttctgccccttcagtgcccatcccataagttggaagtcagtaaatgtcaacaagtatgtgaccaataaatgaatattcaaacaaggcaaaaataagacaggagaaaggtgtttttatgtccttcagtgggagaaacctgcaagcaatacatctttggtgccctgatgacaggctatggtggatgctgcggtactgcccaggtcccctccagcatggagccactcattcttctggctgctgggaatgttgtctgctgacagctcacacttgagtctctcccaggaattctgaagggagctgtgttaccaaggccatacacctttcccaaaagcagtctttatccactgactgatcactcgcacagggacaaagacctggctcctttgccgcaatgtgggacaactctaaagagccatttcagctccagaactctgtagcatggactcaggcccttgttggaattgcatcacagttcaacttttccctctcccccaccctgtgtccctcccaccccagtgaacttcctacacatagatccatcatctctgagtctgtttctgaggaagccaacctgtgacagtgggtaccaggagtaagagctgggaggtgggagtatgttggctcttgctggaagcttcttatccctacgcgttcgtgactcactttattcatggcttgtctcaaatgtactatctcagagatgacttctctggcagtgttgtccaactattcccaaatcattgctagcatatttccccattttgtctcctcctatgcagtcatccacatctgaagtcatcttgttctttttttcttattgttttttctcactctcacatgaggatgtgaactgcagaggacaaataccttgctatactgctcactactatctccagcttctaaacagcacccagcaccatgtaagctcctaagaaatatttattgaatgaatgaatgagaatctgcacacacattcatagtgggaagaactgggctgagagtgggaaaccctcatttccagctctgtttctgccattaaccatctgggtgacctcaggcaagccacctgacttctctgagcctcagttttctcatctgcggaatgagatggtagaatgtgatgatcactagaaattgtgacagctccagcatcctataattttacatggttattcagcttggaattgttctgtctataaactacattctatgggaatcatacagttttttatgctgaaacggagcttcccagagcatttcacaatatccaatgagtatcggctttcagatgccaatttcattattataccaatgctagaaaaactttcatgtgagacgctgcagttaaggatatgttcaacatggggttcatcaaagctttagagcactgtgaaataaccattctcctatttgcataaatatcatgagaactaagtctctttctcaagtcccacgaggtaatgaaaaagtgaacactggttgaggctgcctgtgcaccaggcatgagtctgtgctcatgggaggcagtgaacacctcacctggcctggagcaagcattcaaggaatgctggctcttaacatctgtctcatttaatccaaacaacagtcagtttgaggtgggactcttaaccccaccttggagttaaggacacagaagcactgagatttacctaatctacccaaagtcatcgaactaataagtaagtgatggagccagggttggaatctggacagtcagggtctagagcgttgccatttatccactacactagagctgtctcaattttcttaaaattcagattctgaatcagaatgtttggggtcagcctcgagatctgcatttctaactatttctaggtgatgttgatgcttctagcctatggctcaggctttcagttgtaaaagtacagaagaaggaactcctgctaaaagtcagaaactagcctctggtccagccctggcaaatgctggcaatgagaccatggctaagtgacctctcctcacaggctcactcatgcctgtgatcccagccctttgggaggccaaggtgggaggatcacataagcccaggagttcaagaccagcctgggcaatgtggcaagaccctgtctctacaaaaattttttaaaaaattagccaggcatggtggtgtgcccctatagtcccagctactcgggaggctgaggtgggaggatcacttgagcctagaacacagaggctgcagtgagccaagatcatgccactgcactccagcctggatgacacagtgagacccagtctcaaaaaaacaaaaattactgggtgtgtgtgaaagcactttataaaccagaaaactcaaaagcaaggggacagaaatttgcttatccactcgtctttttccctctaggatgtgagtctttgagccagcacaaagcagtggtgcctggcacatagtagatatttagtaagtgttcaaagtgccaagtactttaaatgttatgtaatttaatcttcacaacaatctctgattcacattttacagataaggaaactgagactgcctaatacaccctcaaactactaaagcagtaaatgctgaagcccagattttaaatgagatctgtctggttccaaaaccaatgctgattttaccctccactcccattattcctcccacataggggtctggctgaggtctaggaatggatccagattttgcttctgcacctgtcacatgggcactgggagtccaactccttcttagaacaaatgagggctctggtctagggacagatcctacaaatgcaagtagaagctcttcattttaggggtgggagaaggcacggaaataattcagctaaaataaacccttcaagtattctgcaatgagaagcaaagtcaaggtcttcctattatcagggcccccaaagccaatccagaatgtacaggttcaacaagttcaaaggagcaaatgcctggaacagtggctctaaaagtggggtccaccagggtctctggatggccctgctgaccaaagtattttgttcttgacattaatttatagctccagcattggtaggaaacttaggggtcatggagtgcagcttcccacacaatgcaaagccacatgagggggctggtttttgaggtcttgagtccactgaccaactcaatttgaggctcaatggcttagagaaggaaaaaaactaaagtaagaggttgatactgttcctatcctagaggcaaggaaacaatgctcagaaaggctaaggaatttagtccaaagcacaaaggcacgaatggtagagataaggcctgaacctagggacaactgactccaaagtctatgccctctcctctgcccctccaggattgtaattaccattataaaagcagcagaatctgagggctcaaggaggagctggacatggctccagagcctctcctgaactctgctggcatcaaacatcatgatggacacaagaagcacgcctgagcccacagtgataaggtccacacacagtggctcctcctttccccaagtcattctgtgggtggtacccagctcatctggataataactaaccacaagctgaccatggtggaaaatccaagatctgataaacacacaaaggaaaatccttcaaagaagctaccgagcctgctcagcgtgggagcctccagcttgtgaaatggcgagggggtagtattgtgacccagacttgaccacctggtgtgaccctagcaaggacctccctcctgctccctgagggctgctttcctacctgtaagaggtgtgaccaggaatccccagcatggtcacagaataagaaaggtcaagaggctggaaagggcctcctgagaccagtgagcccggctccctctgggcctggggctgggtctagcataacacaccctcatttaatcctcctcacaaatgggtcagagaagtatgaagtctttggggacaggaggggtgatggccatctgggtgtctcatcagctccatctctctgcagagaccacggacatcttcattgacacccccattcccccactgtgagtaaaccactctctcaggggaagggggaatatgtccatgccctccccaagaggaccttggcactggtgctgttctgtgggctctgtctggctgccccttaccttatgaaatacaggggtcacagttcagttttcttaacatctagtacattctccagcacaccaagtgttcagtaagtgttggctatgactggataatcatcctataaagggtctgactcaggcagaacactatagctgtaacagctccccaattcttattgaataagacagcgatgtggtggttcctccacaaagcagtgattagaattccaattgtgaggttcatcatttcatccagtatttattgagcacctactcagtgccaggcactatttggggattcagtgatggacaaaacagatataaatccctgacttcatagagcttattttctagtggaagagacagacaaacaaagacacaatacagtatcagttagtaataaatgctctgaaaaaataataaagaaagatgagagaatgaagtgttgggaacactatttgagatgcatggcatgaaaaggccttccaagcagagagaacagcaagtgcaatggccctgaggtgggaatgtgcttggggacaggagagcagtgaccaggaatgatgagctgagaatgaagctggagcagcaggcaggggtttgggccacagtggtcatggcaaggactctagattttattacaaattccacgaagccattgcagggttctgagcacagtggtgaggccatctggtttacatgatctggggaccagaaggactaattcttagcatgtaagctccaaggaaatgtaagtacattaaagaaaccctaagtacatggagagtaacttgtttgaaaatactattgtcttagcctactaggactgtcatcacaaaataccacagactaggtggcttaaacaacagaaatttatttttttcacagctctggaggctacaagtccaagatcaaagtcccagccaattaggtttctggtgagggctctcttcctggcttgcagacagccacctcctcactgcgtcccagcatggcctttcctccgtaagggcatgcaaaggagaaagtgagctctctggtgtctcttcacataaggacatcaatcctattagtgactcttataaccttatttaactcaatatccaaaaggtgctatttccaagtacactcacactgggagttagggcttcaacatattttaaagtaacacgattcagtccatagcgtctagattcctatcaaattagattttacaaaatctgctcttccatggttaacttcagacaaactgatggacaaaaccaatggtgaagtcagagttagtcaacgcagaggaaatggatgtagatcacgctaatattccttagggcagtagctctccgccctgggatgattctgattcagaagtgctgtggtagggcccagggaaagtgcattttaacaagccactttgacagactgatgaacagtggacaaatgcagtgctccctgggcccctctaagaagcagtaccaaagataaaagttaatttcaagtcactatagatagagtattatgcaaataaaagattattttttatgttcctcacactttcaccaaaagaaacagatacccctaacctgccatatgagctccttcttatccacctgatatttgtctttctagattatgtgatttttgtgaacaggacagtccatgaaccctgtggctgctatgtcttcagagattacaggcagctctcagcacctgagctttcgtgcatgttttgagtcccatgatcctctggccatgactaggccaagaatatgtgcacatgccaaagacaatgaccttcaggagagacgtcaaggactccagctgcctcagtcggggcctggctgagccctctgccccgcagacttgccctctggtgaaccagccaatccaagcagactgtccctgctgagcagctgggagtgtgagacccagagagagaagaacaagggaggcatggctgcaggagaaggacaggcagagagcacagctgggtcaggttcagcctgggttagtggctggcatgggaagatgcctggtctccagagctgctgagggtgacaagggacatgctgcagttctccttgggcgtcacagggcaacttccaggatgtttcagaacgtcctcatctccttgatctccttacgagtaatcccatcaacaagacaatctgagcatgttctcagttcccacagcaagagctaagaagcagatcaatgaaactggtcatgtggattcccacactactccaaacttactgggtctcagctcaattctcatttatttctcatgttttccccttgaaggaaattcacaagaatgcaaccagtcctttggagttagttgtggtaggatgcgactggcaaacctaagaggcatcctggcttttctcatttcacccacccatgtctaaacccctagtgagtctgcagtggctctacttccaaagcatccctataacccaacaactctctccatcccattgccaaaactcaaatcatacaactatcttcttgcatgaactattgaagtggcacatcatggtcttttttccactgttgctgctctaaaatccatcccctacacagcagatcatgtccctacttagaaccttctaggagcttcccaataccaatccttaccaaagcctacaagagcctataggattgggccttgcccttctcttcagcttcatctccctccaccctttcaataattcccgcccaatggccttcattttgttcctccaacacaacaagcttattcctgtctcaggaaatttgcacctgctcttcctactgctaggaatactcttcccgacacatctgcacagctgcttccatctcatttggggtttccctcaagggttacctcctcagtgaagccttccctgaatactccagcaaaggcagcccctcagtcaccctgtcctactttttgctctttttattatttttatttttattatttttttgagacagagtttcactcttgttgcccaggcttgagtgcaatggtgcaatctcagctcactgcaacctccgcctcctaggttcaagcgattctcctgcctcagcctcccgagtagctgggattacaggcatgcaccaccacaccccgctaattttatatttatagtaaagaagaggtttcttcatgttggtcaggctggtctccaactcccgacctcaggtgatctgcttgccttggcctcccaaagtgctgggattataagcaagagccaccacgcccggcctgctcttttgtcttcttcataacccctgttagcaccggacattgccctgttcacttacctgttccttgtttaattctatctcctattctaaaatacaagacttacaggcaagcacactggctttcttccccctgaatccctagccctggaacagtgcctggtacccagtaggtacttgatgagtgtcacctgcctgcctggccagtatttattccacatggcaccacctctggggattctggccatctctgtctctcccattgccttctatcttagcaacaatctcaggaaggtggttcctctcagccctgcaggggcccaggctaagcctcagtgcattgcatatggacatctgaatacacctttgctttggaataccatgttccagctctcctttcagtccatgaaaggaacaggaattctgcccctttgacacagatggcccggtgaattccttgtattctttttgtttttcaggacttatatatatattttaattgaacttgttgagataattgtagattcacacagagttgtaaaaaataatacaaagagatctcaggtacttttccctcattttcccccaacggtaacatcttgcaacactatattatatcacaatatcagaatccacataatgtcatcgacagaggcaagattcagagcatttccatcgcacaaggatccctcatactgtgcttttataaccactcccatccctctaggctccaccaggacaaccaaaaagctgtctgttcccccttcctataactgtgtcatttcttcactccttgccttctttccacactttcagaccacatggcattgctgtcaggatgcttggctgcctcatatccgcttgtggtcggcctcggatctggcctccccttccctcctgagccacattgtctcgtccttacccataaatggcaccctgattttttaggacctgctttctaattcatcaagaacatttcagatttatcaccatcctcctagggaggcagcatctccctgtgcaaagaacacaggctttgaatcctactctctacctctccgagcctcagttttctcatctatagaatggagtcaataataccagtatcagggatccatggagaataaatgacacagtgagaggaaggactctgcccagtgtctggcacatagcaggcacatgctaggaagggtaatatgcacaatttaggattacctacgaatctcagtcagtctgcgaaacaacaatagcaactaatcaaaacaccatttcctgatgggattaaaatcagaaagagcatctgatcagagagcagatatcccacagtgttaatagctgacaactggaccaaattatcttctttcaagaagggtgtcaaggatgtcagggggttgggggtccaggaatagatcctcaaaatcttccaattgacaatattcatcaatttgctgtgtgaccttgtcaagtttctctacctctctgaacctccagttcttggtctgccacagggatgccagccttgacctgtgatttcctcaccctatgctacagggtccacagaggagggaaggtggagccctgagaaggtctctggcctccttctcctcccacctccccatccaaagcagcacccacctctgttactggctctacatatcaagagtacaggtgatctttcctttgaagaagagcctctggtggtttcagaacttgcaagaccattgtcccgatgattgctggggttccttctggttctaaagacctgcagtcctaagttctcagctcactctcacgtactgaaaacagacaggactctgcagcagcaactggtctcagctcaagcatcacttcctccaggaagcattctttgacccaggagatgaaggtagggccacctgtgggcacccccaaggcacctcctttctaagttgcccataggaggattccagggatggaactaacaaatcgcagggcccagggcgtgagtactctggagtggggcatgggatgctctgtgtgtgtgactacacatgagtgaggtaaccactcacagcccagattaatggccacgcctggggtccagaggaccccaagtgaaatgcagcctggctggctgtatgtcacagaggatttttcctaatcaaggagggaaacagagtaacggtctaccttgcttagccttgtaagcccccggtgaccaccctggatgcaaatgaccttgcccaaactattaaacattcaaaccctccttctcttattttattctcaggagggtttagagcctcactgtctgccatggttgccactagtcctgtgtgactatttaaatgagatacaatttaaaacccaggtccttagccacactgggcatatttcaagtggcatagtgacagaactgtatcccatcatctcaggaagatcgactgcacagtgctgcctaaactgtttgggaatcctgagcctggctctcgtcgcgcctccttttatgaatcagtttgccaccgtccccgcctctttgtcacttgttcctgaaaaacccggactgggttgaatagtgtccccccaacgttcacatccacccagagcctcaaaatgtgaccttatttggaaatagagtctttgcagatatcattagttaagatgaagtcatattggaatagagtagaccccaaatccaacatgactgtgtcttataaggagaggagagacacatgcatggattcacagagggagaaggccatgtgatgacaacagaggccgagacctgatgacatctctacaagccaaggtcactaaggattgccagcaaccaccagaaattagaagaggcacagaaggatccttccctagagactttggaggaagcatggccctgctgacaccttgatttcagacttctggcctccagaaccatgaaagaataaatttctggtgttttaagccatcagtttgtgctaatttattatggcagccacgagaaattaatacaggaccccatcacgagaccctacattctcatccaactctctccctcaaagacagccaggaccttcaaatcccttggatattaacccctggccagtgacacccacggagcccatcagatcctggccgtgccagccagccagtcactggacgacataaccagaggaagcttggcactggaaggaggccaggcatgctgggctggtgaggctgcctaggaaggagccaggagactcaagtagagcactcaaattccataactttctctccttttaattttaaaacaatatcagaagggttcccagaaagcaacaagccccaggccatccagtcagtggttaaacagtggagcctgatcacttactttattaacttgctaaatcaaagggctgttaaagtctctgtccggtaataaaatgcaggaaggagctgaatcacccacctattagtggcagtattggtgcagttaatgactgtagcctggagggccgtgcagacaacaacaaagccagccctgcgtttccacctacaaaccccaccacttcctctgcccatcccagtgcccccagcacacctgcccacacacacctgtcttcaagaaggctgcatcagaatctgtggtggcttgatttttaaacacacccagaatttctcctgtcaaatacacttccatccaactcttccaggatcccacctccatgaccccaaacaaaaacaaagaaaccaaacatccagaaacgcggtgtttattaaatcaattctttaaacaggcagccaacaccaagttttgacaatgcattacaaacagtgcaaagcctccggagccgaatgctctgtgaatatcagtgcagcactgataagctggaccctgaaccagtatcaccctctgaccacacagagccaggaacagccctatttattttcttcattccaccttctcctgccactttaaaatgggggagaggggaacggcctgtgtgctgttcttccagaagctggtggaaagacatgcccaaaaccgctgacttcgtccatgtagcttatcagcagggccattttgaacaagttatctaagctcagggcctcaatgtcctcacgcgtaagtgatggctccagagggagtgttcttctaagacctggtgaggtaagtgtgcttatgagtttggtacatcataagtactgcattaatattcgttgttggctgggtggggtggctcactcctataatcccagcactttgggaagccgaggcaggtggatcacttgaggtcaggagttcaagaccagtctggccaacatggtgaaatccccccatctctactaaaaatacaaaacttagccaggcgtggtggtgtgcacctgtagtcctagctactcaggaggctgaggcaggagaattgcttgaacccaagaggtggaggttgcagtgagtcgagatcacagcactgcactcagcccgggcaacagagagagactccatctcaaaaaaaaaattcactgttaatgattatgatgaataatgcacctagtatatagtaagcactcaataataacagcaataaagtgctgttattatttctaaagtaacatctaacaaaaccaggctccaagtgccataaaaactcattattaaatctttataacagatgcaactctaaaactatccaaattaaacccttcagaatattcccaggacacccagaaaagattgagcctgaatcccccattggcactaaaaacaggacccacaaaggagcctcgaagtcatgtggagccaggtttggcaactcactccccactgtcccattactggcccctcataaaggcttcctgatttatcactgcagtaggactgaactcttccaccaggaggtttgctccattatgctccattactctggcctcatttgaaagcagcctctggggctttatccatgccaatcaggaggtcttggtggaaagagctccacgtgcccctgagataacagaatgctagcttcccacagctcagacccactgagaatcctgaagaaggagcccagcatgagttcattctccttcccaagagaaaagagagcagaaagaaagaaaaggaagcagcattctttctcatccctcgagatggtgaagctccttttcatttgcttctgagatctgcaaatcaggtggcaattttagctctttttgccccccgcttcttgctagagtatcagaaaggcactaaggccagcagcctctttcttcatcagcaattagatctatggctaggatctgtctacctggcactgacctggggtaacctcagttccaatctctgcagctttccagaaatgaggcttcagtgtggagaaagatttttgtttcaaataaaggcttttcttacgctcaaaagcaatgtaccctggaaattgttgctgggaggacaggaatgcaggatgcaggccctcagctgtgaagtcctcccctccgttccccgttaccaagcacctctacttcctccctaagacctgaggaaacgctaaaagcaggcacaagcagtacacagcaaatccccacatttcacggcatatgcgccttcccagatgactgcatggatacactccataacacattgttaaagtgataattagcgatagacttgttatgaatattccaaatacagtttctctctacaacagttgatggagacaaaggacatcacacgaaatgtaagaagtaacagagggatttttgtgcatatatttttaaaaggtcctgggaaaatagcataaatcagaagttgatttcaacaaattaaacatttcaggacccatttccaatgaaagatgcatgggcatcagtatttcctccgcaatgcttagggaacacgccatcctcccacaaactccagtaaagaatgtgaaacccaattccagaagccactcttctgttgccctgtttcacagcagctaggagtgctaaagacgggtagtttaagaaaaaaaaaaaacagaggaaatgctgaggaataaggaagaaagtaactacagccaacgtgactcaccctttaaaagtaaaagagaaaaggcttctattcatgtttaacatttctccctctaaatgaaatttctggaggccccaactctgcccccacacctttacacacattctgattttttttattatactttaagttttagggtacatgtgcacaatgtgcaggttagttacatatgtatacatgtgccatgttggtgtgctgcacccagtaactcgtcatttaacattaggtatgtctccaaatgctatccctcccccctccgtgtgtggggcctccacaacaggccccagtgtgtgatgttccccttcctgtgtccatgtgttctcattgttcaattccctgatttttaaattcacagtgattttgctccacatgggacaatgttgataccaatgacacactccctcctctcattgcctgcttcaccagggtggatgaaagacttcaggcagccaaactgaggatagtaaagaggggagggagcctctgacaccaaggaacaaaagaaggagacccagccccaccaagtccacctccactgcaaactgagaatcagttcagccaaggggcatggaaaacaacaaccccttcagggctgaaagggagcagcacactaaactaacaaggagaagaacgcaatgaacagtgctgctgcatctcctctgtgaacatcagggattctggacttactcagatagaatgttctattttaaggatgaacctgagctcttctagtccaagagggagacacaagtagcaacacacgttatcatgcacacagagtcctctgcaggcaaaggcgcccttctcctccccagcagtatcgctagacgtcatccgatgccgcttcttaccttaactgctcgcagggtcacagggcttgaaaaccacagtgttggggacagccctagagccatttaagtacacccctttcattttctaagtggggaaactacaaaccatagaggctgaataatgtgctcaattcaaaaggcttgaaaacaagtgccaaggttggtgtaaaatctaggaccttcaagtctcaatcttagtccaccctctacaacaatgttccccgcttttccccttattcagactaaactaacatccaaagcatagaattatcttgaaggagtaacattaaacatcaggatcaaaatataaagaaaggaaaatctaacatctcatatagaataatctcagcactatacctagaacacaccagctgacctgggcttctttgggtcctgagggaggccagccaggggcagaggtcaccaggaacagcctggagaggggagaagagggccgctggaggccttcagggctcaagcttctgccacagggcctttgcactgcctcttccctctgtgggagctccatccctgggcatccacagggctcactccctcacctccttcgcatctatgctcataggccccattctctatgtagcctcccctgacaactcacttgaaaatttcccttgatagtccccatctcttgcaccctacttaagtttttccatggtatttatcactttctaagagactacaatatgtttattctctaccaccttccattttaaataatatccatgaggacaaagagttttggttcactcctctatctcctgggtctacaatagtgtctgacacataataggtgctcagtaaataaatactagtagaatggataaatgagtgctcattccttcactgtctccatcagcaacaaccacctacacacctcctatacacacacacacacgcacacacacacacacacacacacacacacacacacacacgcctctttctgcccttttctctcttcttcacctataccccaggcctgccactaggaacaacagggatagtttaggttaaacttagaacattcagtaataatattgccaagccttccattaaaaactcatgttttatatacatatatggttttataggcacaaaaactctagaaggatacacattaaactgatatcactaggtgtcccagggaactagatggctgggcatgtaaacttttcactctatatgcttttatactatttgaattttgaactatatgaatgtaattacctgtcaagtatgtttaattaaaaataaaattggaggctgggtatggtggctcatacctgtaatcccagcactttgggaggccgaggcaggtggatcacctgaggtcaggagttcaagaccagcctggccaacatggtgaaaccccatctctatgaaaaatacaaaaattagccaggcatggtggttggtgcctgtagtcccaactactctggaggctgaggcaggagaattgcttgaacccgggagacagttgcagtgagccaagattgcgccgctgcattccagcctgggcaacagagtgagactccatctcaaaaagaaataataaataaaaagtaaactggaaaaaccaacgcacgaataacattcattcctcagctctcgtcctcacatcatcttaatacaaatttttcagggtgacggtcactagaatgctgtcagccctggattagatagtgaaatatggtaacattctccttttctctcatcccccaattttctgaaatgtgcatgttacttttacaatgaaatatttgaaaaagtttccattgtgcagaaggatatgaattaatgcaaatttccctacatacataaaacatggagactttgtttcaactcatgaatccatttacctttcattctgttaactcctgttggatttttcatttaatagatttcagaggaagttgtctaagatggtgccaggtcaccagaggtgccaatgcaggacacaggcaatgccgtcaaggttgtatccggtgaggatgaccacaagcaagccaggctcatagcctaaaggatacacctgaacgtgttcgctgtgaggaatgggccagaggattatgtgatgtttcatattttttccttgggactttcagatttttccaagttttctgccctgagatgcattactgaacttctgtttttcctcttactacactgtgaagtaaatgtgtgtgatgagtcactggcctttgccaggctgtgatcttcccaagaatgaagtccctatttaattcatctttgtcttctcagcctcttgcctggtgccttgcaacagcggctcctccatagatgggtaatgaaagaatgaacaaatgactgtttctcagcatccaatgagcactcatgggatatagccacatactaaccccaaagagacaacaccactccctcattcactgcctgctcacctcagtcatcattcatgggtattccctgttccaggcaaggcaacggaagccagagccacccaagtgtggctatataaaggcatccaggaaagggcatatgtggccttcccagcaacctagtctctcatgcatttgggttctgagcagttaatgctggctccatactttgacatctttgtaacttttgcaaattttcttttgattcttttctggggattcatcttaaggaaataattagtcataggaagaggaaactaaaaccacatttattaatgctgtttaggtggagaaaagttggaaacaacctaaacatcaaaccataagagatgaggtaaacaaaggatgctgtagctatgtaaatgagtactcttacattacaattgctgtaaactaagcttgttgctctagaaagttgttcatataagatattaagtgccaacgtgttttatgaaagactatacatgatattgtgacactacacttacattaaaatatatgtgtacatattatatatgtatgatactatatgactaaatgatcatcttgtctttggggtaagtaggatttggaagtagctttttcttctttttatttgtctacacttccaaagtttttgtaacaagcatgtgctgctttgcaataatgaaaaatagcaatgctaacatttaactgaaaaaagaaaagcacaattatcctggagtagggcaggcactaaaaaggcgggagtaagagcgatgagagtagaacgctgagctgaggctggcctccttcacggccaccttcctccaggggtggatccgtgttccagtcacctccaaacacacaaagatgtcagtgccacagaccatactttctctcacacatccagtcaaagcaccaggaggggacagagtcaccacagtgcaagtctcagctgggattgggcaggggagaggagaagggcatcaaggagctgaccaggagacacactgatctggccaggcagcctcttgcagaagtggatcccgttaacaatgaaacagatatgacatgaacttggcaacttctgagaacaggaatgtctagtggtgcttctagcctaaagtgacccagtttcagataagacagtttaatccagaactcagagggagaaaagattaatattttctcctagggaaggatacccagagctaccacagctgaaatgggaataacatgcttaaaggtggatatgagatggccaaagtcccatgaggaatggcctccaggtatgatgatgaaatccagtgcaggagggaaggtctcttctcatagtatccaattgcaaaactggtcaaaattcaaccattttctcagggttattctaaaagctgttggacttgtactgcttctttggcttctctggctcttgttccagcttttgcagttacaaaatgagaaagacctcgctgtgctgtcctccattcagtgggttctggatggattgccagatgatgtgaagggctcttggtcatggctggtacctgcaaacacggagagtgcttatcaccattggactctactgtgccatttccatcatgtcaatcatggatagacatgagataaggaggatggaatcggcagtgggcaggacacaataggaagcgagggaggggagagggcaacagggtggaagggtagagagaattgcaggaagaaggagggacccaggaatggcccaacatcctcagagatgaaagattacagaaagagggcagaaggcgagagcagagaggccatgccagcttgggctggagcagtcagattcctcaccacacccttgtccctgctgtgcccatctgctgccctttctttgccttctggccctgtaggagccatcccagccccacatcccaagccctacctgtgactacccctcccctaagccctaccagagaaatgaacttacttctacccttcgtgggccgcatgcctccagctccagctcttcttggggctccagagtgtgccagtttcccttcaagcaccagtgtcctcaacctctggcatggtattggaatctgtgccttcagaacctcctttcttcccattcttcaggacgtttgtccctcgactggacaagatccagcaggagtgggcaacacaggaacaaatccgagacaccagactgagagggacaggaaggggaaacacggggcagtcctgggtgatctggaccatctggtcacctcattctagttcacgagtggacatttagataagggaaaccaaactgaatcagaactctaaactcagtgtgcagcagggtcaccagattgcttattctatggcacctgagacctttcatcaccactgatcttcacgacagatgcacgcagatatatctaccaaggacttagaaacccaagacagtttcatactttaaaaatgtgtggaaactaaccatgcacaaacttctccaattacatcagtctccccagaagcacatccaacagcactctgtcacaacttctggaagcagcctgcctccttgctaacccctcctccatgcagatgctcacctagaggagtggatgggacataataccaaggaggagagtgtgggtccagtcctagcacaggccaggaacattttctgctttagagtcacaggactgttcaccaagccaagctgaataaacatcttattgcaatatttgcacagacatgcaactacttgctgtgaccatgacagtgactggaatgtaaggatccatcagtggtagacccaaatcttttttttttttttttccaagtcttgccctgtcgcccaggctggagtgcaatggcgcaatctcggctcactgcaacctctgcctcctgggttcaagcaattctcctgcctcaccctcccgagtatctgggactacaggcatgcaccaccatgcccagctaatttttgtatttttagtagacatggggtttcaccatgttggccaggctggtctcaaactcctgaccttgggatccacccaccttggcctcctaaagtgctgggattacaggcatgagacaccacgcctggccggtagacccaaatcttaaagcacatactctactctagtggttcctaaactttagcatgcatcagaatcatttgtagactttgttaaaacacagagttttggttacactcctacggttttttaatcagtaggtctggggtggaggctgacagctagagtttctaacaagttcccaagcccagctattgctggtccagagaccacactttgagaaccactggtctaccaccaacagtgttcaatagtatcacctgtcttatatcaaaggaaccactaatgactcactcgcactcagccctgtaacctcatccaaagcagaggcacagaaaaggccaccacacacacaaagaaaaactgtttacaaaatgtttttattttaaggttaagaataaaaggagccttagggttcatataatctaactacctcacttaatataatattaattaaactaagcttagagagggtaacttgcacacagaaacaatgaaacaatcaatagaacccaaaccaggaaccccagcagcactactctcaaaatcgcaaacgtggagtcctagaaaatctcctaatttttgtcgtcattagagtcacaaggctcaagagtctgcaactggcaaattagggcttccccttctggtcctccatgccgaagcactcaggccatgccatggtcatttcttagtaaggctatgatggaagcaattcttggttccctccaagttcaactgtgagtccactgcctagaactcagaactggttttctcagaaatcccatagcacacgtggagggttcctgggagaactcttcctactaggcaccacattgttgaactgcagtgatgatagcccacaggatctaaccatcatgaagaatataatttcctaaaattccattctgagtttcaacttggacctgtgctggtccctcttcctggaaaactgctgccccagttttctcatgtcaggctccttctgtatgtttcctcttgcagagtatctcctgatcatctacccaagtagttctcactcccctcctgccagttacactgcatctcatcagccttctctacactccttatagccctagaactatataaaacatttgttcatcatctacttgctcattaccccctgaaagtaggatgtgagcttcgagagggcaggaactttacctttctgtctaccactataaccgcagcacctagaacagtgcttgggacacagcagattctctatacatatctgtctaatgaacaaatgaatgtacagaagaatgatgagagagcaccttcttcttcttcttttttttttttttttttttttttttttttttgagacagagtcttgctctgttgccaggctggcgtgtagtggcatgatgttggctcactgcaacatctgcctcctggattcaagcaattctcctgcctcagactcccaagtagctgggtctacaggcacgtgccaccacacctggctaatttttgtatttttagtagagacaaggtttcaccatgttagccaggatggtctcaatctcttgacctcgtgatctgccagcctcggcctcccaaagtgctgggattacaggcgtgaaccatcatgtccagatgagagcaccttctttcaacgtggtttccaaagttggaatttgagactttccttcctgtttctctcattttcaatagtaggagttagactactgagctttaatagaacgtggaaggagaaaaacgtgcccttaggctggtgttctcaatgacaggacagagaagaggaagttgcagggattgggggtggtgtcgatttacttctcagctctggtgtcctttcgcacagaaagcatgctggtgagtcaggtcttcctggatacagggcttgggaggcaatgaggtgtactggaatgagatgtttttgagaccaaagagttgggttcaaaccctcaaaaagtcatgtaaatctctctgagcctcatggggctggtagaaaatacccaagggatagggtgtttgtgaggatcaaggaagttaacatatgtggacactctctgtaaatagtaaaataatataagttgctattaaatgattattgataagaccacataggctctggagagatccaaataggtgaaatttctcggcatgcatctccattcagtcttgctgttttgccttccttagttctaccagcactctcagaccccaggctgctgcgtgggagccccggctcaagagcagaagccctaaggtgctggcatgggctcctcagagccccgtggggctgccagcagccacagcacagccatgagcagggcagccaacaggaagcccaggagaagaccactgtgagaggccacagagggacacagggacaccgtcatcggccctgagccaggggcaggtgtaagaaacaagccggaagccctcacttttggcccaaatgctttggataggccagaatcccagagacaggaatatcagagaagccagcttccctcttatgaccaggccctggcttcttcatgtccttagggtgggttctacactccactcccaaaagcagggcctatacttcttcccttgccaagaaggtggggtggatggtattgggatctttggatggattcccaagattggagaaggtctcctttctcagtcttcatgggctgcactgccaatttctcattgaccaaactttaatgttccaggcaacgaggctcttggctataaggtgtcctcatgttacagaaatcacctcctctgacccagttactcccaaactgtttccactcttccttaagtgataaccttaatgacaagtctcatgcaaacagtaatttcttatcctttcttccaagagttcagttcactccagcaactggctactaactacttacagctgagcacagatttcacgcagaactgtgtaaagttgtccttgggaagacaaacacagcagccagttcctgccaccaagcagcacacagtctgggtgggaacagagacttcacgtccccaccacgaatggctgtgttttagagttcattacctgaaaagaaacagggtgggaggcatgtggggaataaagtgagcaggctggaggaggtcttcttcaagaaaacagagactggcccagctctcttctggctccaaaatgctgtgtttattgggttgtctggatcagaggcaaattcttggatttctgacaatgttgctatgatgtaatgagggctagaatcttcttgaatcaggaaagtttcagggaggttctattagtctgttctcacacggctataaggacatactgagactgggtgatttataaaggaaagaggtttaattgactcgtagttctgcatggctggggaggcctcaggacatttacaatcatggtgaaaggtgaaggggaagcaaggcaccctcttcacaaggtggcaggaaggagaatgaaagcaggaggaactaccaaacaattataaaaccatcagatatttcgagaactcactatcatgagaacagcatgggggaaactgcccccacgattcaatcacctccacctgctctctcctttgacatgtggggattatggggattacaattcaagtgagattttgggtggggacacaggcaaaccatatcagaggtgttatatagtaaggagcttaaaaaacagaaggatttcaacgtgtagaaagggagaggaagggagttccaggctgagaggagtgagtgagggaaagtaggagtgaagagggtacccagaaactggatgatccagcagctttagttcagtggggtttgaggcacttgggaactcaccaaggcgaacctgccacaagctacccagggtctccacctgccaaccttcagcagcggctctaggctgctgatgccagctagagaagcctgtctgtaaatgatgatgaatgtgtgagctcaccaagggagaaggccagaggagctcacacatcgaggagctggctttcaagggatggggaaagaaaggcaccagagaagcagagcgaagacgtggaaaccatagagccttactaagtgtgttcactcacccggctgtacctagggccacctgttgtcctcttggatggaggcagatcggctttctctctccctctctctctccctctctctgtcccacctcctctctctctctctctctcagttctgggctgggacagggaagaacagcaggactctattacttcaggcaaattttgacagatgggccaggacctgcatacagggccacccagcaggcgctggggaagggagcctgctaaggggctgactgcagagccaggcccaggtctgaagggccacgggtgcctggtttcaggttggaaagggtttcaagttgggcagggttggcaatggagcatcccactgaaaacagaagagcctcacccccaccccactgactcctgttcgctcacccctctgagcttctgcccatgccgatccctgtgtctggagcactgctcagggctccctcttggcatattcttgctgcacttttttttttttttttttttttatactctaagttttagggtacatgtgcacattgtgcaggttagttacatatgtatacatgtgccatgctggtgcgctgcacccactaatgtgtcatctagcattaggtatatctcccaatgttatccctcccccctcccccgaccccaccacagtccccagagtgtgatattccccttcctgtgtccacgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaaccgtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttcttgctgcacttttaaaacctgcttccaaactcaccttctccatgaattccctaactcttgaagtcaaaaatcgatcttttcctcccctatacactattctcacaacacttttcatacacaaaaatcagatatggctctatctcccccactggaccatagaactcctcagattagaaacggcactagggtcacaaattcaaatgctcacagagccaggcagataacataaatgggtgaagctgctggtttaggtgacatgggtggtaattgtcttggtgatggccagacaataggagtcactggaagctgtgatgaatcagaggggctggaatgattgattgattgagacagagtcttgctctgtcatacaggctggagtgcagtgatgcaatctcagctcactgcaacctttgcctctcgggttcaagtgatcctcctgcctcaccctcccaagtagctgggactacaggtgcatgccaccaaaggggcctgctgcccctcctgcccatatggagaataccagagcatgggaatgtgacctgtattaccagaactgcaattttcagggagaggccaggtatctgcattcttatatgaaattaccccatctttatgtgtcagcagcaaatccaaatttaagacaccatgttgcaagccaaataaaatgcatctgcagccagatgcaatgaaagcttgttgattgaaaagcaaatgaacaaatgaatgaaggaatagaaaagaaggagcagatgggtgggagggggaaacaggatgggtgcccaagtgtcaagatgccaagcggtgggctgggcacgctcaaggtgaccccgttgccaagctgtcagtgtgaacatcagcacggtcttgcttgttggctaaggggaagagaaaagcctatggccctgtgaacttagcaaccagcttctccaaaaacattacaatcagaagctcttgttgcagccaaaacacaggtgcagaaaacaagcgggcgttcgcacatgcacgtgcacaaggtgtgcagaagttgaaggctcagcatgccacaaattccgcactccctccaagcacaccttatgcctcatgttacagatgtcttgagggaggaagggagggacaatttagcaaattgggaggtgcagcaggggaaaaggagtcatccagccagaattctccccatctctacccagaaactccctctccttgctttgttgacggcgctgaagcttgggggaggcataagtgagcctggtgtgggactgaccctcagcctccaggaacactatcggcaggaacacagcccgtgtgggatgcctggggttgcaaaagaaaagttatttcaggttcaactgagttataatttattttttctaactgatcattactgctgcggctctataaataaccacctagggagtctgcttttctgctcccaaatcctcaaaaagcattgccaggttctctgtggtttctggcctgccaagcacacagcacatttcttttctgtgcagcccttcagggaatccttctgcagtgcatgccaaggaatctgctgagttctgcccaactcagtcctccccttcctgatccaattcctctcctccaaactggccatccagccctcctcccccattccacaagaggcccctctccctggacacaggtggttcccaagccaaggtcccggcttctctctgtttactctgcttccatccaactgcaaccctccatgcttagaagacaagagttatttgtactacagaaatccagctgtggcatcatttgaggtcaagcccaggaagaaaagagggttggtctgatggtatcaccagtaaaatatcaagggtcaataccaccccaggaagggtggctgtggtttacatgaaatcaatttaagtgatttaaagaagaatgtatttcaagtacaactcagtttaaccaagtatagaaaaaaaaaaatcatgttcctgatgatgttctaaaggatgtacgtttaggccctttctaaataacatggggttttctccttaaacagaggaactagacgggaactaatattcatcaagacccactccacaccaagcaattttgtttcattttcacaacatgatgcctatgaggtatgcatcctcatgcccatcttgtagatgggagtcctgagaaaaggacttgctcaaagtcatgcagaaggaaagaggtaggggtgagactcaagcccaagtttttcccctgctacctcctattacctctctaagctagaagactggagtttcaatgtatgtttatttttctaactttcagattacttttgcagctcagaaagcaaggacaacctggatatttcaccacagttccttaacagccatataactctttggagttagcctctccaactagttaactgtgaaatctcaatcaatcaatcaatctctctctctctctctctcaccatttattacgacaatgaccataaaggctatggtcattcaggttgctttaatggtctaaaaatgagagcttatgtatttttgaatagttttaaaaatgatcattcctaacatttacaaaataatggaaaacataagttttacccagtaatcaatgctccacggaaggttaggtggccctgcagatgctaccacagcactctgctctgttgggacaccttttccaccatattggaatggactgtttccttgtctgactctccttctaggccggtgatccccaaagctttttggtcatatgccctaacaataaacatttgagtgtacctgcctatgtgcacatttgtttatttataaattatattcatgccctgtcattcacaaaaatgggaaaaaggatgagatgtgtgtgggtcatcttcctatgtgtctatctacttctcaatcataatttcttcctgccccacaatggaccatctcaccttccatggtctccaacaccgacatcccactttggagaccactctcctaggatatgtgctcatcatccctcatttattcatttcccactgtctccagtaacacctaccctatgctgggtactatgctaggtgctggggatagtgggtgaaccacatggacaaggatcatgttttccatagagcttacaatccagcgggtgaaacagtgtcagataatgtcagagagagaaaacagccacaagaaagtaaaacaagatgatgtgatgttaagtgatggagaatgtctacaggggtaagagggaagtcacgatggaccagaccagcagctcagcaaaggcctctgtgacctgcatgaggagggggtctagtgggagagggggtgcctgggcagacagaatgtcaagtgcaaagcttccgaggcaggaaagaaggccattgtggctggattataatacatcagtaagaagagaggctggagaagctggagaggttggcagctcaggctggagagtcctgaccccactgcttactggctgggtggccttgggtattaatgctatatgctgcccagggttattaaaggaattatgtaaaggattgaaagagtaaatctatgaaacatcaacatcagttagaagaatgcccagcacacagttggcatcaacaaatgactgcccctagggtctgtttacttatttatcattagtctcccctgtggcatggaagctgggcctggccagttttctaccctgccgaaccagagtagctggcaccatgcccagcctatagaaagaactcaatgaaaatttggtaaatgaatgggttttaaaaatgggtaatggctaaggaaaatcagaatttggctaaatattaaaaaatagattttcgtaaacaattttttctaattataaaagtaatgtcatgtcttcaatattttaaacaaaaatggggtcatattctacataccgcttagtacctattttccactccacatgtctgttacaagaggcaggagaatgtaagggtagggatgtgggctctggagacagattgcctggattcacatcctacctccaccactggccacctagagcatctctctgaagttaccaagccaaaggacatttgggatttttaaggctttttaacacatattgccaaatagtctttaagaaataggtgtgagcccatctcctcaaaccttcatctacgctgactgctaacctttagacaatctttgccaatttgttaggggaaagaacaacctttcattgttctaatttgcctttctttaattaccagggatgactaacagtttttcatttgccttgttcctcttgcgaattgcctgttcatgtttaaaaaggaagcccgttttcataattagatgcagcagagtaggtggcctcaaagtgaactccctaccgctgggaagggttgagcagggccaggtggttgcccatcagggaactgggcatctctgtgccttgtggacagcagaactggatgagctctgaagtcctttattacactgggatcatttcactcttgtccagaccagcaaaggtagcaggcaaacctcaaagaaaagatggcttgcggatcaacaactggattctgaagacctccaccaggatttcccaaggtggatttgatgcctaaacatctctcataagcttctgcataaagacaccccagttatatcggagagaagagtcaaatcgacatggttatgcctctagtagctacagcatgccacagtgggggaattccttaaatctcccccttgacaagatggaaaaccttcgtggtcatagatcaaatcctaccacaacaaacatgttcataatcaaggtcagcatagcacaaagactcctaaggtggggccagtggtctgtttatctcaagctataacttttttccctgctttgcatttggctttggtacaagaatttgacataaacaccctcctaaccccactcccctacaggtatttacatagcaattttctcctgagctggtcaaaaccctgctaggacttggagaattccattgtgtttgtagtaagcagacacctggagccagatagctcttagagaataaactattcttggattggaaagggatctgaatgtatctgacgccctccttttgcaaaaattttgcagtgttttcagaggaccttctacattttcactaaggggatatttccccctaatatctccaccattgccattgttggagtttcctgctgggtctggcccccacaggtataatgccagctggaaacagaacactcacatctcttaaattactccactaacgaagaagtcacacgtggaattagaattctggctaattttcctgtgggcacaccttaagcacacaaacctgaaagcagcagagcagcgaaactggcagccaaaataaagcaaaaagaagaacatcttccaggagggaggtggaatcagattgaggcaaagccaggactaggttcttggcaacgtgattaaaatcccgaactacgagggaggagaggccttgctgccagcccctcagcacactcgagccagggcactggaggtgggtggtggttaaaagctgtgtgccattcacagcctatagcactgcctgtgtccgtcagtatgggcagaatggctaatgactccaaataaaactcctacaccatgctccatctggggaccatgttatagctgaatacacaaagtcactttgtagcttgcccgataagtccactttaattcctccaaaataattcatggaggcctgtgagcacactgcaccaggccaagcactagggttataaaaaagaaatgaaaaaagaaaaacctagttgctctactctaagggcttatgatttaaccaaggagatgagattcacaatggtagctggcaatacggtaaatcaaggcacaaagaatccaggagtgtgttctgctagaggcccaagagggcagctggcattttcaggaggatgcaggtcagcctttatgggaaaatggattgagtttaccttgaagggtggggaaattttaggcaggtggctaagaagtgagctggcctctggggatgtggggagactgtgagcgccgcatgagacaggctctgcatcctgcacatgctgcctgcatttccagccctgggaggaggatttgtgcaagggaggcagagatgagagcgttgataggaaggaaggaggccagatttcagagaggtctgaatcccacacagagaagcttgggctttctccaataagctgcagggagcagttggagacttgtgaacagcagattaacataattaaataaaaacttcaagactttagctttttgtggggatgcagactagacgagaggtgatgagaacattagaaagcttttacagtgtagaccaggctggccacggtgttggcaacgggagagaaagaaatagatctggaagataccacaaagcaaatatctaaagggcttggaaacaaatttggccggggggcggatgaaggatgagtcaggggcagttctgaattttaaaacttgggggatgtgaggtggaggtggcatcgtcagacataaagacacaggttcgagcagctttacaagaacttaaaaaggccagaccacccaaaggtggcactgactggaagcacgaggctacggacaatgcttcctcatttcaaaggggagttaacaagttaagtgaagttttatccaccaatgaaatggctgtctgtccaaacaaataagcaacaagtgtgggctctgcactcctctccacctctcttgctccttccgttgatgctcccctaacatttatctgaccataagctaagagcagtcatgagaacaagatagaaatcctcagaaatccagaactctaatccttccttctgctgaaatactgtagggcttagttattttcacacttatgcatatgcttcagtgtgtaagaactgagtcattgttttcttttctcctcccctctcccctctctttccctcctctttgccacccagcacctcctctgcctccacccccaagccactgcaaacatcctggcatgcatctctccccatccatttctgcatggctgtcaacatttcccattccctccaagcttgcctcctgcctcctatttctttagacacactgggagtctaagaaatgaactacagattcaacaggactgtggaccacagatcttgacaaagacaggcagcttgttgtgaaaagagaattggagggcaggtcagagacttaggttttaggagtcaggcaagggaatcagataaagatccctgaaaacaagggatatcatcactgcccagctttactgacgtagagacaagttttctcacttggcagatatagacggaagataagcaggttccctttcagatggtaaccccaagtgcagtggctcacagctgcagttattctgaatggcagcgggagggaaggaaacaatgaatgcacacacacacaagagcaatgcttaaggtgaaatggacttgaacagtctcaaatgcacacctcctccagttcctggaaggcaaggatgagtcaaacagaagttgaatttcacaggcgttcctcctccactgtcacatacgttcccagacgcagagtcatctgtgcacatgtcacccagcatcgactgctaccagcaactgcctcctgggaagttaagctgcagggtcagatctgcttctgctggggagctgaaagtaaactgcgtaaggtgggggtgatcccagtaatgtgagggcaggaaaaagcagagaacgctggaaaaggatggcaggaattaacatggctctgaagagaggagccaaggatcacctgatctgtagagcctggaatctgcagttatttctagtttcctagacaaccctgactaaactaggaagacatctgaactccggctcaaaaataatataggttcttggaatgggacaaaagaagaaaggaaaggggaggtgataccatgtgccagttcagggagtggggaccagaccttcagagaaaggaaggtcttcccaaatggaagctgaaatcccagtgggcattatgctttctgtacttttgcatttgtagccaagagcatgattctaattctggttctccagcggaggtgcgggcagcacatgtgcatgagttcgtcaaaattgatctaacggcacacataagatctgtacatttcactgtatgtaaattagatcctagtaattctacctctctcaattagttggttgtgtgaccttggacaagtcatttaaatttttgtagtccaggattctccatctgtcaagctgaagctaagaagctggcctctaagtttctccctggctctaaaatttacgattgtgagagctgattattgcaggaaatgagcaaatacatccagattaagaagggccgcaactattgatagaagctaagaagaatttctgaatgggattagccatctgcagaaaattccccctaaatcatccatcctggaatcagacgtggagagaggtgaagattccatcctctgcaccaaaaggaagtggcagcccctcctggctctgcattttcccctccttcccatccgctctcccctacagactctctaaattcttccactggagattccccaagggctcaggattgggacaggccttttcttcccttccttccaaatttcctttgggtttatagcaccctggtcgggttcacaggaagggaaaggagagggaagaaaccattcacatttgggtgtgcgtagcaagcagagagctggagggttacagaaacttagaggaggtcagagccagacaatcatctccccatcctatgtcttatggataagaaaatgaagatgcagaaaactagtgtgacttctcaccatttctaaagccccggaaagaacagatcaaggaggcagctgtggccatcttcaggctggttctttcacatagagatgctcctacttactccataaatagtttgtcatgggcaactttcagacagaggagctggaactaccctaaccgggcactggaacatgtgtaagtagaccacctggctcacctgtttctcttctcagaggggctctgagtcatgaggagaacctctggatatgcagaatggataaactgcttctgtcaggatggaaaggaattcacagatgtcttgccagcagctaaccagtgacacagctgaatggtagcaggcccatggaaacactctggataagaaagactatcaaaggagcatcaggtccagattgcaaattgctttagcagctaacataggcataaagacagaacgacccactctaatccaagggggttacgcttcagcgctggctgcctctgactctcacccttgacccagcccattcatcagtatgttgataagcagattctcttcacagagctccttaatctggtttcccagggaggtcttgcagagattaatgagagcactgtgcttcctgccagtttttgaggctgggacagttaaacagcaagggtgaaggagcttgtcataaagtacacaaaccatcccatcattggacttgaccccattaggtggttaactcaaacatcttctcaatgtagacacttggatctattttttttattcactctctccttggtagccagcaaaattaaagcccttcctcatatcatcgttcacgccatcttttataatagtcacagccacaacagcagctggggctaaacaaagattaggagcaataaggatcagatgggacagacaggagatctggtcctaccaaggggcatcaccaatgagctggacccactgtgcagcccacctgtcaaatgccatttgccacctctggcggtgatagcaggggcagctggggctgaatccatgaatcctgaggtctcacagaagtacagccacccctgtcatctagcccctcccctcagaatatgctctggggagctgtcacatcccacactgcaggctgatggaagacacagacacactcttgggtcctggcattatcgctgtttcctctggttacctttaaagaagggcgtctctgagtgctgggtcctccactggaaataatgtggggaaactggatgagctctgcagagatgagaattattttgaagcaaagtaagaaatgaccagggaactctagattggaatacagcttgtgaattcctaggtaggtgtagactcaagagtttataggaacttatatttgctgttattttttaaaagtcttaaaagttaaaatttacagcaatagcaagaaggaggacaaagtgcaacagctttaactatgagctaataccaaggttaacactatctgtccattacacgtagctttgggatttggcaaaaaggaaaaaaaaccacataacacggagctttgagctcataaataggtcccaaagacttgacaaataaactaacaaggcttttatggtagaagggagcatcgaaatctgaggccttctgtgccttctctccccgctgctgtgatggcagctggcaactgggccctactgtccattaacaaaacagagagacggataactatccagccgaggccagcttcctcacaccaggcagatccacagtggactctcaggaatcttcagcaccctttacaccagcagtggtcaaagtggggggtgcagctgccttgggactgagagatggggatggacacatctgcagggaggggtcaggctctagcccctttccccaggccaccactcctcagaggctggtcctccaccccagcttcagggacaggggatgcatggtggaaaccactgcagctgctgcattagcaaccttcaagagccaaagattctcttctctctagccagagagggaaggcaaacaggttagggtgacctgcagctcagggtcggccccaggccaggccactgcctgtactgactcctgggcctctatgcagtgcactccactttctagggcaggctgcttgccaaggattcacagtggacctggctgctccctgtgggactcactggatctggacccaggaccaagcctgcttgccaggagcagaaggtcaggttggtttaaaaaggtaacctctgtcctttcccagttccgttcctttctcttccccagctacctcctcctcttctccaaatcagccttctcttggctcagtttctgaccttgggtattttccccaaggaacacatccgaccatcaggcactcaaaggagcatgagcctagtcttttcctcaagcaaatcaccccggtacagtcagcagctgcagagcacagggagctcctggcatgctaaaggtcatttacagatcactgaaaaatctggacaagatgctaatgtcccagctcaatgcccatgtcctgacttaaaccttgactgtgtcttaaggacactcaacgtcaggatacctatgacagaaagagggacttctgagtatttcaggcataacaggcaaaacagacatctttaaagcttgcaaaatatatgattctgtcattcctctgcatcctcaccaccaccatgatggagagccagggccagtctttccaatcatcactcaagcttccagtggctattgggcactctccctcttagagaggggacactccagcaggaactccaggtagagagctgttctgcagtgggcatttctagctcagggccagcctccgagactctccaggagtggcatgaaatgaggtggatggggcttccttgtcctggccatcatgtgcctacagcaggcattggcaagctttttctataaagggccagaaagggttatggaccatcttctttgatgtttttattttacaactctttagaaatgtaagaatcatccttagtttgaggtgccatataaaaacaggcggcaggcaaatttggctcacaagcaggctgcagtttgcagaccccctcctagaggaagatgctgaggcctcaccaagcagcccctccccaccttccctctctagcctgactcctccagactcattccagctgcacgtggcacctgtactaggccgcaggatggccttcttgctgcaggcatttcaatgagaaaatatgctgcatggatcatgagtgattctgtctccctcgtgcttaaccttggaagcacaaggccctgctggcctcacctcaaggtctcacctgcccatactcatgcgaccttgtccaccatctctccactacgaggtgccatctggtaaatggcctaacttgggttcttcctcccacgcctcctgtgtaggttcagggcagggagaccaaggtaaatcctgtcagttctatctgaaggcagagcctggatccaatcacttcccacccctccaatgctatcacctagaacacagccacagcctcccatctggactccctgcttcgatctctgccctcccccctccccttccaaaagctcccagaggctttccatctcactcaaaataaaagccaatgtctctgagcagtgaaagccacccaccatggtcatccaggtcctatcactgacctgctgagccccaactggcccgcatggccacctggctggcctcagtgcctcctctttcccctagctgatactaactccagccacactggcctccttcctaccctgcttttcctcttagccatgaacaccatcagtagttatataatagtttgtgggggtttttttttttttggtcttgtttttctcactcaaatataagctctgtcaaatagagtctgacttcagtgttacactccagggcccagtgtcagccttgggtaggtgctctacaaatatacaaatatttggagaatgcatggggacaggatgccctgctgatgggtgagagatggtggcactgtcatgacactgtgtatcaatttgcacttggatacttttatgcaaataagtctcttgctcttaagtcccctcctcccccgccttagtagccagatgaaccgataagacactgaaaacagatacacccctggagacactagtctccaattttttgtttatattcaaccctaaagcaataacaacaaactcatattccaactgaactagtcaattatctcaggggaaaacaacaaacgattgctttatggtttagagcacacctgtgcgtggctctcccgcactcaccacaaccaccctcccatgagcacagcaaggaaagagaaagcatgggcttgctcagcagaggtctgggtttcaaatcctgacactgccatctataggtggtctgattctggacatggtaccaagtacactaggccttagctttaccatctgttaattggggatactaacacttatttcgtaagactgttgtaaggcttaagtgaacaattaaaacaaaacagacacctaaagcataatgactgtgcacattaattgctcaataaataggaatttctccccttttgtaagtgaggaagcaacagttcagaatgtgaaatgatttgcctgagatcagaaggcttgttcccagcaaaggtggggttcaaagcaatggtttctgtggatgtattttttccctagcatccagcctccttcctgttcatgtctacaccctataggctacttatgtcagtagaataaaacaggtgatggctctcccatcgacctgcttgttgaggattttgggacagttccattctaggctaatgctcattactaaagacaatgctcattaataaagacaacgctcttaaggaggtcaccccctcacacggagaaatctgtgtgtcacaagcaagggatcaaaaaagctaagagaattcacctgccctggatatcaactgcccttaagagatgcaaactaaaggtgactgccttcctttccccaagagacaaacggaaaccccactcagtgtgagaagagcacatgccatggaggccccagaccagtcagtgcccagtgaggagatgacagagcctgacgcagctacatctgagatcagatgccaaggacacagcaaagactgatgaagccatacgtgagacaccaaagtacgaaactcacattcaactcaaaggtttccatgtttgatgactgttatctccctgcacagtgtttttctttaaggagcacatgtgttctataatcctataaagtaaatttttgaaaaaaacaaaatgagaaacaaagggacacacagaaactcttgcaggtgacggatatgtgtattaccttgcctgtggtgacagcatcatgggtgtaagcatatgtcccaactcattagactgtacacattaaatctgtacagttttttaatatcaattataacctcaataaagttgaaaaaataaagaaaatttttgtagaacaaaagccttctcccattagctttcatcatgacattgaaatgtgttcctcttgaaacatattggcccctgacattataaaaatataaattattaaggaacaaatcttacaagtaacacgtttggaggacaaacaataaagagatggcctaaacaatgtctaaacagatttgaaacggagcagaatgtgagtgcgtctgactaaaagaggaggcttttctcaagtgtcagtcctgagacaaggaccctgggactgctgacatcccaaacatagtgcccctatgactccaagaagggaaggtgctgcaggggtgacggtccctccccaccccaccatcctcatctggctgatccctgctcatgcctcagaccttagctgaaatatcacttccccaaaaaaagccccccagcactagattgggtgactcattcactcattcactgagtcatccattcaacaagtgattactgaccccctagtatgagtcacattcgacttatcactctctcttttcaacgttgcaattaaataatcacacacacaatactgatttactgtctgtcaccctccctaaactgtcagttccaaaaggacagagattgtatctgatttgtcatttcattcccagcgcctgacacagtacgtgcaacatggtaggcatcctgtccatactggccgggtgaacgtacaaatgaatgaattaaagcatttgaaagctccattcatattctaaaattccaaaatgcaccctgctgtctactttacacagggataattgatgttacaatcaatatgacttttaaatttaacaaacgaaattgttttatttattaatctactagtaagtgaaaacaataagatgtaagacaacaggaagaaagttactctccctgagaggacagaacctgcaggtgttatcctgggactggcagaagcagcatagggtcatcgctgaggggagtgtggatagagtcaggctatctgggttagggtcttgacccctccactgaccagctatgtgactctgggcaagcaacttaacctctctgtcttccagttttcaaatctgtaaattgagaataagaatatcagcttcagataatttcattaacaagtaaatggattacgacacgtgaactgcttagaacagtgcctggcacgtgctaagtactcactaaatgtcagttgtttttattttctggaagaatgggaacaagatgggttaaaaccaaggacttggacatactgtcactaaattcacaaaccactcagaccaaatctccaagatttcctattacaaaatgaagtaattcaaaggcaggtggctggatgggttatctactccaacttccagacttactgctttacctatagaggtgatgatgccttatccatctgaaattaagggccaggtcaaacaaaccctcaaggtttctccaggactggagtctgggatttgattttatacaccccacagtgcccagcacaatgacgaacatgcatttaaagcttagaaaatgttcactgtgttaatttacaatgaataccatttaaagctaaaaaaaaaaaaacccctgcatattctaaagtatattatctagcatatgtgctagccccagaagaataaaatgcagaagtgaacaggagttgcttcatggaactgaaattaattatacacaattatctctgagatctttaaacagtaagtgaacaatgaaaatgtagattcagaattctcctggtaatgaataagatgatgaacatgtttccacagagggtgggatcaggttgatctgctgaaataaccagatagcaggataatttcactatctacgtgaaacattatccaagaatctgtgcgttactcgacaattaaatcagttcaaatgtcttatcaatgatttcatagaacaaccttcaatgagttaacaggaacccgtagataaaagacaagaatagggctacgtcaagaagctcaaaatcctcagctgctgataatgcaaaaccttggccacattgatgagcccaagaccaccagatctctttatactgagtcattttttaaagaaaacttttattttatatgttagttttccttataaaaataagttgtattgaggtataatttatatacagtaaaatgcaaccatttcaagtgaacagtgggttttgacaaatgtatatacccaagtaaccactaccctaatcaagatataaaaacttccataatgccagaaagttccctcatccttgataaaagaaaaacttcagccgaattaaatttaaaggagtttaattgagaaatgaatgactcgcaaatcaggcagcccccagaatcacagcaggttcacaaagactccaatgcagccatgtggtggaagaagatttacagacaaaagaaagggaaatgacatagtacagaaaacggaagtgaggtacagagtggcgggattggttacaagttggcatttgccttatttgaacacagtttgaacacttagcagtttataaatggttgaagtatggccacagggattggccaagacccagctattgttacaggcacatactcctaaatcttgtctacctattaagctaggttgcaattcatccacaagaactcaaatatagaagtacggagtccttctcaggccatatgcagtttgctttaacacactctttctcggttaatccctgctcttatctccctctatcccaccccaaggcaaccatagttttgacattccccctatagattagttttgcctattctaggatttcatgtaaatggaattgtacaatatatatatacttgttgatatctggcttctttcagtctaatgctttgaaaatccatgcatgtttttgcatgtgtcggtagtttgttcctttttattactgaataatatctatttgggtggactgcaagttgcttatccattccccagttgatgggtatttgggctgcttttagtcttggactgttttgaataaagctcttatgaacatccacgtacaagtcttccaccaacatatgtgttcacttctcttgagtaaatacctaggagtaaaatcactgggtcatatgctgtgcatgtttaactttctaggaaaatgccagatttatcctgaataacagaaatgatcaactgatttactattaaaggacttactggattttataaggaaaagaggaaacgagacgaaagaaaatgtagtgcatctgaaagcacatgggggctgctttgctgaaggggctggcaggcggcttcccaggcagggtctgctcaggactgctctagccagatgcctcccctggtgtttacttcacccacaggaaaatggccaccttcaccccaccttcagtggacgtgcagccccttcggtgctcctctcttcatctgccttcagaggtagtcctgattaacctgttgccagcagaattttctaggagagacaggacttgggggtaccactaggccccggggacatgcactcagctggcccaggcaccgataacctagcatgtccttttagaatttgggggatcccggcacccactgttctcagctttgggcctcagctaaggccaggacaagcatcatttaatgtcatgtcatataattagtatggaaactacaaaaacctatatgtttacaaaacaaccactgatctacattatttcagaggtaatgatacttttacatgagataacttcccaagacactaagctgaaattagataaatttaggttttctgtattctcgctgacttgtgtttttcacactggctttatcttggtttctgagggagaatcaattctctttaactctcttccagaatacctcactaccttcagaaaggaagaaggagggaaaaaaggacagagggaaggaggaggattagaattcctcatatcagagaatcccagagctttgaagctttaaagtgaattcaagagtgggattcaagagaccaaaccatggggtctaggggaaataaggaacccctctcccagaaggtggagaagcttctcaaagcaactggcccaggcagccttgtacttgcttcattctggggtcaggaagaagctgcaggccctccttcccaccctcgcttcccttctcctccacactgtcaactctgctccaggaaggggcagtatccccagtgtctgctgggccagcacagccatctctcacccacctgagttcataatgactcctgtgtagagcagacttcccttggcttcactgaaaccattccttcttgtcttagaaagcaatcagaaatatagttaactgccttaaagttcccttatcattgaaatgaactagatcacagaagtgcctatttgcattttttattcttattcactgggtttttaaaaggagccaagagaggggagaggaaatgcatttacttgctgggatttcacttgggatgttcatgttcgtctggaaagcaaaataaaggcatgaagattgcccactgatttcctttcatttggagaattctgcttgagttaggcttagctggctagcacataaacctgtcaagagaaaagtcttcctcttcctgggcctggtatgtctaccacctggggcttcagagacagtattctaggagattcacagtgtctaaggttcgaaatgtggacttcagcagcagggcagctgccaaacgctttcctgcccttgcagaaagccaccaccaaactcaccaccacctccctcaccgtggcctctctgtttcagtatctgagcagcgggtgaggaggactggattctagaagataaagagagactccacggtacagaaagtaagccctcaataggattctattagaaaacagctggaaggaactgtggagtcactcagtcccatggctgattttacagacaataagcaaacaaacaaacagaggccctgagggatttagttagcggtctccaagtgccagtccctgaggaaaggattctcctccccagctacctttcccttctccagtgtgtccacctcaggaaaagggcttgcatcctcccagctgctcacacacaacttgggctggccttggtgctggctctgtcctttctcccaccagatctgccttccgccctcgccacttgtctctgcccagggctcacttggaaggaccacatcaatgaacaaccttggcaggtcacagggagggatggagcgggggagagaacagcaaataggcttctgccctgcaagagagggagagccagaataccagcctggcttgggctgctcccgaaggtcctggctgctgcctgcaatgcagcgccttccttcagggctccagcaccatcccctgtcctcagcctttaaggctctactgctctcagccccagccctgcccttgaggctcccctgtaccctgtctttgtagatggtgcctgggaactgtcccgcttggagagtgctgtttgctaggatacacactgactcccatggctcccctccagctccccatccatcctgctcctggccacggcctctggcctgaagggctgcaaaacagccttccaactgggttcctggcttcccttctggcccctcttcatctgctgtccccagcagcatacagagctatcccatgaaatataagtcagaccatgtcatgccctggcttaaaacctctcaatggtttcctctggcatctccagtaaaaatcagaactccttgctgacttttgagagctgctctagacagggctgctctctgcagcctcctcttgtgccccgagcttcaggacactccagcagctgtggggcctcctttcccttactcatgaccccaggctctgccctgtctctgggcctcacacatgctgtccctgtgcctggcaggtgccccgtcactggtacaggctgtccccacccctctaggagagccttgccttagcagggtacatgccctgcaccttcttctctccacgaatttttattctctatccctggactgtgctcatttctttccaaacacctaacaaatttgtaattatgtgattttttgtttactttttaaatgactctctcccccaccgggatgcaagttccacatgggtacgaactaggtctgtcttgttctccacctgacatacaacagctactctagtcacatctacaaaacagcaactgggtttgggttcctataaagtggacaactctcctttctggggaaggattgcttcataatctgagattatgttccttctactttgttggggagagtgttaagttttttttttttttcttttatgaaaggatagtaagaataaggggtattcatcaaaaatttttaaatgataacctgatataattctccaaaatgtttttaaaatttttgagtctatgatatcccagattaagcaatgttttgggagtcacagtgttgggtcctagagaggcaaagagataggtgaagatagtgacagagaagagaccggctttgcagtcagactgcagggcctgggttcaagtcccaactctgctgcttggtagctgtcaaactctgagcgagttgcttaaactctctgtgccttagtttcctcatctgtaaaataaagataataatagaacctgtttcagaggactttataagaattaagtgaattaatacttgtaaagttaataaaacagtgcctggcctatagacaatgcttgacaaacattactgctatcattattatctattattattattattgctattgttattattactaaacccaggtctcctaaatccccaaccaggactcttttccctttaaaatgttatctcccagcattgtctctttaaatgttatctggccactcttaaatgtaagactgaaattcagcacttggaaaactatcccactccagccaagcacattttttgaatagctaaacactaaccctgataaaatgtatccatttaggatagaaatgtttctacaatatgttacatcttgtctactttctaactgggttttttgagatgagtatcattacagaaattatctgctgtgcagcctggaaacagcaaaaggaaaactcagcacgttctacagacgtgggttcaaagccctgctctgtcctccctccaagccctaaacccctcctgagtttcagtttccttactgaagaagtgggaaggccatgtgcattgagaggttactgtggttttgagtccagtgaatacacacactgctaaatcctaaaactcttctttcttttttggttaataatattaaactcatccaggagaataccttaatttaagactccaggcagaattctcctttccccaagctctgccaacacccaaacccctccccagaagacagcctggttcacacaacagaggaacagacccctcacgactctgcagggggaattcctttctgggagagaacacatgtccaatagggccagtccccactcaggctgctgctgtcactcagccagaaggcaggacaggcttttgaagctgtgatatttctgagtttggttttggacaaaaacaccattcttcctcatagcctttcacaccctgattcaagcaattttaactgaattctatttcccttcaatagaaggctatttgaagatacaaaaaccatatttgtgaatgaattctaggattgtatttgcagagtcactcctgttggatttcgtgctctataccaagtgtatttctacctctgggcctcagaaccatttctcacaccccccaacaatatctcatgccctcatatcccaaatatgcaattacctatcagttgtgaaaggtaaaaataaaattcatatgggtttcataggtcaatggttcatgttaaaggagacccatattaaataatattattaagtagatatttataaggctaagaataaaaggtggggaaatgggtgggattcatcttatctttctaatgttcattacctagaacctggaaaccaaatcaatgaattttctgactacagactcaacaaatatcatttgtttttaatgataatcagataatttaaatcagataatctaaatcaggtaatttagaaatatctgatttctaaactagtcctggactacacttacaaagaaacagcactgctatagagaaaggatgaagacataaattggagacaggaaacaggaccagattcagaacactattcctgcatatgagatttaaagaaatatacatacataattttacaactcctacaaagcctaattttatttgtaaaatataccagggtatcttagcaagtttctttggaaccacgcaactaagagtgctttttaattaattgcacatctagcaatccacaaatacgaattaagcaccatgagttggcactgaggagaatttaggtctgttctcccacagagcaagcaatttgcgaaactttgctctaaaacacataaaaaccctggccttagctaccaattttaaggatgttctattctgcaagggttcatcttcattctctccaaaaggatatgagggtcctgctgtatttcaatggaaccagacccccaaggctcagaaatcaatcatttcacaagaaaaaaagggtaagattatatctaaacatttcattagcataaatctgaatgtgtgatatttggtcattttgtcttagtttacaaccacctttgcaagtgataaaatatagattgatggtggggagagggtaggagaagaaaacaccacactcacatcacgggatctaaattccaccagcaggggtgggagctgaactggcctaacctgaatgtatgtacaaaagaattccttccttcctctctccctcccttccctcctccctcctcctccctctctttctaactccctcccttccttcctctccttcccccctccctccctctcttcctccctcctcctccctctcttcctaactccctacctttcttcctccccttccctctcttcttccctcccttccttcctccccatctcctgccctctcttcttccctccctccctccctcccctccttccttttttttcctacctttcctttccatcaacaagcccaggtgatggcagggataccgcatactccacttgtctcttccacggctggggatggctctatcagcacttgccccatttttaggttttacttcccaggtcatcccagatttataatccatgcataatgcaggcacctaagcacttctgggcccctactagaaatccagaggcgaacaaggcccagtgcctgcctgttctcaagtctccatgcaatgggcaccctagcggaaagaacacactctgagattaatctggcattgcaggggacttgcaggacctgttccaggtgcctgacattatctatctagaagaggtctccctttcagcacagttattgcctacatgaaggtggcctctctcaactgcacaggatgtgccattcgccaaggaatactaggcatccctccatcgtccagacagatctcaagtgagatgctcaatccctataagggttggtttcccctcagtggattacaacactcagatcccaactttccactgcacaggataccttgcagccatttggttttgaatgaccttctcttcccctcttcctgaaaatataagtttccttattgaagccaattaaagccaattctgctttaacatattctggagcacttcacagcatgctttaaattaagcaggaacaccctggtctagtggtactgcctccaaggcagtcctcccttcatctccctgcctccagccaataccctgcttctctgtctcctcagtccacctctgcctgctctgtccctggtttcctccacctagaaaagtgcatccaactgattttaagtacctctgacttaggggtaccacactgtgaaacctctgcttctatttcctcttctataccttgcattgcaagaaaatctaggctttttattcattttttagaaaaattagggaagtcacagcctaggtagttactagaagaaacaggcaaggccaagaaaaatagccaactcacatagagctcttcttaggtgcctagcatggtcttaagtgctttatagatactgaccattaaacctcaccacagtcctatgatgtagatattattagtgtgcccattttacagatcatgagcatgaagcccaaagaggctaattagcttgcctgggatcatcctctcttttttcttttttctgagatgggtctcactctgttgctcaagctggagtgtagtggcgtgatcatagcccactgtagccttcacctctcagtctcaagcgatcctcctacctcagcctcttgagtagctgggaccataggcatgccaccatgcccaagtagagatgggggtctccctatgttgcccaggctggtcccgaactcctaggctcaagcaatgcccccacctcagcctcccgaagtgctgggagattacaggagtgagccaccatgcctggcccatcctcttaataaatggtagggctgagatttgaacctaggggcctgactcaggagtgagtactgcttaccaggaagggaatgtggtcagcatgacaacaaaggcatctctgtcctccttaaatgcagcaccaactctgtaaacacacagcaggagctctagatacaccacgtttgtacacatttactgagtctacatttccatgtcaccttcaggaagagtggattggcttgggtgaggagaaggaagaagagcggagacttccgcccttgagagattctattttaatttttaagaaaacactgaacagaccaagccctggatttcaagatcagttttcgaggtctccagacatgaggcagtcatctgaaaaggaagacatgacagaggagtctgacctctgtgtggcctccttgctctccctgcactgccttcagatctcccagtgaataggaaaggaggggagacctgcatctgtggggcgagcatcccctaatcctgataggcttcaaaaggttgcgaaaggggccacattctctagtactaagacaatggcattaaatctaaatttcttgataaccaaactaaggcataaaggccagttaactatgtctagttctaatataacactctggaacatgccctgtgttatcttagcctagcttcctagaaatactgaatcgcaatattccacaatgcaagttcctcccactaaaggcctctttggagaaaggagttggctgtgacaaaggctgtagtatatagaggatgatcgttatggtggtgatgacaacagtgctgatagattagacaatagcaacaatgaccatgagggcaacgaagaccatgagttgtgcaacatctaatacaggtcaggggtgaatacttttgtgctgactgcttttcaagcattattatgttatatcttcacaacaatgatgagaggtgggtatcagcacaatgccccctttgaagatgaggaggagttagatgagaaaggccaagtctctggggcaagttgccataatttgggtcataacatgaacccaggccaatctgactccaaaatttcacattcttatccactgctcatctctctcttcctattagaaaaccttattatagaaagttctaaaaacgatatgctgattagtcaaattttctggtaaatacatagtaatcagttccaaatactcaattgaaaaaaattgccaaaatgttcatggtccccagtcctgccttagtaaatatagcacactaaatataaatctagttctactttattaatagacacatgatggactatctcccagctatttgccagaacaatctgttcttattgtagagtatttcagatgtaggtacagcattgagaaggaccatacactcagcccagggcatgctctgaaactacggtattaaacattaaaatctttttaaaaatgtgttttattatttgcctttttcttacaaaacttcagtccaaattatttgggttgataagtagaagtttcactgtagtaaactgtaccaatggctgcctgtggtatgtccagagtgtaagagagttgatgagaaacaacaaaagaaacaaacaaaaacttgaaaatataacaaaacttggcataaaaattaaaatgaccagccccctgatcctaaggaaagtccattttctcataggggcagtcagtatatttttatcttgtggcttaatgtttttgtagacacattaaatcataaaaatccaagaaaccatatctcactcccaaaccacacaatgtattttaaggaatatgtcccttttctaagaaactgcttgattttcaggaagtggtaaagtggcaggtgtgttcccatgatcagccagagaaaccaaataaacgttccactgggcaaacctgtttctcacagataaacagctgcgagctgcacgcgggagggaaaaggatcgtaaagactgcccctatgtctgcctgacactttctggttttctgtttcaattgaaaaggaagatggcagcctacaactgagcagaccctactgtggccaggccaatcccagcccctgcatgggacaggagtttcaaaatcccagcactagacagaaggctgtggtcatctctcctctaggtagacctgggaagggataattaaactaggagttgcaggagaagcagatttcccatgaaaaagacatcatcacacaattaatagctaggcttgataggaaggggaaggaatgtccctttttacttacttccaaggcagcctccaccttgcttctcataccacccatcacattggaaacaatcaccagtctgtatcctcagcagactgtgagctcctggaagtcccctgggcacataacaagcactcaatcaatgagaattattgttattacagtgtgtgttcaagaaatatctgttgagtgagtggaacagaggaaggaatgaaataacttgactttccatttggaaagtgtcttgctaaatccttgctgttagagttcaggagttgggataggatttcctatactgccactttggtttgtcatgttgtaagcagggttaaaggcaaatttttaaaaatatgagacagggctgaactggctttctgtctagaaattctagattaaaataagggtctgtctaggagcggggagccagctggctatttaggaggcttggaggttaaagcgaagtctaaatggagtaagagacactattccaaggggtcccctggtcacacagaaaatacaggggcagcattcagactacccaggagtctgcaggacttggtatgaaagagcaaaaagaaaaaaatatatagacaacctaggaggtctgaggactcacagacactgactggctggggtgggactggcaggagctgctgggaaggctggggcagcttctcagtggtcctggcagtaaatactatccaggaaaagtgtgccttgcagtgagagagctgctgggaaaacggcctggacaatcagactgcagtgctgtgagctagattgcccttcccctagccaagaggtgtctcccaccacccttcccctaagcagcataagagtgaaacggggtggacagctaatgcccactgacctcctgctatggaccacaggcactctcctgcgaaatgcttgtgaggttggtgacatcaacattacactaatgacaaaactgagcctgagaactgcaactcacctgcaatggtacacctgacagcagaaccagaactttcactgaaggcttacctctccagggccaaaagagaacctgtgaccccacaggatcgagcctgccccctcaatgcctgtcagaggcagcctggtgggtgcagaatgtgatagcaagttgctgttggcacggcctgctcttctgacagctctgcaggttatttctcacaactttgctgccagcttctccctgcctgtcgctgacccctgtcccagagccacctccatctggaaacacccaccccccaactctaaagttgtaaccatacatacttaagctagaaaatttaaaaggacaaagcagaaaggaattaagaaaaaaatggagtaacctattattttacagagaaataattttaacattttggattaattccttcacatacttttcttttgagatggagtctcactctgtcacccaggctagagcagtgcagtggcgaaatcttggctcactgcaacctctgtctcctgggttcaggtgattctcgtgcctcagcctccctggtagctgggattacaggagcacaccaccatgcctggctaacttttgtatttttagtagagatggggtttcatcacgttggccaggctggtctcgaacacctggtctcaagtgatccacccaccttgacctcccaaagtcttgagattacaggtgtgagccaccacgtcatgagccccctccagtaattttctatgcatttagatgcagatactgtttgcctgtctttaaaatggtgttgcaccagactaactgtttagaggtccacttccctgctcagctgagcactgacacatgcaacctgccacctgggaggatgggcaggcattcccgaaatgccatcatggctgctgctaaccatcccgggattgcaggcaagtgcggctgatgcagaaggacgttggggaatgcggacatcaggggtttgcaaacttgtgtttctccctccactgcccatcctgccagcctcagaaggttagccatggagggtgggccaatcccaacatactcaaaaatttaaaatcctgaagggttagcattggaagggattttagaggctatccagcccaatcccctcacttgcaaatgaggaaagcagagctgagagagatttagcttgtgctgggttctaacagtggctccttgccaacctcaggctcctcctggtctaccgtctgtgcctggactctgctccagcacccccacccacccacccacctgccccacttggcagagggcagcagccagagaaggcaggcccaggtgggggacaagagtctcaggactcacctttcaaatttaaagaatctctcgttaccatcaccataactcttagcccaaccattcctcttcagatccaaggatatctaagtctgactgtggaattttgttgcggaggattggatacagctgtcaaattccaaaggcatccagtacccatgctctccacagagcagtcccttattatacaagctctgcaccagctgagaaccatgttccagtctcatattgctcagaatctcctctgagcttcacataactcaggcacaatctccctgaatcatatggcataggaaagtcatgagcagtaagacttggttcaagaaaaaataccaagttctgaccactcaaagtacccttaggtgctctcattcatgtgagctttccgtttcctgctctccagccccatttcttatttgggttagggatcccctagggctgctcagtggtagggggccactgaattcaaagcaggccactgtactcgaagtagatggctaggaaaaaaaaaagggccagtcacagtggttcatgcctataatcccagcactttgggaggctgaggcaggcagatcacttgaggtcaggagtttgagaccagcctggccaacatggggaaaccctgtctgtactaaaaatataaaaattaactgggcatggtggtgcatgcctgtagttccagctacgcggaggctgaggcatgagaatcacttgaacccaagaggcagggggtgcagtgagctgagatcacctctgcactccagcctgagtgacagagtgagactccgtcaaaaaataaaataaaatccttccttccttcctccttcccttcctccttcccttcctccttcccttccccctcctcttcccctttcccttcccccttcccttccattcccttcctttcctttcattccctccctccctcccttcttccctccttccttcctatttctgagcacttctttcccaggcacaaggtaaacgagctttcaaatatagcacactgaatacccatgataattctataaaatggatcctattcttcccattttaaagatgaagaccccaaggctcagagcagtgaggtgcagatttactgtgatgctaaggaagaaagtttcagggccctgccagcatggacccctttcaaggccctagcaatatattcttagaatcatgtaatttttaaatgaaatttgcagtagtaagatattttaactgcaattgatgaagagcactgtatctttcaactctgatgtctcctcctgatacatttcccctcatgttcatattgaatggtgttacagtagctataggtgttttgggatccagcataagggaaagttaatttggggataaatttagtttgggtgtagtgggatttatgtctattgttcacagtcacgttaatgcaaagtcaagtgattgttagctgtccccatggcttccagtgctaagctttccacaactcaatggctttgagactcaaaggtgcaatacctggcacctgagacataaaaataggggagaaaaaataggattgaaatatacagagcggtccgggtgcggtggctcacacctgtcatcccagcattttgtgacaccgaggcaggcggatcctctgaggtcgggagttcaagaccagcctgaccaacatggagaaaccctgtctctactaaaaatacaacattagttgggtgtggtggcacatgcctgtaatcctagctactcgagaggctgaagcaggagaattgcttgaacctgggaggcggaggttgtggtgagctgagatcgcgccattgcactccagcctgggcaacaagagtgaaactccatttcaaaaaaaaaaaaaaaaaaaaaaaaaagaaggaaaagaaaagaaaaaagaactatacagagccagaagctagagcatagaactttcttccagtctttggacatgtggaattgaaggaaaatttagttttcactgatgcctattcgaaaaagaaagttttctcctatcagaaatgtatttgataatataatgaatacagttataaatataccagacattttccccctttttggtgggaattacacaaaatatattttatcaaaattcctgtattgtaggacccaaacctatggcagtaaaacaaaaaaaagtggatgtctgtgtctgaagccatgttttatgcaatgtaactatcaataataaaaaataaatattgtcagtcatgctagaagaaaagctaaattttctttgcaacctccctttagaaaaattacaaaatcactatcatatgaagaggtgatcaaagtgtattcagccaaaatatattcagggaaaaaagtattatggaggtttcacaggcaaataataaaaatattttgttatttttctggattttataaagtttgtgatacatgtcaggttttaaaaacgtatattgaatgtgatttattttcttattctaaataaatattcaccatggtacctaattttgtatttgtaattttatattctttttcttaaagaggtcccccagttgcttaaacttcaagccctacaaaatctcaacccatccctggaggtgaaataactttcccagccaggaagtggcagacccaggactagagaacttggtccctgactttgggatcccctgaacttcacacatttgtgcccagtcatccatagggcagcctgggctacaagggtcagggtgctagtggagaaggtcaaaggatgatgaatttgtaaactggataccatcactgcagccagcacatgtggcttctacctcacctgagcagacagcaagaggttttctgaagacctgagtatgcaactgacaaatcccgactctgttaaaaccaagtgcccagattaaagataaatagccccaaatccccaaacaatataattgaatctggtttgattcttctgggtgtcacattccctaaacttgcactgtccaaaatggtggtcctggccacatgcggctatttaaattaataaaaatgaaatgaaataaaaaatccagtccttcagttgcagtaaccacgttttaaatacttaatagccacatgtggccagtggtttctgagtcagacagtggagatatagaatgctcccatcacacccccaccccaggctctactgttaagcccagctgaacttttttttttttttttttttgagactgagtctctgtcgcccaggctggagtgcagtggcgtgatctcagctcactgcaagctccgcctcctgggttcacgccattctcctgcctcagcctctcaagtagctgggactacaggcacccaccaccacgcccggctaatttttttttttttttttttttttgtatttttagtagagatggggtttcaacatgttagccaggatggtctcaatctcctgacttcgtaatctgcccaccttggcctcccaaagtgctcggattacaggcatgagccaccacgcccggcctagcccagctgattttaaacagtctttactaagacatatctaagcccttcttctcaagaagagtgtttgcaggtgagtgtggccgatatgtgaggagagaggagaaggaggagaaaggaaggcctatccagagagaagagagggacagcccagctgagaaggggccaaagagggggaaaaaggaaatagaacctaaagtgactgaggtgttaggccttgtagagaataagggcatcatcagatgtgagccaaggaaatgattcagatcacacctgacagaataaggaggataaattagctccagaatcagttatcacatacctcatgtaccccccaacatacacaccatatacctcacaccccccacacacataccacacacacacatgccccccacaccacatacctcacacatgcgcacccccacatacctcatacacataccaaacacacacacaccacatacctcacacatataccacacacacatgcccccataccacatacctcacacacacaccacatacctcacacacataccccacacacgtacaccatatacctcacacaccacatgccacatacacacacaaagaccacacatgccacacacacacacaaagaccacacatgccacacacacaccacataccacatacacacaccacatacctcacacgctacacacacacacacacaccacacaacacatacaccacacacaccacacatacgccacatacctcacacaccaaacacacacaagcaccacacacacaccccccacatacctcacacatcacacacacctccatatacctcacaaacacacatatctcacacacacacacaccacatacaccacacaccccacacctcacacagtcccaccccacatcccctgctacacacaaactcacacactttaaagtgtgctttgcattccaagtctttgctgggaaaccttagttgcagctttacgtggctggaatatcaaaaggcaggagttgtggagtcactgacaataacatcatccaccttctcaatgtccccgacactgccacctcattacccaaaagccactgccattccagacctacgcagagtctgaagggcagcacccccttctccttgggactggagggacaccttgcctcaactctcctgcagggcctgaggttaaactctcctgtattccaccatcaaaggacagcatgggggactctagcccttttaatgggctgccaagagcaaaaattcacgcattctagagtatgaaagcccggcagggtgggccttcatttcccatatgttagtgtgtatcgatggagagggtagggagccctgtggggaatgagggcacccattgtcccctgcagagcagttgtggatggagctcctgtaggaataacggactctgattaccacggtgacactcccaaggtgatggctctggatagggtttgcagtctcctttatactcatcactcccatctaatcctcacaagaaccctgctccccacttaatgaacaaagaagcaggcctagaaaggcaagtggcttgcccggaattaacaataatagtttaaccataataacattgccccatctgctcaccatccaatgaacaactcaagtgacagcacagtggttaagagaacagattctgaaacagatgtacctggttcaaatcctggctcggccaatgactagctttgtgccactgggcatgtgattcaattaccctgtgcctcagtttccttgtctgtaaaatggggatgatgatagtccctacctcatgggttgctgtgtggtttaaataaattttcacatgtaaattacttagaaccaagcctggaatgctcagtcagcactccttaagtgctggctgctttggtgcaggctctgagcacagagacaaccaaacatagcacctgcctccaaggtacttacagcctaaagggagaaacagaaaagtgaacaagagctagggtagaaaagatgctcggggcacaaatgagggacctggaatccaggaagggcctgattcctgggccaagtgacaactgggttgagttctgaagagccacagtacaggcactgtgacagcccttatttatgttttccagcttttattgtagattcatgtgcaggtttgttacctgggattattgtgtgatgctgaggtttgggagatgaatgatccatggccctttttatatagtttgtcatttaatccttggaccattttacaaatgaggagcctgaggctcagagaagttaagcagcttcccccggaaaaccaacttggtaagtggtggagctgggattcaagcccacatttgtctgattccagaatcttactccaagtctgggcaaggcgtgggctggccaggcagctgcctgaagggcaattgtctataaccctggggtcagggggatgagaaatgtgaggcctgttaacccaggtctctgggcaagcttccttatataacctgcacattgtcaacgctccactcaggcagctctcccattccttactacataattattagataatgcataagggagaggtttgaatgactagcctgcctgggaggctgcctctctacggtcctgcttccaccacacgggagccctgaaacgagcaggccagctggagaggtggccaacacattcctcacccagaggctccgggctccccagatggccactgccacctgaccacacagagtcactttgccagaaggactgccctgctttaggcctgatctgatctttttccaggaaactcgtctggtgtaagatttatgtgtccaaacttgccagccttcccctttcaccctggactaacagggacaagaattctaatcaatgtgcaggaacacagaaaaaaaacagggaaacagcaggcaggcccaaccccaaaagccccaaacttatttcccaattttgggttgcacatgtatttctactcacataagacagtttgcatccaactggggggaattttgagtttcaattaaactttgctaaaatacaaaactcatttccccttaactgtgcttcctgacaatgaagtggtggtgtcacggggcagaagggctgatggtgtgggttaccacagcaaggtccatgctgcaaagacgggctgcccctcctgctctgggagtcaacgcttcctgggtccaccaggcccagcatttccacaggctgtcatcggtgtgtccccagcacagcacctagctagatctcagcaaatgatttgaatgtgtggggctccctccaggtaagaaaggaacccctgctcacggcactccccagaagtccttggtaactcactttctctttctgttctgaacatccattcgggctggtttaaagcacagctcgctcaagaggcagccctccagaggagatcggggttaattacgtttactgacagctgtcttctttctcctacagtcacttcttcccatgtcctgatttcattgcttgtgaaaagagatggccttccaatgggaaaaggcaaggagtaaaactcacgagagaaagcgtcctggagattttaaggagaaaggcacatcggttctgccagcacaagagctgcctgtttccctatcagatatcaacactcatttagtgcaagggtgaatatcacctttctattgaaaagaaatagagtaccctaggaaaatagcttgcatcaaaacaagagaaaagtaggttctgaaccagaactaaaatatttggacaccgaagctgtgactactgatgcaaagccattaacccataaaaacaaacattcaaacaagacactgcatagctctctttaaatgagtccaaacaccagagctttatcttaaaacaaataaacaacaacaacaaaaaattcctttccccatcccatctccacccacccactaggagtaaaacatattgctagctctgagacttttctaagaacttggtcagagacactgagcggctggtcaatatatttcttacaaatggggctttgagagcggaactagcagctgggtgccaagaacacagtggctctgctcacatctcacatatgcccagacgctctgaaccacagcctaccactgctgccacaggttcaagttctgaaacccaaagagagcacagagaaggcaggaagagaagaaaaaaagacccagatgttgcaaatcagaataagtgctgagtgaggcagtatcatgacatggcaacgataaatgttgaacgttggctctcctcttgtcagctgacccctctgctctgggacccttcacactgtgactccagttaaatcaaccagctgtgcctccaagaaaggcagcatgggtcagtgtggctgcctggactctgctgctgacagctgcagagagaaactcaaaccagccacatagcctggcccaccttatagtctgaacgtgcccagccaaaaagaagaaaagaaaacagctcaaaaaacagcaaaggctgggtacggtggctcatgcctgtaatcccagaactttgggaggttgaggcgagcagattgcttgagctcaggagttcaagaccagccagggcaacatggtgaaaccctatctctaaaaaaaaaaatgcaaaaattagctaggggtggtggcacacatctgtagtcccagctactcgggaggctgaggcaggaggacagctagtgcccgcaaggttgaggctgtagcgagccatgttcgtgcaactgcactctagcgtgggtgacaaagcaagatctcgtctcaaaaaaaaaaaaaaaaaaaacagaaaagcaaaaaacccacagctgagaagcctctggctcaaacccacatacagaagcttgtcggctgctgtgtgtacacataccagccaccatgatcctggccttctctgaccattggtctgtaaggaaataaggtgataagtgggaactgggctctgaaccctggaactgagaagtcaggctgctgcaaaactctccaggatattaatccctctctctgcccagtggttttcaactgggggcagtttagcccccctagggaacactcatcaatgtctgaagacatttttggttgtcacatctgggggtcagggggttgctatcgctacctagtgggccctggtagaggccaggtttgctactatacctcctacaatgcccaggacagctctcacaacaaggaatcatctggcccaaaatgtcaatggtgccaaggctgagaaaccctgctctagagcctaagagtgctgggctcaaattctaacatcactgctgactagcccaggggcctttgtataacttacttcacctgtcagagcctcaggtttatatatatgtgtgtgtgtatgtgtttgtgtgtgtgtatatagatatacatatatatttatattcatatatacatatttttatatattatatatttatatattaaatatgcatatttatatataatacattatataacatataatatatattatatatgaatatgaaaaaattatatattatatattatatatgaatatgcatatataatatttattttttatatatatatatataaattgtctttctgagacgaagtctcactctgttgcacaggccagagtgcagtggcatgatctcagctcactgcaacctccacctactgggttcaagtgattctcctgcctcaacctcctgagtagctaggattacagacactcgccaccacaccaagtgcagggattacaggcatgagccaccatgcccagcctattttatatatttaacaaaacttatgtagcagtttctaagtaccaggcactattcaaagcagttcatacatattaactcatttaatcttcctaatcaccctatgctgtagtgttaacctgacctccccactttacagatgagaaaactgaggtgaagggaaattaagtaaattgtccaagatgacccagctagtaagaggaggacacaggattcacattcagcaatctggagccacaacctacactcttccattagctcactcacagggctgccttacagatcaaagtttacatttattatctaccttagtctctcctatcaaggtgtgcagcaaatgtggcttctcaaccttcattccatgttaaccttatactgtttacattacccttgaacactgagaccaaggatctcaccacttgctttttctattttccttccatcacccagaatggcaaacattcaaacatttccactcccgaaacatgcagcaacgccagaatgtttatccagaaattcaaaatgagctctagtgaggctggcatgaatatactctaacacaatgttttcaaatatcgtggctcaacaacaatgaccagtgctaaggttgctgcgaatgacatcttaggcctgaaattgctctctgctgtaacccagcactgaaggtgactctggcctttgcatgctggctttgaaaggtcccaagtctgtctacttggaaataaattaaaatgttgtctatatttaacagataaccaggccttactaagcaatctaaaacacatactctagaagcacgctgcaagagctcccttcctggccactttgcagaagagaaactaaccttgcgcagcaagtcaggaccctcccccacaaccaccccccagaaaacacaacagtctcacaagttttagtatggtcgcgtctgtaagcaaaagtaaggaagtcataagataagccccacgctggaaaacttgatccttttatgaaaggatggacaggctcactgattcaggtgagaaagaagcccaagtcctgagaggtgcagctgctgaagaccagggtggccccaagcaggctatgtgcaggctcccctgtcctctacctctcagtgaaggatgtccaggagatcccactcctttccccatgaacccagttcccttccatctgcccactttggtctccctgcacataaactcatctccccctacacactccacgtggtctggccccagccttcattccacccattttagtagactgcttccacaatgggctgttcagatccagggggtccaatgttcatatcagggcttcaaatgacctaacattaccagaggcaaaggtgcttaggttaaccaaaaagcaggaccagactgttggcaacccagtgtgctaatgcaggccacccaggccaatcagaagtactgaccagagaaaggcacatttcagactaaataaatatttatcttttttgaaattacttaaagattgcaatttgtttagaggtgtaactggaccccccgcaggcccaagggaaggctgttctagctaacggtaaggagaggagtagaaggcaaggtggaggagggccttctgaggcaggaagtgaggcatcaggacagggtgtggctgggaacatcccccaggaacacatcaagtgactgataaacatttatttgctttatattaggagaatgagaacacggcctatagaaaactgggagtgctaagggcaaagaaacggcttaaagacagagagactatgtttgagcaaagtgagaaaggccattcattggtaccctcagttattaaaataatatataattcaccgctaatcacggcactgcccggatgaatattaattgaatattatatacaacatattacacactgagtgactcatagttacttctaatgaatatcaatatattttgacacatttaacaacgtggagtggtggagggggtacttctagagccaggcttcctaggtgcgattcccagctctgccacttactagctctgtgacatgtggcgaatccctggacctttctatgcagcagttttccactctgtaaaatgggaataaaaacaatgtctaccacaaagtaaaactctcaatacatagtagcttttgttttttaaaaagcttcaggattcaagttgatgagtgaaatgtatgggcatcaaccagattatgagcattcctcttcttcagaagttagtgctgaattatctggtccttccttaaccactgtgaacttgcgtggtgtccaaagacagaacctttcctgtcaacacatgtggaggcaactgcattaggtgcccggcccactgcttttctgactgccacttggccagagctgaaattctactcaagtctgtgagtgaggcccagctcctttccaagttccttgtaatcccactcaaaaaggcatgctttttacttttcttttctttttttttttttttgagacggagtgtcactctgtggcccaggctagagtgcaatggtgcgatctcgggtcaccgcaacctctgcctcccgggttcaagcgattctcctgcctcagcctcctgagtagctgagaccacaagtgcgtgccaccacacccggctaattttttgtatttttagtagagatagggtttcaccatggtagccaggatagtctcaatctcctgacctcgtgatctgccttccttggtctcccaaagtgctaggattacagttgtgagccactgcgcctggccaaggcatgctttttaatgaactccagttctcctgtctcaaagaggtctatcacatggtctttggaaagaagtggtccctgctgtgacagaggatcctgacagcagtcatggagcgctcgttaaagaaaaaaatgattcaatggcgcttgctaacgaactatagggcaagctttatttagggaaaccaccaagattggtgtagggaccaccacagtggtgttttgcagtcagggagagagattgggatcaactccaaatacaaggaaaagtgggaatgcatagccaacgagaatggtgaaggtcagtggatggaaaattactgcagaaacatcagaggtaaggggggattctggctaaattggcctaacaggattcttgctgaaggcaggcaggttgaacagacatcacctggggcacggtagaggatgatgctatggtctgaatgttggtgtccccctaaaattcttatgttggaacctaataccagtgtgatagaatgaagaggtggagcctataggaagtgatgaggtcatgagggctgggattagtgtcctcataaaaaaggttgaagaaagcgtccctacccctccaccatctgaggacacgtagaaggcatcttttctgaagaacaggccctcgtcaacactgaatctgctggtgccttgaccttggactgcccagccgccagaatagtgagcagtacataaattacccattctaaggtattttgctatagcagcaggaacagcgtaagacagatgaggaacccaatcagatatcaagggtgatcagatattgaggatggaggattctgtctaaactggattcgtgctacagttggacagagacaaacacagaagctcaaaagttgacccctagttgaaaaaaatctcagaagagcctaacgtgtggtcatggagagaatctttgtcaggccccagatcaaggacagcatgtggtgggtgagatccacactcttagggagaggagatgctttgaatgacctaattctttattgctgggagaaggaggacccagggtagaaggaaagacctgagagagagggagagagagagagagagagagagagagagagagagagagagaggtgctgggagaaggaggacccagggtggagggaaagggcagaccagagcctcagagcctgccatccccactggcatcattttgctctcacagggcccctgcactctgcacaataaaggagttgtttaacctcccagcatcctgggggcaggaaatattggtttcatctatttgttgtttgtttcagtcttggtgcatcttggaaccaaagttctcactgtatggacacaaaactaatttaggttcttttaatccaacataagaaaaacttagtttcctctagccaccatcaatcaacacaaagccaacagggcggaagggagggcccttgcttcctggcagtctccctggagggggagggggcaggaagtgatctagaatccagtctcagaagaactgctgacaacaccctcaccaaaacgcatcatcatcttgcactcatctctaagtagtgcctcccacagcctaagagcaaaggctcataacttctatccacagggtttctgccatttaccattacctccctgtcctggctcaggcaaggaccctcagggctgagatgcatcttcaggtcagcctgcccacatgtaaacagatgatacatgcacacgtgcgtgcacacacacccacctctgcatgctggagatacacaggacgtggaataagtcctctctgagaatttacgaaggcacctggctgccatcagcacagagtcatcctctgtctgagttctgaaggtagcagtgtctctgcaggtaggaagagagacaaatggagcttccttccagctgaagcaagtagaggctttgttttctctctagagggttgtaagaatttattgttttggagaaataacataaaatctaagagcgctggttcccaggctagaagacagaccagatctattcattcagcaagcattaaaaattcactgcttaattaatacaccaattgctccctccttgcaaagaggaagaacagttcagccccatgggctggcatctttgccactgaggtctgcacaagatgcggatggtgaacacatgctacggccattttggatgtttccttgtagcatcaatgaggaaagaaaacaaaactgttaaaaataaaacctctgccactatatcctgaattatatcagcaagctcctttttaacaagatgttatgtccaggaaatgtatccatttactgattgttcctgaagaaataacttgttcactaggaaataacttaaaccagaaatgtgggctctcatctgatgtggtttatgcatctctaggtgttttcagtgtctcttgtctatttaatggactcccagaagagtaggatgtctacctaaaaagaaaaattaacgtttatactctcctgatgatgtttatgtggaagaaaacaaacatttgtcaaatgtctgttttttattttatttatttatttatttagagatggagtttcgttcttgttgcccaggctggagtgcaatggtgcaatctcggctcactgcagcctctgctgcccgggtttaagcaattctcctgcctcagcctcccgagtagctgggattacaagtgcccgccactaggtccagctaattttttgtgtttttagtagagacggggtttcaccacgttggccgggctggtcttgaactcctgatgtcagctgattgtcactcatccattatacatcatttaatctgccatgagcttaataagcattatagagtctaatcacctaatgagcacgctcatgaaagtgtcaccttcattgaatcatttaactctcctagtagctctatgaagtactattattaccccccagcttataagataggaaactgaggctctgagaataatctgcccaagatcctgtaagtagtaggtctagaattcaagcccagcctgatctttctccaaatctacattattgtccctgaaccaaaacattctcaggccatgatcttctcccctgtcagcagaatctggagcatctcagggttcatgttgaattacaaagccctgccctaaagcagatttattggaagtccagtgcttgtgagagttattctgaagggaaaaaaaaataaaatacatatatatatctcagaaagccttctctgcccaggccaatgcagccagctccctgcttaagaatagctgcccatgggcagggtttcctggccagcaattcaagatgtgcctgtgccggctttactctttaatctcagtttcctcacctttaaagtgggtcccacaagccctgtcctacagggctgctataaggatttaatgtgatgagaatcctaacatagctaacaaagtgcctggtactgggtggtcagtaaatgacagttattgctgctattacttggtagactcccaaaagttattctcacatccagtggagggaagaggagggagcaatcctcccttgggggtagagtattttgcatcaacaggttttagaatttttggtgcaaggtgagagtcaaaatctaacagacttcgtttattatattattgcttttacgttctcttcagacaacgtacccccttattgcctctccctgggctgggcctctctatcccttccctctccccactccctgtgctcccacctagatctcttccaaatttcccagtagagagggaatagagaggcagtggtggtatctttcaccccacatcccagtggtgatcacagcacttcagggaaaaagaaagcagccttcacacatatgggcctccctaaaaagcttcccaggaaaaaggaaatgtgtgtggaaaggccataactgggaatgaatcatctgttaggaaggctgaaggagagggagaaaggggagtggccggaggtgaggctggagaagtaggcagggcccatcgcctggggtggtgcataccttgggaagaattttcaattatctttagttcagcaagaaattacagacatgattagggcccatgcaaacattctggaagggtcaaggcaggatgtgggggaccggtgaggaatctcctgcagcagtcaagcaatggtggcctggagagggagtggacgtcaggatggataagtggatggattcatgcactcgtccttaggaggaggaatgcacaggacttggtgacagcttaagtgtaacaggtggtggagaggagagggtgaagtccggcttctggcccaagcagcttgggggacagtggtgccccttcctaagacagggtgcatctgaagaggagagactcacaggctgaggaaggggctggggtgtgggttggtcatgcatgtgggaaggtgctgagccgagttatgcgtgtgttgagtcatctaagtggagatgctaagaagggggctgcatttacaatcagttcttccaaagaggggtccagatgagatgcatggaaactaacaccaggggacgtgacaccttcacctaggggaagactacattgtaagaagagaaatcctcagacagagtctagggagctgcgatcctcaatagccaagcagaggggtggtggaggcagcagagaaggctatgcaggagaagcctgaaaagcagagagaaaaccaggagaggctggtgcctcagaagcccagggaagaaaacaagatgcagagttttaaacttcacaaaatgccactcagagggcaagaaagacaaagttaggacaatgtcactggcatttattaagacgcaggtcagaggtgctcttttcaggagcaggtgtggctgggcatgcaagggctgaagcggaggagggaggtgacaccatgcacacagcccaggaggctgcctcactcacaccccacttgcttagccccactcacttagcctatttccttcacagccattatcttaatgtgtgctgtcttgcttctttgtttacttgtgaattgccttcttcccttaaggtctgttagggcgagctccttgtctgctctattcacagctgtaccccagcacctaggaggatgcttgacacagaacagggattcaatacctgttgggtattgaatgaatgaaacagaagcagagtaaagtctggctaagaagtgaggagggggagagctgcaaagcccagaaactacccacaagaatgagccagtggtgaggaggaggggtgggttactgtccctgggaagtgggacccccagtttaagtggaggcttagggcagaatcctggacactaaaaggaatgcttaaaagggaatttgaggcattttctggtctgaaagacatccggcccacattgctttcacttaggtcatgttcccccaaaggaaatcctgagataaggattcctagatgagtgattcattgaagaaatgtccccagagtggtcggtaggagagtggagaagcaggacagaaaggggagaggccaagccaagcatgacctcaggccacatcccagcctcagcctgaccccagggagggtcctggaatgtaaaccgaacctcctgcaagtttgtacacccccaccccccactgccagggcaaggtggctgacctttcatattcccaccctaattaatattggctacagactgtcatggccaggacagaaactcccagccactccaactctcttggcaagagggtaatcctttgaagaaggcgatggggcaaagctttagaaacagaggctacagaagctgcaggatgggcacacagaagtggccgaagtgatccaacgccatctgagcagagcgccggcaatgtctgctactaaattgggatagagttttttatggattaccctggaagagcacaccaaacaaaccacttcattctgagggcctggacggtgcagggatagctaccatttagaatcgtttcagtttctattccggtaaagaatccttcaaagaaagacatcgaggctcttacagtgcagagaggtgctcttcttggacaactatagggtgtgaacgtagcacagctactaaaagtgaatgtgacacaacaattaagagagtatggtgagtatttagaaatacttagaagtcaaagcataaaaaactggataacttgggttacattcctgagacatgtttattattatcacagtactgtgatattgtagaatctggagaaataaaatcaattgaaataaaataaaatacatctaccaactaccatttactgaacacctgctatggatccaactctgtgctagaaatgaagcagcatctcccttgctcaaagctgattttcaggctgggaactagatggggctcctgaagcaattcaagaacaaggcaaaaacagatctatggaggtcacataggatgatgattaagagttgagccaggctcagcaactgcctaggatcactcccatttctgctgccagactctctgtgcctcagtttccccatctgaaaaattgagatactaagagtctttacttcacaagattcctgtgaaggtaacaggaggtgatgtgtgcaaggtccttagtatggtgctgatgaatgcagtgagcactgaggccttgttattctgcaattattactggaggtgaggctagaaaagaccacacttgcccgacttgtcctacctttctctcctcaggagggaccaagacatttatgcctggttatgaggtgacattagaaaagaaatcaaaaagcatctgtccttgtttcttgaagccagatgcaaccaagctaagcctgaaccaagagttgatgggcagctgggtggtgtgctcctctgttgagctggccaggagctaaggctgatggctttctgtccagggagccgtttagactcagagtacacacatgcttgcctcttaaaagagtattgggtcagcaaggatgcactgggaaagccatcagcatctttgcatccctactgaccatttcctgcccagcacactggagccagtgctgaccattttcctttttttttctttttttttttttttgagacagtctctttctgtcacccaggctagagtgcagtgatacaatcttggctcactgcagccacctcctgggttcaagtgactctcatgcctcagcctcctgagtagctgggattacaggcatgtgccaccatgcccagctaatttttacatttttagtagagatggggtattgctacgttgcccaggctaatctcgaactcatggcctcaagtgatctgcctacctcggcctcccaaagtcttgggattacaggcctgagccaccgtgcctggtcctgaccattttctgattggcagcagcaggagggccccagggtcaaacaatgcagtcacacaggcctgtgctttaactgtgcctccccacacagcttggtgaccccgggccagtgactttgacctctgaagcctcaattcccttgactgtaaaagaggtcctgaccttggctgcacattaaaatcactgggggagtgtttaaaagtccaaatacccagggcttgcccagaccaacaaaatcagaaccccctgatgagacctactgctgtaaggtaaaatggtcatcttctactcccagaagtggaattaagggagactatccatggaaggtgcttaccgccatgctttacacagagtgcgccgtaaaaggaggccgtgatatggtaccatttggagttcccagactctagaaacacctcccacaggcccacagaggattgtacttgaaacttcattcattgtactttatgccccactttggtgagtatcaaagatcaattgtgcattttgatttctctagttcttttgatcaccctggtccacaatcatgttattcttcaagagagaaaatggccagacccaggaagtgcttctctggattaagggctgtgaggttaaatctttgtttccatctctgccctcaaggacctccaatcccccatcctaataagagagctgccatccacaagggtccttggcccttggcttgcagaagcgggatgagcatctacaaccctggctgtgatgaaggctgccctgacagttacattcttgatagagttgcaggacaaatatttctgaacctgtggttcctttgccgtgtctctagtcaacatagggcttttagccctgtggaacatgaagatttttgtgaactagggtataaggatttaagagtgtaggtggggcctctctaggccctgcttcctacatagttgatgtgtctggacccacaactgagagaaggaacaaagcaaacaggtgggatcccttatagtttatagttatgtttttcagagtaacagacattcagggaaacagaaacagaactttagctcaagcagcaggagggggcagccagcatctgagctggaagaagagctagcaggtgacaaaggaaacaagcactctccatgcagtgttaaggcagtgcttatcatccagtgggaactggggtgccagggtgccaggcaacagagcagttgatggagacagttccagtgccattatgagctgttaaaaggggatctgacgtgtgcattccagaccctgatactacttcttgtccagtcattcaacaacatagtattccctataggcccagcatgtctgtctatgtatctgatttcacaatcccatgacataggtactgttatcctcactttgcagctgaggagactgaggcacatagaggttaagtaacttgtccaagatcacacagttagtatatgacagagttgggatttgaaccctgtgctcttaatttctatgccaaattgtctctagcttagtgagggtgtcaaacaggtcaacagacaattagaatatagtacagtctaagtgactgctagggactagcacaggtggtggcatccaaaatcccattcttatctgatgctcactcataggaagaaaaacagaagtacccacctggtgacaggctagcaggcacaaggatagacagaatgtgcacctgaaggagttcacctaggagagctgaggaggcacaaagacctgcatgtgagtgttcgtggcagcttcatttacaatagcccaaatctggaaacaatccaaatttctatcaacaggtggatggataaaaaatctgtggtggccaggcgcggtggctcacgcctgtaatcccagcactttaggaggccaaggcaggtggatcatgaggtcaggagtttgagaccagcctgaccaacatggtgaaaccccgtctctactaaaaataggaaaaatcagccaagcgtggtggcatgcacctgtagtccctgtaactcaggaggctgagacaggagaatcacttgaacctgggaggtggaggttgcagtgagctgagatcgcaccactgcactccagcctgggcaacacagcaagactctgtctgaaaaaaaaaaaatcctgtggcatatccagacaatggaataccattcagccacacaaataatgaattgctgatctacacaacatggatgaatctcaaaagcaccatgctaagagaaagaagccagaagcaaaaagggtgcatattttatgattttagctatatgaaattctaggaaaggcaaaactctggttttagaaaacagagttttgcaaggggatgggggtaggagggacgaactaagtgtgacaggcatgaagaaactttacgggatgacgggaatgttctatattttgatggtggtgatggctacactggtgcagatacttgtcaaactcattaaattgtacacttcaaaaggtgaattttattacatgtaaattatactcaatttagaaaatattttaacaagagacttgatgtcatgcagtcaaaagtgaactgtgctatgctctgaagctaacggtgagagttacatacgttctgcttcctttgttttttgttccttgttctttctttccccctttccttttttttttttttctctctctctctctccctcctttctgtctctcctcaaagtctaccacctccttttccaagccaagcctaggtgacaggcccctgagctgcaagtgtttccagcactgccattacaaattagtggaaatgatcagacccccaggcagactggttctcagcctgcttcagaggggcagatgttctgcaaaaccagccagtgacccacagagaagactggcaagcccgcaaggctctcattggacccctctgtggcttctgcctcccaggtagaaagcatgcatatattagatttaaaaagaggaagtgcctttccaaaaactactcggctttgggagggatagaggtcatttgtctttgtccaagaaaaacatgttccttccttgtaatccttgataacccctgaattgttttctccaagatagttagggacaggggtaggggagaggggctacagtaaaagagaaaaggaggtagagaggacagaggaagccaatgccctactactctgcggtagcagcaaggtgagctcttaccaccttgaactctgggaaagatggtaaaagagggaacccttcaccaaccagtgcccacatgactacctaagacagcacccatatgaggtgcaaccatatgaaggttcacttctcgctggatgagaagtgaacagagaggttaacagggcaaagaagcagcagtaatgggaaaagaacgtgagactggcacggttccctcccctgggcctgcgggaggcccatggcagccagaatgtccatctgctgtgccccaccactagtaggctcacaggaagggaagagaacaatgacaacccaactgtcccttgcgcagaagttacaccaagaagtgagcagcaggacccgctggcctggcagtaaaccacatcagagttatcagtcggaaacctcttggacaaagagagtttataaagtcccttggccaagaggcatggaagttgagttcagccaagcgcaactcagacacatgggcaatggaaggggagctggggatgccagctgccatccaagtcctgtttgttggaaattgagagagatagtattggagaactagatgctttcactttatttctccaaaagagagctggtctccaggtggtgaagcctataattctataaaaactggagattggagagataggagggtacaactctggcccaagacagaaataagcaaaaacaaaacaaaacaaaacaaaaaaataggcatccataagagaaaaaagtgagtggttctgggcatctagtaagtggaagaggaaagagaccatctctaatcctaactcactctgttccaggtttggaataaaagctgtatcgggagaaataacctgttaaagtagaattgtcaatgtgtagaactgaaaatcggccaaaaatccatcagctttctcaatttactaagaaagaataattaactccctagtacctgatatacttttgcatttaaaggctaaactacctatatctactcaatatcattcacttctagtaagactcttattggcaggtttaaagcacccctacccaacccactagcaccaacttgtcttttatcttagcctggaaagaacatgtatgggttacattactaagaacatagtatcattgaatgaatcattaaatagaccagtcactgtaataaatacatgtggatatatacattctgttaatagacttggcatagtctttcatggtttcaagtgttaaggtttattgtggtattaaagaaaaccttatagactttcattttctgaacgatagtggattcaatatatagccaactctactgaaaacactaagcaaactggatactatagaaaaactcttttgaaatgactgatgagctggcaagttagtaagacgtattcagtgagcaaaaactaagcaaaatctgaagcctagtataagagccaatccctgaagctagcttgaagacaatagccaacaaagtgaccttcacttttatcttttgtggcctcacgggaagaggagacaggataagaatttcccataacataaaggatactatcacatggatccaggaactccaatgaataccaagtatgagaaataaaaataaatatatacctagatacgctttgtgaaactatagaacaccaaacaatttaaaggaaccagaaggaaaacacagattattctcaaaggagacactcttgtctgtagacaagacagtagattttagaggcaacaatggaaacagaggacagttgaataatatcttcattgtgttggagagaaaataactggcaacctagaattctaccctaattctacccagtaaaaacctctctcaaaaacaaggggaaaaatagtgtatttgcaagcaaacaaaatcaagaagttgtcaccaacagaccctcaataaagaaaattctaaaagctgtacttcaggctctattggaaaataccaaaatgaagttggtagacctacattaatattaatcagaatagacttaaagactaaaagaattactaaggaaacaagttttgcttaattataaaagattcaattcaccagaaagataaaacaattcaaacctataggtacctaataacaaaggctcaaaatatataaaacacaaactgacagaccataagaagaaacagaaaaatctacgatcatagtgggagattataatacttctctcagtaactgattgaacaagcatacaaacatcagtaatgatataaaagacttggacaacacagtgaagaagcttgatctgatagagttacatagaacactgcatctaacaatggtaggatccacagaacattatgaaaagtgaccacataccaagccttacagtaagcttcaataaatttaaaaggctgggtagcactcaaacaatatttgacaaccatgaggcaattaagttagaaattagtaacaaaaagataataagaaaaataaacaaacattcagaggattaaaaagaaacacagctttaagtcataagtcaaagaataaatcatagtgaaaattataaagtactcagaaccaaattatatacaaatattacatatcaaaatttatgaagttagagtaaatattgtatagcttacaatgctcataatggggaaaaaagcctgaaaattaaaaagccaaacacttaccttaaaaagctaagaaagaaaaatagctcaaatgtaaataagttagatggaagaaaataataaaaattagtatagacattcataaactagaaaacaaaagatggagaggatcacaaagtcaaggattagagatagtctctaataacattgagaaaattcttaaaagaccatttaacaaaattatagaaggtattacaaatgaaaagtggacataaccacagatcccacagaacattaaaaaataacagcatcttataagtagcttcaaggtaaaaattttgaaaactcagataatatggataaatttctagaaaaatctaatttaccaatattgatttaagaaaaaaattaaaacctgaatacccatgatctattgaagaaattgaatcagaggttaaaaatcttcaggaaagaaagaactccagcctcacagaatctttttttgagaacagataaagaggaaatattctataacttactttacaaattcagcaaaaccatgatacaaaaccctgccaaggataagataagaagtgcaaattacagtacaacacactcatgaagatagatataaaacttctaaattttattagcaaaaaaacctagcaatgtataagaaatgaacccattacaaccaagtcaggtttattctaggaaagcaaggttaagttaacattggaaaattagtttaccagatattaacaaattaaagaaaaaaattatataaatctcaataaatgcagaggaagtatttaataaacatccatgtatataatttgaaagaaaaaaagctctttgcaaactacagaacaggagtagttccttatcctaataaggaatatcaaatccataaaaactctcattctcaagggaaaacgttgaacatgaaaggcaaagcttaaacgtttagaagaccatacaagaactgtccttaaggatgtcctttaaaagacacaaaatgttcaatgataaaggaaagattgataaattttattacattgaaattaagaatttctgccactgtaaagatactaaaaaagatggtgagaaaaaataacacaaataaggagaaggtattttggcaacacagagaaatagtctcctgcatatataaagaactcctacaaataaataagagagatgtaaactacccaattttcaaataaatgggcaaaaggcttaaagaggtacttcacaaaaaaagaaaatccaaaaggtcaacagcgtatgaaaagatactgaccctctttagtaatcaaatgtatataaattgaaagcagattagatactgttacacatccacaagatgggcaaaagtttttgacaatatcctacaaaatataaagtttttgcaagattagagagcagtaggagaaattgcagctggatatagaaattggttaaacacattggaaattaatttttgattaaagtgaaactcatatgacaccatagaattctgaactatcctagcagcactgaaaatgcccatagtctgtggccagtaattttattactatgtgtattccctaagtaaacttacacacatacttagcagggaacttgaaaaaaaatgtttacagcagcactatttataatagcaaaatactggaaataagctaagtgttcattaataatagaatagacatataaactgccatatattcattcaatggaatattatggttcagcaaaatgaaaaaatttcagctacacccaacaatgtgaatgaatccaggacgaaacatttaacaaccagttggtacagagtccaatcaaatgaagtcccagccctagtgccagagctggtacccaagaccccctgccatgccaggtgtaatccctttagaaaggagtggacttggagaagtaccataggagcacctgggaaagacccaggtaagcagcaatttaccaactgatatggaaatattcccattgtttgtcaaccagtgagccttactggtgtggtgtgcatggactaaacgtgagcattaagaacaaaagaataaaacagtgtgattccatttatatgaagttcacaaacacgcataactagacaatatattgtttagggatacaaatgcaagaggataagacaataaagaaaagcataggggaataaaaggtacagaaatgtccagaagatggtaatccctgagaagagaaggaatgggatagggtggagggaggtacacaggggatgtcaaaggttcaagtaacattctttttctcaaattgactggtgagtacataagtgttagtcataatgttattctttagacctttctacacagtttgtaagcattcgtttgcatctaggggctatttcattaaagttatttcaaaagatggtcacaacacaaatttaataagaaactctcatatcaaattgctgcagttcctgccatatcttttctagttgctgggcaaagatgctctcctcaattgtaattggtgtgctcttaaacccacttaaaattctaagagcttctccccagaccactccaaaacattcttgtgagaatctttccagtgaggtacagcaaggcccaacctccagggcacattatgctctggctcatttatttgatacaatcataatcatagtgggtttttttctcaaactttgaaatcttcaaaatgagggcatggagcaaatgactacattctgcttctcttgctaagatttcaatggtgatgctctcattttaagttctttaccagacgcttcagctgtgctatgcccaattcccctcatcaagatttgctgacagtcaggggaagtttctaacactgtattaagtgtatactgagggccagggaattggggggagtttgaggggctgcacacatgtgcaattttttagcaaacccagcagatgcttgtagattcaacactttttcagttatttgtgaacaacccctaatagccacaccacatggcaatttgtcttttctctggagcacaaatgtgaactgtatgttgcaaagccacagcaaagaacaagtcacttagctagagagggagtcttctcaaagacccagtaaccccatcccaagatgccaccagggaaacagaaactctctggaggtgaaagaaacttaatttccttgagtgcaaattgaaaaggcaaataattggtagcctgtgaatagtcataggaacctcttcactctggaatggaacctgattcaggaggaagtcaagagcctatgcaaatatttctgcatttgcaaacttggggatttgccaagggcttgagatgtatccactgaaaatgtcaagcgtctactgtgtagaattttgatggaggaggatttcaaaattcttcttctatttaaatccaatcaattcatgtttatcagggcatctctgatctttttgtttttaagagacatatttgctctattgtccaggctggagtacagtgatgtgatcatagcccatggcaggctcaaactcctggactcaagagatcctcccgcctctgtctcctgagtagttagaattacaggtgtgagccaccatgtccataattttatttttattttttttaagacagggtcttgctatgtcgcccaggctgatctcaaactcctgggctcaagtgatcctcctgtgtcagcctcctgagcagctggcattacaggcatgagccactgtatccagctcctctgatcttaagatagtttcaacatctaatgctaagcctggaagtccaatgaaagactcaatagactaaaattggtgactgagattcggaggagcatatcgtgtgtttataacactgcttttattttttccatatctttctactatttgtttattagcttttctttggatctcagttattcatacataacacatgtttaaaaagttgatcctaaaccccaattcaagggtccaccgatgctcagagatctcaagatttctgagactagcttccctatacttctccctggctttgctccccaaatctgaaaggcattttcagatcacccctacttcatatttagatataaagcttccccctttatccacaagaattccagctgcacctggcatttcaaaaacacttagtaatgaggaggggagacccatcagtcatgtactcaccacttccattgttgtcctgcctcccaagcacatatttccaactgtgaaacctcccaacagggcagtcctctggatagtgtggttcagtcacttcccaccaccatgcctcacctcctctgccttccaagccctctgggacttcagggaataccttttctccatcatattacaattagatacagggaacctttggagagttctgagtatttgtgattatattcaataacctgttactgacagtttcttttagttaaagaattttttcaagtaagttaccaaaacaatgaatgtatgtacatctagaaactgagaaatactcttccatgacttttagttaggtcctcacgttttccacatatgtattgaatttttaaaatactattttaaaagggtctacatttattttcctctacttttgtttttcctcttgcctttgttttggagcaaattttaactgaacacattgtcagagggtcaggccaagtttggcactgctcgtgtatctcagccaccttccagttttcagcacgatgtctgaactgaaaaaacaccattgcttaccataagggtgtggccatgacagcttgaacaacatccgggtagtggtaagtctacatttgctacacagatgtaagaaacagatagcagtagggtctacctctcctgctccatcttttccatcaccaggtctcttccaactccagaattaaagtcatcaagttggaacaactctaagtgtgtttcctgatcataacaagacaggttgaggttcatgaatattttctttagtattaaatgttagaacataaccactaataataacagtagcatagtagttccctgataaattttgacaaaagatcataaagttctcaatttcaacagcagggctttatagttgtaatataattttgaccagtaagccaccggctatccagaaacctcacaggtgccattatcatggatagttgcagttttttctctaagaatcatgcaaaaaaaaaaaatcttttggggatacttcagaactctgtctttttaaattggatgaacaaaatataattttaacttctatggatacatgtgggtcattgtgagcatcagttactatgttataaaacagagtaccaaagatccatcaaaatacataaaatttcactgaattgcttacattaaatgctcatatcagctttagaattccatgccttgaattcttgtgccttttaaatttttttttagtttttctgttttttactcttacttcttactgatacttgataaaagagctttaataatccttgcacagtacagtatcagttgcttccaatttgctaggtgcatttgacaaactaataaccaagcctcttaaaacttgaagtaaatgcagaggcctgaaagagggtataaaatttcctccaatgatcaaaattcataaactgtagctcatggacttatgacctttctcttgatttgccatctaggtcccaactggataagtgaaattatgtaaatgtgagttccagattgttgtggtattatcctaatacctatcaactacatagcatgttactaaacgtatctcatttttcttctcaagatagttcagtggtcttggtaaggttatgatggttacacctactttacagataaggaagaaaattggtcacgggctttggccaagtctgacccagaatgctagtgctgcctgttgatacagccagtgttttccagccctgcccgcctagtgcatctgcagatttgtaaatacactttgactccacaggaaacaggatggagaacagcatgtcagggactccttgatgggcaggatggagggcaaaaaagagccttaaagacattagggaattcacagagtagggagtgagagacaagttaaatgctatccagttgtcacacagctttcttaatgttatctttcatcaaatcatgtcctagaacctgccaggacttcagactaaatgcatcttcttcttgcctgtacctttcacacactaaatgtctcaacagctcacttggcaaggacccaaaggcagcacacacttctccactccaaggagggtggctgccactaaacacaatgggcggagacagctcaacaatagtgccagttgagcacatcttgatccactgccacagagttcacagtagtagttggccctcaaagcaaacccactggggtgttgagggcaaaaaaacaatcttagccttaaggggccagactttgccatcaaattaacaaatctgcccaacagccccaggctgaggcgctcaggggtgtgacaggagggcccctgttaacaattctgtatcctgtgggtgccttaactagatggagtggagaggaagcagagagctaagtgtcacaccaccctctcctcctgcctgcaggtgtcttagttggacagctgtccaccttccttgcaaaaaactcccacaatctttaaatgcaactatgtaaagggcctccagcctctgcaagccatcacaactttaaagagcatatgtcaaacagctcagacggcatctgaggtctattcttcagccccacagtatagcccaaccccagagcacaagtgacaccctagtggacaggaactcctccctacactggctgctcagcaggaccatgaagaacagctgggacctggcctattaccttggcttcaggattcattttctgcctggaattgggaaactggaggccctgcaggggtccttctcctgggtccaactgtctccagggtgcaagaggggtgaaattaccaaatgaaagttcagataagcaattactggctgaaagagacacaggagggtcttcagatcaacactgacccagagctaataccacactgtcctcagagggacacacgatcactgacctgtattcttcacatttaagttgctagaattattcctccttgcccccactctctccctgcccccagcatacacataattacataaagacgtcttaaacaactgtagcacccaacttcttcagtctgggggagagccaggagatggtggggagctgtttgggcacacgtctgatcattacataatcacacaaacatgggctggagaacactgccatgcagatcagttcagcaaacacctcattctccctctttcctcttccctccccccgtaacacccaaaatgcacaccagagttaacaaaaccgaagcactccaggtagccagtgggcacctggctgctgtggttacaatgccaagggctaccagaaacgtcagcgtataccagaaagagggccagggtgctgctcacccagcgaccagatctgcagaccctcttcctgcaaccactgcccccgaagttcaaggaagggcctagccacagaaatattcctgacctgcaacagaaaccaaaccagctacgttaaaggaaaccaatgccgagcctccaagttcctctgcaccactgccacactcaggagtcctcagcagcctggacaatatcattagggaccattcggcaccatcagtgtttccatttaaaagatagtaaaatgtggggcataacttggaggggacactctctctgctagcagggaggcaagaatcccctatagaataggagtttggtttgggtttggttgggtcaggttgggggttgggaaatgattttgctttaggaatattttcagggggctaggattaagggggaaaaagaaagctatcccctctgtctcagcagccagcatcatacgaatctcactctcaaccaagcaggctactgcagtccgcctaaacaatccggagcagcagccaaggcagcacaagaaaacgccggtgccacggaacgcgatgcctaagccccccagccgaggctcctatggagccggccgccagtgcgcgggtgcagagcccagcagagcctgctgcaagcagcgctggagcgcacggcgcgcatagggttacagccccgccgccgccgccgccgccgccgcctgtgattgacgcgcgggggtcacttgaggctcgcgccgctccccagcaccaggccgagcagcgcgctcagcccaccgggggcactggccgccacgcgcagcccacccggccggcccctgcgtctcggcagccggacaccttgcctaagaaaggcatacacaaaatggaatcgcagctcgctattctgcttcgcggtgcggcctcaggcaaaaacacaatcacaaggtaaaatacagcgcaaggaatccatccgccgaataaaaacccagagtcccctaccttcggccttgggatggcaaactggtcctgtgttctctgacccacggatccagccccttcttcatgaattattccggccaggcaggattttgtgcatttttttcatgaacacctgtttcaagtaaggggtaaagaccttattgaaagaattgtccttaaaaaataacctgtgcatacgtatgtccatccaggcatgcatgcgtgtttgtatacacacatatgcacacggaatagccatgtacattgaagcaccaaactaggcagctggataatgggagagtcggctggttgtgag

SEQ ID NO: 1744 - DNA, 412343 bp, Homo sapiens; identical to SEQ ID NO: 1743

SEQ ID NO: 1745 - DNA, 71637 bp, Homo sapiens
aagaggaaactaaaaccacatttattaatgctgtttaggtggagaaaagttggaaacaacctaaacatcaaaccataagagatgaggtaaacaaaggatgctgtagctatgtaaatgagtactcttacattacaattgctgtaaactaagcttgttgctctagaaagttgttcatataagatattaagtgccaacgtgttttatgaaagactatacatgatattgtgacactacacttacattaaaatatatgtgtacatattatatatgtatgatactatatgactaaatgatcatcttgtctttggggtaagtaggatttggaagtagctttttcttctttttatttgtctacacttccaaagtttttgtaacaagcatgtgctgctttgcaataatgaaaaatagcaatgctaacatttaactgaaaaaagaaaagcacaattatcctggagtagggcaggcactaaaaaggcgggagtaagagcgatgagagtagaacgctgagctgaggctggcctccttcacggccaccttcctccaggggtggatccgtgttccagtcacctccaaacacacaaagatgtcagtgccacagaccatactttctctcacacatccagtcaaagcaccaggaggggacagagtcaccacagtgcaagtctcagctgggattgggcaggggagaggagaagggcatcaaggagctgaccaggagacacactgatctggccaggcagcctcttgcagaagtggatcccgttaacaatgaaacagatatgacatgaacttggcaacttctgagaacaggaatgtctagtggtgcttctagcctaaagtgacccagtttcagataagacagtttaatccagaactcagagggagaaaagattaatattttctcctagggaaggatacccagagctaccacagctgaaatgggaataacatgcttaaaggtggatatgagatggccaaagtcccatgaggaatggcctccaggtatgatgatgaaatccagtgcaggagggaaggtctcttctcatagtatccaattgcaaaactggtcaaaattcaaccattttctcagggttattctaaaagctgttggacttgtactgcttctttggcttctctggctcttgttccagcttttgcagttacaaaatgagaaagacctcgctgtgctgtcctccattcagtgggttctggatggattgccagatgatgtgaagggctcttggtcatggctggtacctgcaaacacggagagtgcttatcaccattggactctactgtgccatttccatcatgtcaatcatggatagacatgagataaggaggatggaatcggcagtgggcaggacacaataggaagcgagggaggggagagggcaacagggtggaagggtagagagaattgcaggaagaaggagggacccaggaatggcccaacatcctcagagatgaaagattacagaaagagggcagaaggcgagagcagagaggccatgccagcttgggctggagcagtcagattcctcaccacacccttgtccctgctgtgcccatctgctgccctttctttgccttctggccctgtaggagccatcccagccccacatcccaagccctacctgtgactacccctcccctaagccctaccagagaaatgaacttacttctacccttcgtgggccgcatgcctccagctccagctcttcttggggctccagagtgtgccagtttcccttcaagcaccagtgtcctcaacctctggcatggtattggaatctgtgccttcagaacctcctttcttcccattcttcaggacgtttgtccctcgactggacaagatccagcaggagtgggcaacacaggaacaaatccgagacaccagactgagagggacaggaaggggaaacacggggcagtcctgggtgatctggaccatctggtcacctcattctagttcacgagtggacatttagataagggaaaccaaactgaatcagaactctaaactcagtgtgcagcagggtcaccagattgcttattctatggcacctgagacctttcatcaccactgatcttcacgacagatgcacgcagatatatctaccaaggacttagaaacccaagacagtttcatactttaaaaatgtgtggaaactaaccatgcacaaacttctccaattacatcagtctccccagaagcacatccaacagcactctgtcacaacttctggaagcagcctgcctccttgctaacccctcctccatgcagatgctcacctagaggagtggatgggacataataccaaggaggagagtgtgggtccagtcctagcacaggccaggaacattttctgctttagagtcacaggactgttcaccaagccaagctgaataaacatcttattgcaatatttgcacagacatgcaactacttgctgtgaccatgacagtgactggaatgtaaggatccatcagtggtagacccaaatcttttttttttttttttccaagtcttgccctgtcgcccaggctggagtgcaatggcgcaatctcggctcactgcaacctctgcctcctgggttcaagcaattctcctgcctcaccctcccgagtatctgggactacaggcatgcaccaccatgcccagctaatttttgtatttttagtagacatggggtttcaccatgttggccaggctggtctcaaactcctgaccttgggatccacccaccttggcctcctaaagtgctgggattacaggcatgagacaccacgcctggccggtagacccaaatcttaaagcacatactctactctagtggttcctaaactttagcatgcatcagaatcatttgtagactttgttaaaacacagagttttggttacactcctacggttttttaatcagtaggtctggggtggaggctgacagctagagtttctaacaagttcccaagcccagctattgctggtccagagaccacactttgagaaccactggtctaccaccaacagtgttcaatagtatcacctgtcttatatcaaaggaaccactaatgactcactcgcactcagccctgtaacctcatccaaagcagaggcacagaaaaggccaccacacacacaaagaaaaactgtttacaaaatgtttttattttaaggttaagaataaaaggagccttagggttcatataatctaactacctcacttaatataatattaattaaactaagcttagagagggtaacttgcacacagaaacaatgaaacaatcaatagaacccaaaccaggaaccccagcagcactactctcaaaatcgcaaacgtggagtcctagaaaatctcctaatttttgtcgtcattagagtcacaaggctcaagagtctgcaactggcaaattagggcttccccttctggtcctccatgccgaagcactcaggccatgccatggtcatttcttagtaaggctatgatggaagcaattcttggttccctccaagttcaactgtgagtccactgcctagaactcagaactggttttctcagaaatcccatagcacacgtggagggttcctgggagaactcttcctactaggcaccacattgttgaactgcagtgatgatagcccacaggatctaaccatcatgaagaatataatttcctaaaattccattctgagtttcaacttggacctgtgctggtccctcttcctggaaaactgctgccccagttttctcatgtcaggctccttctgtatgtttcctcttgcagagtatctcctgatcatctacccaagtagttctcactcccctcctgccagttacactgcatctcatcagccttctctacactccttatagccctagaactatataaaacatttgttcatcatctacttgctcattaccccctgaaagtaggatgtgagcttcgagagggcaggaactttacctttctgtctaccactataaccgcagcacctagaacagtgcttgggacacagcagattctctatacatatctgtctaatgaacaaatgaatgtacagaagaatgatgagagagcaccttcttcttcttcttttttttttttttttttttttttttttttttgagacagagtcttgctctgttgccaggctggcgtgtagtggcatgatgttggctcactgcaacatctgcctcctggattcaagcaattctcctgcctcagactcccaagtagctgggtctacaggcacgtgccaccacacctggctaatttttgtatttttagtagagacaaggtttcaccatgttagccaggatggtctcaatctcttgacctcgtgatctgccagcctcggcctcccaaagtgctgggattacaggcgtgaaccatcatgtccagatgagagcaccttctttcaacgtggtttccaaagttggaatttgagactttccttcctgtttctctcattttcaatagtaggagttagactactgagctttaatagaacgtggaaggagaaaaacgtgcccttaggctggtgttctcaatgacaggacagagaagaggaagttgcagggattgggggtggtgtcgatttacttctcagctctggtgtcctttcgcacagaaagcatgctggtgagtcaggtcttcctggatacagggcttgggaggcaatgaggtgtactggaatgagatgtttttgagaccaaagagttgggttcaaaccctcaaaaagtcatgtaaatctctctgagcctcatggggctggtagaaaatacccaagggatagggtgtttgtgaggatcaaggaagttaacatatgtggacactctctgtaaatagtaaaataatataagttgctattaaatgattattgataagaccacataggctctggagagatccaaataggtgaaatttctcggcatgcatctccattcagtcttgctgttttgccttccttagttctaccagcactctcagaccccaggctgctgcgtgggagccccggctcaagagcagaagccctaaggtgctggcatgggctcctcagagccccgtggggctgccagcagccacagcacagccatgagcagggcagccaacaggaagcccaggagaagaccactgtgagaggccacagagggacacagggacaccgtcatcggccctgagccaggggcaggtgtaagaaacaagccggaagccctcacttttggcccaaatgctttggataggccagaatcccagagacaggaatatcagagaagccagcttccctcttatgaccaggccctggcttcttcatgtccttagggtgggttctacactccactcccaaaagcagggcctatacttcttcccttgccaagaaggtggggtggatggtattgggatctttggatggattcccaagattggagaaggtctcctttctcagtcttcatgggctgcactgccaatttctcattgaccaaactttaatgttccaggcaacgaggctcttggctataaggtgtcctcatgttacagaaatcacctcctctgacccagttactcccaaactgtttccactcttccttaagtgataaccttaatgacaagtctcatgcaaacagtaatttcttatcctttcttccaagagttcagttcactccagcaactggctactaactacttacagctgagcacagatttcacgcagaactgtgtaaagttgtccttgggaagacaaacacagcagccagttcctgccaccaagcagcacacagtctgggtgggaacagagacttcacgtccccaccacgaatggctgtgttttagagttcattacctgaaaagaaacagggtgggaggcatgtggggaataaagtgagcaggctggaggaggtcttcttcaagaaaacagagactggcccagctctcttctggctccaaaatgctgtgtttattgggttgtctggatcagaggcaaattcttggatttctgacaatgttgctatgatgtaatgagggctagaatcttcttgaatcaggaaagtttcagggaggttctattagtctgttctcacacggctataaggacatactgagactgggtgatttataaaggaaagaggtttaattgactcgtagttctgcatggctggggaggcctcaggacatttacaatcatggtgaaaggtgaaggggaagcaaggcaccctcttcacaaggtggcaggaaggagaatgaaagcaggaggaactaccaaacaattataaaaccatcagatatttcgagaactcactatcatgagaacagcatgggggaaactgcccccacgattcaatcacctccacctgctctctcctttgacatgtggggattatggggattacaattcaagtgagattttgggtggggacacaggcaaaccatatcagaggtgttatatagtaaggagcttaaaaaacagaaggatttcaacgtgtagaaagggagaggaagggagttccaggctgagaggagtgagtgagggaaagtaggagtgaagagggtacccagaaactggatgatccagcagctttagttcagtggggtttgaggcacttgggaactcaccaaggcgaacctgccacaagctacccagggtctccacctgccaaccttcagcagcggctctaggctgctgatgccagctagagaagcctgtctgtaaatgatgatgaatgtgtgagctcaccaagggagaaggccagaggagctcacacatcgaggagctggctttcaagggatggggaaagaaaggcaccagagaagcagagcgaagacgtggaaaccatagagccttactaagtgtgttcactcacccggctgtacctagggccacctgttgtcctcttggatggaggcagatcggctttctctctccctctctctctccctctctctgtcccacctcctctctctctctctctctcagttctgggctgggacagggaagaacagcaggactctattacttcaggcaaattttgacagatgggccaggacctgcatacagggccacccagcaggcgctggggaagggagcctgctaaggggctgactgcagagccaggcccaggtctgaagggccacgggtgcctggtttcaggttggaaagggtttcaagttgggcagggttggcaatggagcatcccactgaaaacagaagagcctcacccccaccccactgactcctgttcgctcacccctctgagcttctgcccatgccgatccctgtgtctggagcactgctcagggctccctcttggcatattcttgctgcacttttttttttttttttttttttatactctaagttttagggtacatgtgcacattgtgcaggttagttacatatgtatacatgtgccatgctggtgcgctgcacccactaatgtgtcatctagcattaggtatatctcccaatgttatccctcccccctcccccgaccccaccacagtccccagagtgtgatattccccttcctgtgtccacgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaaccgtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttcttgctgcacttttaaaacctgcttccaaactcaccttctccatgaattccctaactcttgaagtcaaaaatcgatcttttcctcccctatacactattctcacaacacttttcatacacaaaaatcagatatggctctatctcccccactggaccatagaactcctcagattagaaacggcactagggtcacaaattcaaatgctcacagagccaggcagataacataaatgggtgaagctgctggtttaggtgacatgggtggtaattgtcttggtgatggccagacaataggagtcactggaagctgtgatgaatcagaggggctggaatgattgattgattgagacagagtcttgctctgtcatacaggctggagtgcagtgatgcaatctcagctcactgcaacctttgcctctcgggttcaagtgatcctcctgcctcaccctcccaagtagctgggactacaggtgcatgccaccaaaggggcctgctgcccctcctgcccatatggagaataccagagcatgggaatgtgacctgtattaccagaactgcaattttcagggagaggccaggtatctgcattcttatatgaaattaccccatctttatgtgtcagcagcaaatccaaatttaagacaccatgttgcaagccaaataaaatgcatctgcagccagatgcaatgaaagcttgttgattgaaaagcaaatgaacaaatgaatgaaggaatagaaaagaaggagcagatgggtgggagggggaaacaggatgggtgcccaagtgtcaagatgccaagcggtgggctgggcacgctcaaggtgaccccgttgccaagctgtcagtgtgaacatcagcacggtcttgcttgttggctaaggggaagagaaaagcctatggccctgtgaacttagcaaccagcttctccaaaaacattacaatcagaagctcttgttgcagccaaaacacaggtgcagaaaacaagcgggcgttcgcacatgcacgtgcacaaggtgtgcagaagttgaaggctcagcatgccacaaattccgcactccctccaagcacaccttatgcctcatgttacagatgtcttgagggaggaagggagggacaatttagcaaattgggaggtgcagcaggggaaaaggagtcatccagccagaattctccccatctctacccagaaactccctctccttgctttgttgacggcgctgaagcttgggggaggcataagtgagcctggtgtgggactgaccctcagcctccaggaacactatcggcaggaacacagcccgtgtgggatgcctggggttgcaaaagaaaagttatttcaggttcaactgagttataatttattttttctaactgatcattactgctgcggctctataaataaccacctagggagtctgcttttctgctcccaaatcctcaaaaagcattgccaggttctctgtggtttctggcctgccaagcacacagcacatttcttttctgtgcagcccttcagggaatccttctgcagtgcatgccaaggaatctgctgagttctgcccaactcagtcctccccttcctgatccaattcctctcctccaaactggccatccagccctcctcccccattccacaagaggcccctctccctggacacaggtggttcccaagccaaggtcccggcttctctctgtttactctgcttccatccaactgcaaccctccatgcttagaagacaagagttatttgtactacagaaatccagctgtggcatcatttgaggtcaagcccaggaagaaaagagggttggtctgatggtatcaccagtaaaatatcaagggtcaataccaccccaggaagggtggctgtggtttacatgaaatcaatttaagtgatttaaagaagaatgtatttcaagtacaactcagtttaaccaagtatagaaaaaaaaaaatcatgttcctgatgatgttctaaaggatgtacgtttaggccctttctaaataacatggggttttctccttaaacagaggaactagacgggaactaatattcatcaagacccactccacaccaagcaattttgtttcattttcacaacatgatgcctatgaggtatgcatcctcatgcccatcttgtagatgggagtcctgagaaaaggacttgctcaaagtcatgcagaaggaaagaggtaggggtgagactcaagcccaagtttttcccctgctacctcctattacctctctaagctagaagactggagtttcaatgtatgtttatttttctaactttcagattacttttgcagctcagaaagcaaggacaacctggatatttcaccacagttccttaacagccatataactctttggagttagcctctccaactagttaactgtgaaatctcaatcaatcaatcaatctctctctctctctctctcaccatttattacgacaatgaccataaaggctatggtcattcaggttgctttaatggtctaaaaatgagagcttatgtatttttgaatagttttaaaaatgatcattcctaacatttacaaaataatggaaaacataagttttacccagtaatcaatgctccacggaaggttaggtggccctgcagatgctaccacagcactctgctctgttgggacaccttttccaccatattggaatggactgtttccttgtctgactctccttctaggccggtgatccccaaagctttttggtcatatgccctaacaataaacatttgagtgtacctgcctatgtgcacatttgtttatttataaattatattcatgccctgtcattcacaaaaatgggaaaaaggatgagatgtgtgtgggtcatcttcctatgtgtctatctacttctcaatcataatttcttcctgccccacaatggaccatctcaccttccatggtctccaacaccgacatcccactttggagaccactctcctaggatatgtgctcatcatccctcatttattcatttcccactgtctccagtaacacctaccctatgctgggtactatgctaggtgctggggatagtgggtgaaccacatggacaaggatcatgttttccatagagcttacaatccagcgggtgaaacagtgtcagataatgtcagagagagaaaacagccacaagaaagtaaaacaagatgatgtgatgttaagtgatggagaatgtctacaggggtaagagggaagtcacgatggaccagaccagcagctcagcaaaggcctctgtgacctgcatgaggagggggtctagtgggagagggggtgcctgggcagacagaatgtcaagtgcaaagcttccgaggcaggaaagaaggccattgtggctggattataatacatcagtaagaagagaggctggagaagctggagaggttggcagctcaggctggagagtcctgaccccactgcttactggctgggtggccttgggtattaatgctatatgctgcccagggttattaaaggaattatgtaaaggattgaaagagtaaatctatgaaacatcaacatcagttagaagaatgcccagcacacagttggcatcaacaaatgactgcccctagggtctgtttacttatttatcattagtctcccctgtggcatggaagctgggcctggccagttttctaccctgccgaaccagagtagctggcaccatgcccagcctatagaaagaactcaatgaaaatttggtaaatgaatgggttttaaaaatgggtaatggctaaggaaaatcagaatttggctaaatattaaaaaatagattttcgtaaacaattttttctaattataaaagtaatgtcatgtcttcaatattttaaacaaaaatggggtcatattctacataccgcttagtacctattttccactccacatgtctgttacaagaggcaggagaatgtaagggtagggatgtgggctctggagacagattgcctggattcacatcctacctccaccactggccacctagagcatctctctgaagttaccaagccaaaggacatttgggatttttaaggctttttaacacatattgccaaatagtctttaagaaataggtgtgagcccatctcctcaaaccttcatctacgctgactgctaacctttagacaatctttgccaatttgttaggggaaagaacaacctttcattgttctaatttgcctttctttaattaccagggatgactaacagtttttcatttgccttgttcctcttgcgaattgcctgttcatgtttaaaaaggaagcccgttttcataattagatgcagcagagtaggtggcctcaaagtgaactccctaccgctgggaagggttgagcagggccaggtggttgcccatcagggaactgggcatctctgtgccttgtggacagcagaactggatgagctctgaagtcctttattacactgggatcatttcactcttgtccagaccagcaaaggtagcaggcaaacctcaaagaaaagatggcttgcggatcaacaactggattctgaagacctccaccaggatttcccaaggtggatttgatgcctaaacatctctcataagcttctgcataaagacaccccagttatatcggagagaagagtcaaatcgacatggttatgcctctagtagctacagcatgccacagtgggggaattccttaaatctcccccttgacaagatggaaaaccttcgtggtcatagatcaaatcctaccacaacaaacatgttcataatcaaggtcagcatagcacaaagactcctaaggtggggccagtggtctgtttatctcaagctataacttttttccctgctttgcatttggctttggtacaagaatttgacataaacaccctcctaaccccactcccctacaggtatttacatagcaattttctcctgagctggtcaaaaccctgctaggacttggagaattccattgtgtttgtagtaagcagacacctggagccagatagctcttagagaataaactattcttggattggaaagggatctgaatgtatctgacgccctccttttgcaaaaattttgcagtgttttcagaggaccttctacattttcactaaggggatatttccccctaatatctccaccattgccattgttggagtttcctgctgggtctggcccccacaggtataatgccagctggaaacagaacactcacatctcttaaattactccactaacgaagaagtcacacgtggaattagaattctggctaattttcctgtgggcacaccttaagcacacaaacctgaaagcagcagagcagcgaaactggcagccaaaataaagcaaaaagaagaacatcttccaggagggaggtggaatcagattgaggcaaagccaggactaggttcttggcaacgtgattaaaatcccgaactacgagggaggagaggccttgctgccagcccctcagcacactcgagccagggcactggaggtgggtggtggttaaaagctgtgtgccattcacagcctatagcactgcctgtgtccgtcagtatgggcagaatggctaatgactccaaataaaactcctacaccatgctccatctggggaccatgttatagctgaatacacaaagtcactttgtagcttgcccgataagtccactttaattcctccaaaataattcatggaggcctgtgagcacactgcaccaggccaagcactagggttataaaaaagaaatgaaaaaagaaaaacctagttgctctactctaagggcttatgatttaaccaaggagatgagattcacaatggtagctggcaatacggtaaatcaaggcacaaagaatccaggagtgtgttctgctagaggcccaagagggcagctggcattttcaggaggatgcaggtcagcctttatgggaaaatggattgagtttaccttgaagggtggggaaattttaggcaggtggctaagaagtgagctggcctctggggatgtggggagactgtgagcgccgcatgagacaggctctgcatcctgcacatgctgcctgcatttccagccctgggaggaggatttgtgcaagggaggcagagatgagagcgttgataggaaggaaggaggccagatttcagagaggtctgaatcccacacagagaagcttgggctttctccaataagctgcagggagcagttggagacttgtgaacagcagattaacataattaaataaaaacttcaagactttagctttttgtggggatgcagactagacgagaggtgatgagaacattagaaagcttttacagtgtagaccaggctggccacggtgttggcaacgggagagaaagaaatagatctggaagataccacaaagcaaatatctaaagggcttggaaacaaatttggccggggggcggatgaaggatgagtcaggggcagttctgaattttaaaacttgggggatgtgaggtggaggtggcatcgtcagacataaagacacaggttcgagcagctttacaagaacttaaaaaggccagaccacccaaaggtggcactgactggaagcacgaggctacggacaatgcttcctcatttcaaaggggagttaacaagttaagtgaagttttatccaccaatgaaatggctgtctgtccaaacaaataagcaacaagtgtgggctctgcactcctctccacctctcttgctccttccgttgatgctcccctaacatttatctgaccataagctaagagcagtcatgagaacaagatagaaatcctcagaaatccagaactctaatccttccttctgctgaaatactgtagggcttagttattttcacacttatgcatatgcttcagtgtgtaagaactgagtcattgttttcttttctcctcccctctcccctctctttccctcctctttgccacccagcacctcctctgcctccacccccaagccactgcaaacatcctggcatgcatctctccccatccatttctgcatggctgtcaacatttcccattccctccaagcttgcctcctgcctcctatttctttagacacactgggagtctaagaaatgaactacagattcaacaggactgtggaccacagatcttgacaaagacaggcagcttgttgtgaaaagagaattggagggcaggtcagagacttaggttttaggagtcaggcaagggaatcagataaagatccctgaaaacaagggatatcatcactgcccagctttactgacgtagagacaagttttctcacttggcagatatagacggaagataagcaggttccctttcagatggtaaccccaagtgcagtggctcacagctgcagttattctgaatggcagcgggagggaaggaaacaatgaatgcacacacacacaagagcaatgcttaaggtgaaatggacttgaacagtctcaaatgcacacctcctccagttcctggaaggcaaggatgagtcaaacagaagttgaatttcacaggcgttcctcctccactgtcacatacgttcccagacgcagagtcatctgtgcacatgtcacccagcatcgactgctaccagcaactgcctcctgggaagttaagctgcagggtcagatctgcttctgctggggagctgaaagtaaactgcgtaaggtgggggtgatcccagtaatgtgagggcaggaaaaagcagagaacgctggaaaaggatggcaggaattaacatggctctgaagagaggagccaaggatcacctgatctgtagagcctggaatctgcagttatttctagtttcctagacaaccctgactaaactaggaagacatctgaactccggctcaaaaataatataggttcttggaatgggacaaaagaagaaaggaaaggggaggtgataccatgtgccagttcagggagtggggaccagaccttcagagaaaggaaggtcttcccaaatggaagctgaaatcccagtgggcattatgctttctgtacttttgcatttgtagccaagagcatgattctaattctggttctccagcggaggtgcgggcagcacatgtgcatgagttcgtcaaaattgatctaacggcacacataagatctgtacatttcactgtatgtaaattagatcctagtaattctacctctctcaattagttggttgtgtgaccttggacaagtcatttaaatttttgtagtccaggattctccatctgtcaagctgaagctaagaagctggcctctaagtttctccctggctctaaaatttacgattgtgagagctgattattgcaggaaatgagcaaatacatccagattaagaagggccgcaactattgatagaagctaagaagaatttctgaatgggattagccatctgcagaaaattccccctaaatcatccatcctggaatcagacgtggagagaggtgaagattccatcctctgcaccaaaaggaagtggcagcccctcctggctctgcattttcccctccttcccatccgctctcccctacagactctctaaattcttccactggagattccccaagggctcaggattgggacaggccttttcttcccttccttccaaatttcctttgggtttatagcaccctggtcgggttcacaggaagggaaaggagagggaagaaaccattcacatttgggtgtgcgtagcaagcagagagctggagggttacagaaacttagaggaggtcagagccagacaatcatctccccatcctatgtcttatggataagaaaatgaagatgcagaaaactagtgtgacttctcaccatttctaaagccccggaaagaacagatcaaggaggcagctgtggccatcttcaggctggttctttcacatagagatgctcctacttactccataaatagtttgtcatgggcaactttcagacagaggagctggaactaccctaaccgggcactggaacatgtgtaagtagaccacctggctcacctgtttctcttctcagaggggctctgagtcatgaggagaacctctggatatgcagaatggataaactgcttctgtcaggatggaaaggaattcacagatgtcttgccagcagctaaccagtgacacagctgaatggtagcaggcccatggaaacactctggataagaaagactatcaaaggagcatcaggtccagattgcaaattgctttagcagctaacataggcataaagacagaacgacccactctaatccaagggggttacgcttcagcgctggctgcctctgactctcacccttgacccagcccattcatcagtatgttgataagcagattctcttcacagagctccttaatctggtttcccagggaggtcttgcagagattaatgagagcactgtgcttcctgccagtttttgaggctgggacagttaaacagcaagggtgaaggagcttgtcataaagtacacaaaccatcccatcattggacttgaccccattaggtggttaactcaaacatcttctcaatgtagacacttggatctattttttttattcactctctccttggtagccagcaaaattaaagcccttcctcatatcatcgttcacgccatcttttataatagtcacagccacaacagcagctggggctaaacaaagattaggagcaataaggatcagatgggacagacaggagatctggtcctaccaaggggcatcaccaatgagctggacccactgtgcagcccacctgtcaaatgccatttgccacctctggcggtgatagcaggggcagctggggctgaatccatgaatcctgaggtctcacagaagtacagccacccctgtcatctagcccctcccctcagaatatgctctggggagctgtcacatcccacactgcaggctgatggaagacacagacacactcttgggtcctggcattatcgctgtttcctctggttacctttaaagaagggcgtctctgagtgctgggtcctccactggaaataatgtggggaaactggatgagctctgcagagatgagaattattttgaagcaaagtaagaaatgaccagggaactctagattggaatacagcttgtgaattcctaggtaggtgtagactcaagagtttataggaacttatatttgctgttattttttaaaagtcttaaaagttaaaatttacagcaatagcaagaaggaggacaaagtgcaacagctttaactatgagctaataccaaggttaacactatctgtccattacacgtagctttgggatttggcaaaaaggaaaaaaaaccacataacacggagctttgagctcataaataggtcccaaagacttgacaaataaactaacaaggcttttatggtagaagggagcatcgaaatctgaggccttctgtgccttctctccccgctgctgtgatggcagctggcaactgggccctactgtccattaacaaaacagagagacggataactatccagccgaggccagcttcctcacaccaggcagatccacagtggactctcaggaatcttcagcaccctttacaccagcagtggtcaaagtggggggtgcagctgccttgggactgagagatggggatggacacatctgcagggaggggtcaggctctagcccctttccccaggccaccactcctcagaggctggtcctccaccccagcttcagggacaggggatgcatggtggaaaccactgcagctgctgcattagcaaccttcaagagccaaagattctcttctctctagccagagagggaaggcaaacaggttagggtgacctgcagctcagggtcggccccaggccaggccactgcctgtactgactcctgggcctctatgcagtgcactccactttctagggcaggctgcttgccaaggattcacagtggacctggctgctccctgtgggactcactggatctggacccaggaccaagcctgcttgccaggagcagaaggtcaggttggtttaaaaaggtaacctctgtcctttcccagttccgttcctttctcttccccagctacctcctcctcttctccaaatcagccttctcttggctcagtttctgaccttgggtattttccccaaggaacacatccgaccatcaggcactcaaaggagcatgagcctagtcttttcctcaagcaaatcaccccggtacagtcagcagctgcagagcacagggagctcctggcatgctaaaggtcatttacagatcactgaaaaatctggacaagatgctaatgtcccagctcaatgcccatgtcctgacttaaaccttgactgtgtcttaaggacactcaacgtcaggatacctatgacagaaagagggacttctgagtatttcaggcataacaggcaaaacagacatctttaaagcttgcaaaatatatgattctgtcattcctctgcatcctcaccaccaccatgatggagagccagggccagtctttccaatcatcactcaagcttccagtggctattgggcactctccctcttagagaggggacactccagcaggaactccaggtagagagctgttctgcagtgggcatttctagctcagggccagcctccgagactctccaggagtggcatgaaatgaggtggatggggcttccttgtcctggccatcatgtgcctacagcaggcattggcaagctttttctataaagggccagaaagggttatggaccatcttctttgatgtttttattttacaactctttagaaatgtaagaatcatccttagtttgaggtgccatataaaaacaggcggcaggcaaatttggctcacaagcaggctgcagtttgcagaccccctcctagaggaagatgctgaggcctcaccaagcagcccctccccaccttccctctctagcctgactcctccagactcattccagctgcacgtggcacctgtactaggccgcaggatggccttcttgctgcaggcatttcaatgagaaaatatgctgcatggatcatgagtgattctgtctccctcgtgcttaaccttggaagcacaaggccctgctggcctcacctcaaggtctcacctgcccatactcatgcgaccttgtccaccatctctccactacgaggtgccatctggtaaatggcctaacttgggttcttcctcccacgcctcctgtgtaggttcagggcagggagaccaaggtaaatcctgtcagttctatctgaaggcagagcctggatccaatcacttcccacccctccaatgctatcacctagaacacagccacagcctcccatctggactccctgcttcgatctctgccctcccccctccccttccaaaagctcccagaggctttccatctcactcaaaataaaagccaatgtctctgagcagtgaaagccacccaccatggtcatccaggtcctatcactgacctgctgagccccaactggcccgcatggccacctggctggcctcagtgcctcctctttcccctagctgatactaactccagccacactggcctccttcctaccctgcttttcctcttagccatgaacaccatcagtagttatataatagtttgtgggggtttttttttttttggtcttgtttttctcactcaaatataagctctgtcaaatagagtctgacttcagtgttacactccagggcccagtgtcagccttgggtaggtgctctacaaatatacaaatatttggagaatgcatggggacaggatgccctgctgatgggtgagagatggtggcactgtcatgacactgtgtatcaatttgcacttggatacttttatgcaaataagtctcttgctcttaagtcccctcctcccccgccttagtagccagatgaaccgataagacactgaaaacagatacacccctggagacactagtctccaattttttgtttatattcaaccctaaagcaataacaacaaactcatattccaactgaactagtcaattatctcaggggaaaacaacaaacgattgctttatggtttagagcacacctgtgcgtggctctcccgcactcaccacaaccaccctcccatgagcacagcaaggaaagagaaagcatgggcttgctcagcagaggtctgggtttcaaatcctgacactgccatctataggtggtctgattctggacatggtaccaagtacactaggccttagctttaccatctgttaattggggatactaacacttatttcgtaagactgttgtaaggcttaagtgaacaattaaaacaaaacagacacctaaagcataatgactgtgcacattaattgctcaataaataggaatttctccccttttgtaagtgaggaagcaacagttcagaatgtgaaatgatttgcctgagatcagaaggcttgttcccagcaaaggtggggttcaaagcaatggtttctgtggatgtattttttccctagcatccagcctccttcctgttcatgtctacaccctataggctacttatgtcagtagaataaaacaggtgatggctctcccatcgacctgcttgttgaggattttgggacagttccattctaggctaatgctcattactaaagacaatgctcattaataaagacaacgctcttaaggaggtcaccccctcacacggagaaatctgtgtgtcacaagcaagggatcaaaaaagctaagagaattcacctgccctggatatcaactgcccttaagagatgcaaactaaaggtgactgccttcctttccccaagagacaaacggaaaccccactcagtgtgagaagagcacatgccatggaggccccagaccagtcagtgcccagtgaggagatgacagagcctgacgcagctacatctgagatcagatgccaaggacacagcaaagactgatgaagccatacgtgagacaccaaagtacgaaactcacattcaactcaaaggtttccatgtttgatgactgttatctccctgcacagtgtttttctttaaggagcacatgtgttctataatcctataaagtaaatttttgaaaaaaacaaaatgagaaacaaagggacacacagaaactcttgcaggtgacggatatgtgtattaccttgcctgtggtgacagcatcatgggtgtaagcatatgtcccaactcattagactgtacacattaaatctgtacagttttttaatatcaattataacctcaataaagttgaaaaaataaagaaaatttttgtagaacaaaagccttctcccattagctttcatcatgacattgaaatgtgttcctcttgaaacatattggcccctgacattataaaaatataaattattaaggaacaaatcttacaagtaacacgtttggaggacaaacaataaagagatggcctaaacaatgtctaaacagatttgaaacggagcagaatgtgagtgcgtctgactaaaagaggaggcttttctcaagtgtcagtcctgagacaaggaccctgggactgctgacatcccaaacatagtgcccctatgactccaagaagggaaggtgctgcaggggtgacggtccctccccaccccaccatcctcatctggctgatccctgctcatgcctcagaccttagctgaaatatcacttccccaaaaaaagccccccagcactagattgggtgactcattcactcattcactgagtcatccattcaacaagtgattactgaccccctagtatgagtcacattcgacttatcactctctcttttcaacgttgcaattaaataatcacacacacaatactgatttactgtctgtcaccctccctaaactgtcagttccaaaaggacagagattgtatctgatttgtcatttcattcccagcgcctgacacagtacgtgcaacatggtaggcatcctgtccatactggccgggtgaacgtacaaatgaatgaattaaagcatttgaaagctccattcatattctaaaattccaaaatgcaccctgctgtctactttacacagggataattgatgttacaatcaatatgacttttaaatttaacaaacgaaattgttttatttattaatctactagtaagtgaaaacaataagatgtaagacaacaggaagaaagttactctccctgagaggacagaacctgcaggtgttatcctgggactggcagaagcagcatagggtcatcgctgaggggagtgtggatagagtcaggctatctgggttagggtcttgacccctccactgaccagctatgtgactctgggcaagcaacttaacctctctgtcttccagttttcaaatctgtaaattgagaataagaatatcagcttcagataatttcattaacaagtaaatggattacgacacgtgaactgcttagaacagtgcctggcacgtgctaagtactcactaaatgtcagttgtttttattttctggaagaatgggaacaagatgggttaaaaccaaggacttggacatactgtcactaaattcacaaaccactcagaccaaatctccaagatttcctattacaaaatgaagtaattcaaaggcaggtggctggatgggttatctactccaacttccagacttactgctttacctatagaggtgatgatgccttatccatctgaaattaagggccaggtcaaacaaaccctcaaggtttctccaggactggagtctgggatttgattttatacaccccacagtgcccagcacaatgacgaacatgcatttaaagcttagaaaatgttcactgtgttaatttacaatgaataccatttaaagctaaaaaaaaaaaaacccctgcatattctaaagtatattatctagcatatgtgctagccccagaagaataaaatgcagaagtgaacaggagttgcttcatggaactgaaattaattatacacaattatctctgagatctttaaacagtaagtgaacaatgaaaatgtagattcagaattctcctggtaatgaataagatgatgaacatgtttccacagagggtgggatcaggttgatctgctgaaataaccagatagcaggataatttcactatctacgtgaaacattatccaagaatctgtgcgttactcgacaattaaatcagttcaaatgtcttatcaatgatttcatagaacaaccttcaatgagttaacaggaacccgtagataaaagacaagaatagggctacgtcaagaagctcaaaatcctcagctgctgataatgcaaaaccttggccacattgatgagcccaagaccaccagatctctttatactgagtcattttttaaagaaaacttttattttatatgttagttttccttataaaaataagttgtattgaggtataatttatatacagtaaaatgcaaccatttcaagtgaacagtgggttttgacaaatgtatatacccaagtaaccactaccctaatcaagatataaaaacttccataatgccagaaagttccctcatccttgataaaagaaaaacttcagccgaattaaatttaaaggagtttaattgagaaatgaatgactcgcaaatcaggcagcccccagaatcacagcaggttcacaaagactccaatgcagccatgtggtggaagaagatttacagacaaaagaaagggaaatgacatagtacagaaaacggaagtgaggtacagagtggcgggattggttacaagttggcatttgccttatttgaacacagtttgaacacttagcagtttataaatggttgaagtatggccacagggattggccaagacccagctattgttacaggcacatactcctaaatcttgtctacctattaagctaggttgcaattcatccacaagaactcaaatatagaagtacggagtccttctcaggccatatgcagtttgctttaacacactctttctcggttaatccctgctcttatctccctctatcccaccccaaggcaaccatagttttgacattccccctatagattagttttgcctattctaggatttcatgtaaatggaattgtacaatatatatatacttgttgatatctggcttctttcagtctaatgctttgaaaatccatgcatgtttttgcatgtgtcggtagtttgttcctttttattactgaataatatctatttgggtggactgcaagttgcttatccattccccagttgatgggtatttgggctgcttttagtcttggactgttttgaataaagctcttatgaacatccacgtacaagtcttccaccaacatatgtgttcacttctcttgagtaaatacctaggagtaaaatcactgggtcatatgctgtgcatgtttaactttctaggaaaatgccagatttatcctgaataacagaaatgatcaactgatttactattaaaggacttactggattttataaggaaaagaggaaacgagacgaaagaaaatgtagtgcatctgaaagcacatgggggctgctttgctgaaggggctggcaggcggcttcccaggcagggtctgctcaggactgctctagccagatgcctcccctggtgtttacttcacccacaggaaaatggccaccttcaccccaccttcagtggacgtgcagccccttcggtgctcctctcttcatctgccttcagaggtagtcctgattaacctgttgccagcagaattttctaggagagacaggacttgggggtaccactaggccccggggacatgcactcagctggcccaggcaccgataacctagcatgtccttttagaatttgggggatcccggcacccactgttctcagctttgggcctcagctaaggccaggacaagcatcatttaatgtcatgtcatataattagtatggaaactacaaaaacctatatgtttacaaaacaaccactgatctacattatttcagaggtaatgatacttttacatgagataacttcccaagacactaagctgaaattagataaatttaggttttctgtattctcgctgacttgtgtttttcacactggctttatcttggtttctgagggagaatcaattctctttaactctcttccagaatacctcactaccttcagaaaggaagaaggagggaaaaaaggacagagggaaggaggaggattagaattcctcatatcagagaatcccagagctttgaagctttaaagtgaattcaagagtgggattcaagagaccaaaccatggggtctaggggaaataaggaacccctctcccagaaggtggagaagcttctcaaagcaactggcccaggcagccttgtacttgcttcattctggggtcaggaagaagctgcaggccctccttcccaccctcgcttcccttctcctccacactgtcaactctgctccaggaaggggcagtatccccagtgtctgctgggccagcacagccatctctcacccacctgagttcataatgactcctgtgtagagcagacttcccttggcttcactgaaaccattccttcttgtcttagaaagcaatcagaaatatagttaactgccttaaagttcccttatcattgaaatgaactagatcacagaagtgcctatttgcattttttattcttattcactgggtttttaaaaggagccaagagaggggagaggaaatgcatttacttgctgggatttcacttgggatgttcatgttcgtctggaaagcaaaataaaggcatgaagattgcccactgatttcctttcatttggagaattctgcttgagttaggcttagctggctagcacataaacctgtcaagagaaaagtcttcctcttcctgggcctggtatgtctaccacctggggcttcagagacagtattctaggagattcacagtgtctaaggttcgaaatgtggacttcagcagcagggcagctgccaaacgctttcctgcccttgcagaaagccaccaccaaactcaccaccacctccctcaccgtggcctctctgtttcagtatctgagcagcgggtgaggaggactggattctagaagataaagagagactccacggtacagaaagtaagccctcaataggattctattagaaaacagctggaaggaactgtggagtcactcagtcccatggctgattttacagacaataagcaaacaaacaaacagaggccctgagggatttagttagcggtctccaagtgccagtccctgaggaaaggattctcctccccagctacctttcccttctccagtgtgtccacctcaggaaaagggcttgcatcctcccagctgctcacacacaacttgggctggccttggtgctggctctgtcctttctcccaccagatctgccttccgccctcgccacttgtctctgcccagggctcacttggaaggaccacatcaatgaacaaccttggcaggtcacagggagggatggagcgggggagagaacagcaaataggcttctgccctgcaagagagggagagccagaataccagcctggcttgggctgctcccgaaggtcctggctgctgcctgcaatgcagcgccttccttcagggctccagcaccatcccctgtcctcagcctttaaggctctactgctctcagccccagccctgcccttgaggctcccctgtaccctgtctttgtagatggtgcctgggaactgtcccgcttggagagtgctgtttgctaggatacacactgactcccatggctcccctccagctccccatccatcctgctcctggccacggcctctggcctgaagggctgcaaaacagccttccaactgggttcctggcttcccttctggcccctcttcatctgctgtccccagcagcatacagagctatcccatgaaatataagtcagaccatgtcatgccctggcttaaaacctctcaatggtttcctctggcatctccagtaaaaatcagaactccttgctgacttttgagagctgctctagacagggctgctctctgcagcctcctcttgtgccccgagcttcaggacactccagcagctgtggggcctcctttcccttactcatgaccccaggctctgccctgtctctgggcctcacacatgctgtccctgtgcctggcaggtgccccgtcactggtacaggctgtccccacccctctaggagagccttgccttagcagggtacatgccctgcaccttcttctctccacgaatttttattctctatccctggactgtgctcatttctttccaaacacctaacaaatttgtaattatgtgattttttgtttactttttaaatgactctctcccccaccgggatgcaagttccacatgggtacgaactaggtctgtcttgttctccacctgacatacaacagctactctagtcacatctacaaaacagcaactgggtttgggttcctataaagtggacaactctcctttctggggaaggattgcttcataatctgagattatgttccttctactttgttggggagagtgttaagttttttttttttttcttttatgaaaggatagtaagaataaggggtattcatcaaaaatttttaaatgataacctgatataattctccaaaatgtttttaaaatttttgagtctatgatatcccagattaagcaatgttttgggagtcacagtgttgggtcctagagaggcaaagagataggtgaagatagtgacagagaagagaccggctttgcagtcagactgcagggcctgggttcaagtcccaactctgctgcttggtagctgtcaaactctgagcgagttgcttaaactctctgtgccttagtttcctcatctgtaaaataaagataataatagaacctgtttcagaggactttataagaattaagtgaattaatacttgtaaagttaataaaacagtgcctggcctatagacaatgcttgacaaacattactgctatcattattatctattattattattattgctattgttattattactaaacccaggtctcctaaatccccaaccaggactcttttccctttaaaatgttatctcccagcattgtctctttaaatgttatctggccactcttaaatgtaagactgaaattcagcacttggaaaactatcccactccagccaagcacattttttgaatagctaaacactaaccctgataaaatgtatccatttaggatagaaatgtttctacaatatgttacatcttgtctactttctaactgggttttttgagatgagtatcattacagaaattatctgctgtgcagcctggaaacagcaaaaggaaaactcagcacgttctacagacgtgggttcaaagccctgctctgtcctccctccaagccctaaacccctcctgagtttcagtttccttactgaagaagtgggaaggccatgtgcattgagaggttactgtggttttgagtccagtgaatacacacactgctaaatcctaaaactcttctttcttttttggttaataatattaaactcatccaggagaataccttaatttaagactccaggcagaattctcctttccccaagctctgccaacacccaaacccctccccagaagacagcctggttcacacaacagaggaacagacccctcacgactctgcagggggaattcctttctgggagagaacacatgtccaatagggccagtccccactcaggctgctgctgtcactcagccagaaggcaggacaggcttttgaagctgtgatatttctgagtttggttttggacaaaaacaccattcttcctcatagcctttcacaccctgattcaagcaattttaactgaattctatttcccttcaatagaaggctatttgaagatacaaaaaccatatttgtgaatgaattctaggattgtatttgcagagtcactcctgttggatttcgtgctctataccaagtgtatttctacctctgggcctcagaaccatttctcacaccccccaacaatatctcatgccctcatatcccaaatatgcaattacctatcagttgtgaaaggtaaaaataaaattcatatgggtttcataggtcaatggttcatgttaaaggagacccatattaaataatattattaagtagatatttataaggctaagaataaaaggtggggaaatgggtgggattcatcttatctttctaatgttcattacctagaacctggaaaccaaatcaatgaattttctgactacagactcaacaaatatcatttgtttttaatgataatcagataatttaaatcagataatctaaatcaggtaatttagaaatatctgatttctaaactagtcctggactacacttacaaagaaacagcactgctatagagaaaggatgaagacataaattggagacaggaaacaggaccagattcagaacactattcctgcatatgagatttaaagaaatatacatacataattttacaactcctacaaagcctaattttatttgtaaaatataccagggtatcttagcaagtttctttggaaccacgcaactaagagtgctttttaattaattgcacatctagcaatccacaaatacgaattaagcaccatgagttggcactgaggagaatttaggtctgttctcccacagagcaagcaatttgcgaaactttgctctaaaacacataaaaaccctggccttagctaccaattttaaggatgttctattctgcaagggttcatcttcattctctccaaaaggatatgagggtcctgctgtatttcaatggaaccagacccccaaggctcagaaatcaatcatttcacaagaaaaaaagggtaagattatatctaaacatttcattagcataaatctgaatgtgtgatatttggtcattttgtcttagtttacaaccacctttgcaagtgataaaatatagattgatggtggggagagggtaggagaagaaaacaccacactcacatcacgggatctaaattccaccagcaggggtgggagctgaactggcctaacctgaatgtatgtacaaaagaattccttccttcctctctccctcccttccctcctccctcctcctccctctctttctaactccctcccttccttcctctccttcccccctccctccctctcttcctccctcctcctccctctcttcctaactccctacctttcttcctccccttccctctcttcttccctcccttccttcctccccatctcctgccctctcttcttccctccctccctccctcccctccttccttttttttcctacctttcctttccatcaacaagcccaggtgatggcagggataccgcatactccacttgtctcttccacggctggggatggctctatcagcacttgccccatttttaggttttacttcccaggtcatcccagatttataatccatgcataatgcaggcacctaagcacttctgggcccctactagaaatccagaggcgaacaaggcccagtgcctgcctgttctcaagtctccatgcaatgggcaccctagcggaaagaacacactctgagattaatctggcattgcaggggacttgcaggacctgttccaggtgcctgacattatctatctagaagaggtctccctttcagcacagttattgcctacatgaaggtggcctctctcaactgcacaggatgtgccattcgccaaggaatactaggcatccctccatcgtccagacagatctcaagtgagatgctcaatccctataagggttggtttcccctcagtggattacaacactcagatcccaactttccactgcacaggataccttgcagccatttggttttgaatgaccttctcttcccctcttcctgaaaatataagtttccttattgaagccaattaaagccaattctgctttaacatattctggagcacttcacagcatgctttaaattaagcaggaacaccctggtctagtggtactgcctccaaggcagtcctcccttcatctccctgcctccagccaataccctgcttctctgtctcctcagtccacctctgcctgctctgtccctggtttcctccacctagaaaagtgcatccaactgattttaagtacctctgacttaggggtaccacactgtgaaacctctgcttctatttcctcttctataccttgcattgcaagaaaatctaggctttttattcattttttagaaaaattagggaagtcacagcctaggtagttactagaagaaacaggcaaggccaagaaaaatagccaactcacatagagctcttcttaggtgcctagcatggtcttaagtgctttatagatactgaccattaaacctcaccacagtcctatgatgtagatattattagtgtgcccattttacagatcatgagcatgaagcccaaagaggctaattagcttgcctgggatcatcctctcttttttcttttttctgagatgggtctcactctgttgctcaagctggagtgtagtggcgtgatcatagcccactgtagccttcacctctcagtctcaagcgatcctcctacctcagcctcttgagtagctgggaccataggcatgccaccatgcccaagtagagatgggggtctccctatgttgcccaggctggtcccgaactcctaggctcaagcaatgcccccacctcagcctcccgaagtgctgggagattacaggagtgagccaccatgcctggcccatcctcttaataaatggtagggctgagatttgaacctaggggcctgactcaggagtgagtactgcttaccaggaagggaatgtggtcagcatgacaacaaaggcatctctgtcctccttaaatgcagcaccaactctgtaaacacacagcaggagctctagatacaccacgtttgtacacatttactgagtctacatttccatgtcaccttcaggaagagtggattggcttgggtgaggagaaggaagaagagcggagacttccgcccttgagagattctattttaatttttaagaaaacactgaacagaccaagccctggatttcaagatcagttttcgaggtctccagacatgaggcagtcatctgaaaaggaagacatgacagaggagtctgacctctgtgtggcctccttgctctccctgcactgccttcagatctcccagtgaataggaaaggaggggagacctgcatctgtggggcgagcatcccctaatcctgataggcttcaaaaggttgcgaaaggggccacattctctagtactaagacaatggcattaaatctaaatttcttgataaccaaactaaggcataaaggccagttaactatgtctagttctaatataacactctggaacatgccctgtgttatcttagcctagcttcctagaaatactgaatcgcaatattccacaatgcaagttcctcccactaaaggcctctttggagaaaggagttggctgtgacaaaggctgtagtatatagaggatgatcgttatggtggtgatgacaacagtgctgatagattagacaatagcaacaatgaccatgagggcaacgaagaccatgagttgtgcaacatctaatacaggtcaggggtgaatacttttgtgctgactgcttttcaagcattattatgttatatcttcacaacaatgatgagaggtgggtatcagcacaatgccccctttgaagatgaggaggagttagatgagaaaggccaagtctctggggcaagttgccataatttgggtcataacatgaacccaggccaatctgactccaaaatttcacattcttatccactgctcatctctctcttcctattagaaaaccttattatagaaagttctaaaaacgatatgctgattagtcaaattttctggtaaatacatagtaatcagttccaaatactcaattgaaaaaaattgccaaaatgttcatggtccccagtcctgccttagtaaatatagcacactaaatataaatctagttctactttattaatagacacatgatggactatctcccagctatttgccagaacaatctgttcttattgtagagtatttcagatgtaggtacagcattgagaaggaccatacactcagcccagggcatgctctgaaactacggtattaaacattaaaatctttttaaaaatgtgttttattatttgcctttttcttacaaaacttcagtccaaattatttgggttgataagtagaagtttcactgtagtaaactgtaccaatggctgcctgtggtatgtccagagtgtaagagagttgatgagaaacaacaaaagaaacaaacaaaaacttgaaaatataacaaaacttggcataaaaattaaaatgaccagccccctgatcctaaggaaagtccattttctcataggggcagtcagtatatttttatcttgtggcttaatgtttttgtagacacattaaatcataaaaatccaagaaaccatatctcactcccaaaccacacaatgtattttaaggaatatgtcccttttctaagaaactgcttgattttcaggaagtggtaaagtggcaggtgtgttcccatgatcagccagagaaaccaaataaacgttccactgggcaaacctgtttctcacagataaacagctgcgagctgcacgcgggagggaaaaggatcgtaaagactgcccctatgtctgcctgacactttctggttttctgtttcaattgaaaaggaagatggcagcctacaactgagcagaccctactgtggccaggccaatcccagcccctgcatgggacaggagtttcaaaatcccagcactagacagaaggctgtggtcatctctcctctaggtagacctgggaagggataattaaactaggagttgcaggagaagcagatttcccatgaaaaagacatcatcacacaattaatagctaggcttgataggaaggggaaggaatgtccctttttacttacttccaaggcagcctccaccttgcttctcataccacccatcacattggaaacaatcaccagtctgtatcctcagcagactgtgagctcctggaagtcccctgggcacataacaagcactcaatcaatgagaattattgttattacagtgtgtgttcaagaaatatctgttgagtgagtggaacagaggaaggaatgaaataacttgactttccatttggaaagtgtcttgctaaatccttgctgttagagttcaggagttgggataggatttcctatactgccactttggtttgtcatgttgtaagcagggttaaaggcaaatttttaaaaatatgagacagggctgaactggctttctgtctagaaattctagattaaaataagggtctgtctaggagcggggagccagctggctatttaggaggcttggaggttaaagcgaagtctaaatggagtaagagacactattccaaggggtcccctggtcacacagaaaatacaggggcagcattcagactacccaggagtctgcaggacttggtatgaaagagcaaaaagaaaaaaatatatagacaacctaggaggtctgaggactcacagacactgactggctggggtgggactggcaggagctgctgggaaggctggggcagcttctcagtggtcctggcagtaaatactatccaggaaaagtgtgccttgcagtgagagagctgctgggaaaacggcctggacaatcagactgcagtgctgtgagctagattgcccttcccctagccaagaggtgtctcccaccacccttcccctaagcagcataagagtgaaacggggtggacagctaatgcccactgacctcctgctatggaccacaggcactctcctgcgaaatgcttgtgaggttggtgacatcaacattacactaatgacaaaactgagcctgagaactgcaactcacctgcaatggtacacctgacagcagaaccagaactttcactgaaggcttacctctccagggccaaaagagaacctgtgaccccacaggatcgagcctgccccctcaatgcctgtcagaggcagcctggtgggtgcagaatgtgatagcaagttgctgttggcacggcctgctcttctgacagctctgcaggttatttctcacaactttgctgccagcttctccctgcctgtcgctgacccctgtcccagagccacctccatctggaaacacccaccccccaactctaaagttgtaaccatacatacttaagctagaaaatttaaaaggacaaagcagaaaggaattaagaaaaaaatggagtaacctattattttacagagaaataattttaacattttggattaattccttcacatacttttcttttgagatggagtctcactctgtcacccaggctagagcagtgcagtggcgaaatcttggctcactgcaacctctgtctcctgggttcaggtgattctcgtgcctcagcctccctggtagctgggattacaggagcacaccaccatgcctggctaacttttgtatttttagtagagatggggtttcatcacgttggccaggctggtctcgaacacctggtctcaagtgatccacccaccttgacctcccaaagtcttgagattacaggtgtgagccaccacgtcatgagccccctccagtaattttctatgcatttagatgcagatactgtttgcctgtctttaaaatggtgttgcaccagactaactgtttagaggtccacttccctgctcagctgagcactgacacatgcaacctgccacctgggaggatgggcaggcattcccgaaatgccatcatggctgctgctaaccatcccgggattgcaggcaagtgcggctgatgcagaaggacgttggggaatgcggacatcaggggtttgcaaacttgtgtttctccctccactgcccatcctgccagcctcagaaggttagccatggagggtgggccaatcccaacatactcaaaaatttaaaatcctgaagggttagcattggaagggattttagaggctatccagcccaatcccctcacttgcaaatgaggaaagcagagctgagagagatttagcttgtgctgggttctaacagtggctccttgccaacctcaggctcctcctggtctaccgtctgtgcctggactctgctccagcacccccacccacccacccacctgccccacttggcagagggcagcagccagagaaggcaggcccaggtgggggacaagagtctcaggactcacctttcaaatttaaagaatctctcgttaccatcaccataactcttagcccaaccattcctcttcagatccaaggatatctaagtctgactgtggaattttgttgcggaggattggatacagctgtcaaattccaaaggcatccagtacccatgctctccacagagcagtcccttattatacaagctctgcaccagctgagaaccatgttccagtctcatattgctcagaatctcctctgagcttcacataactcaggcacaatctccctgaatcatatggcataggaaagtcatgagcagtaagacttggttcaagaaaaaataccaagttctgaccactcaaagtacccttaggtgctctcattcatgtgagctttccgtttcctgctctccagccccatttcttatttgggttagggatcccctagggctgctcagtggtagggggccactgaattcaaagcaggccactgtactcgaagtagatggctaggaaaaaaaaaagggccagtcacagtggttcatgcctataatcccagcactttgggaggctgaggcaggcagatcacttgaggtcaggagtttgagaccagcctggccaacatggggaaaccctgtctgtactaaaaatataaaaattaactgggcatggtggtgcatgcctgtagttccagctacgcggaggctgaggcatgagaatcacttgaacccaagaggcagggggtgcagtgagctgagatcacctctgcactccagcctgagtgacagagtgagactccgtcaaaaaataaaataaaatccttccttccttcctccttcccttcctccttcccttcctccttcccttccccctcctcttcccctttcccttcccccttcccttccattcccttcctttcctttcattccctccctccctcccttcttccctccttccttcctatttctgagcacttctttcccaggcacaaggtaaacgagctttcaaatatagcacactgaatacccatgataattctataaaatggatcctattcttcccattttaaagatgaagaccccaaggctcagagcagtgaggtgcagatttactgtgatgctaaggaagaaagtttcagggccctgccagcatggacccctttcaaggccctagcaatatattcttagaatcatgtaatttttaaatgaaatttgcagtagtaagatattttaactgcaattgatgaagagcactgtatctttcaactctgatgtctcctcctgatacatttcccctcatgttcatattgaatggtgttacagtagctataggtgttttgggatccagcataagggaaagttaatttggggataaatttagtttgggtgtagtgggatttatgtctattgttcacagtcacgttaatgcaaagtcaagtgattgttagctgtccccatggcttccagtgctaagctttccacaactcaatggctttgagactcaaaggtgcaatacctggcacctgagacataaaaataggggagaaaaaataggattgaaatatacagagcggtccgggtgcggtggctcacacctgtcatcccagcattttgtgacaccgaggcaggcggatcctctgaggtcgggagttcaagaccagcctgaccaacatggagaaaccctgtctctactaaaaatacaacattagttgggtgtggtggcacatgcctgtaatcctagctactcgagaggctgaagcaggagaattgcttgaacctgggaggcggaggttgtggtgagctgagatcgcgccattgcactccagcctgggcaacaagagtgaaactccatttcaaaaaaaaaaaaaaaaaaaaaaaaaagaaggaaaagaaaagaaaaaagaactatacagagccagaagctagagcatagaactttcttccagtctttggacatgtggaattgaaggaaaatttagttttcactgatgcctattcgaaaaagaaagttttctcctatcagaaatgtatttgataatataatgaatacagttataaatataccagacattttccccctttttggtgggaattacacaaaatatattttatcaaaattcctgtattgtaggacccaaacctatggcagtaaaacaaaaaaaagtggatgtctgtgtctgaagccatgttttatgcaatgtaactatcaataataaaaaataaatattgtcagtcatgctagaagaaaagctaaattttctttgcaacctccctttagaaaaattacaaaatcactatcatatgaagaggtgatcaaagtgtattcagccaaaatatattcagggaaaaaagtattatggaggtttcacaggcaaataataaaaatattttgttatttttctggattttataaagtttgtgatacatgtcaggttttaaaaacgtatattgaatgtgatttattttcttattctaaataaatattcaccatggtacctaattttgtatttgtaattttatattctttttcttaaagaggtcccccagttgcttaaacttcaagccctacaaaatctcaacccatccctggaggtgaaataactttcccagccaggaagtggcagacccaggactagagaacttggtccctgactttgggatcccctgaacttcacacatttgtgcccagtcatccatagggcagcctgggctacaagggtcagggtgctagtggagaaggtcaaaggatgatgaatttgtaaactggataccatcactgcagccagcacatgtggcttctacctcacctgagcagacagcaagaggttttctgaagacctgagtatgcaactgacaaatcccgactctgttaaaaccaagtgcccagattaaagataaatagccccaaatccccaaacaatataattgaatctggtttgattcttctgggtgtcacattccctaaacttgcactgtccaaaatggtggtcctggccacatgcggctatttaaattaataaaaatgaaatgaaataaaaaatccagtccttcagttgcagtaaccacgttttaaatacttaatagccacatgtggccagtggtttctgagtcagacagtggagatatagaatgctcccatcacacccccaccccaggctctactgttaagcccagctgaacttttttttttttttttttttgagactgagtctctgtcgcccaggctggagtgcagtggcgtgatctcagctcactgcaagctccgcctcctgggttcacgccattctcctgcctcagcctctcaagtagctgggactacaggcacccaccaccacgcccggctaatttttttttttttttttttttttgtatttttagtagagatggggtttcaacatgttagccaggatggtctcaatctcctgacttcgtaatctgcccaccttggcctcccaaagtgctcggattacaggcatgagccaccacgcccggcctagcccagctgattttaaacagtctttactaagacatatctaagcccttcttctcaagaagagtgtttgcaggtgagtgtggccgatatgtgaggagagaggagaaggaggagaaaggaaggcctatccagagagaagagagggacagcccagctgagaaggggccaaagagggggaaaaaggaaatagaacctaaagtgactgaggtgttaggccttgtagagaataagggcatcatcagatgtgagccaaggaaatgattcagatcacacctgacagaataaggaggataaattagctccagaatcagttatcacatacctcatgtaccccccaacatacacaccatatacctcacaccccccacacacataccacacacacacatgccccccacaccacatacctcacacatgcgcacccccacatacctcatacacataccaaacacacacacaccacatacctcacacatataccacacacacatgcccccataccacatacctcacacacacaccacatacctcacacacataccccacacacgtacaccatatacctcacacaccacatgccacatacacacacaaagaccacacatgccacacacacacacaaagaccacacatgccacacacacaccacataccacatacacacaccacatacctcacacgctacacacacacacacacaccacacaacacatacaccacacacaccacacatacgccacatacctcacacaccaaacacacacaagcaccacacacacaccccccacatacctcacacatcacacacacctccatatacctcacaaacacacatatctcacacacacacacaccacatacaccacacaccccacacctcacacagtcccaccccacatcccctgctacacacaaactcacacactttaaagtgtgctttgcattccaagtctttgctgggaaaccttagttgcagctttacgtggctggaatatcaaaaggcaggagttgtggagtcactgacaataacatcatccaccttctcaatgtccccgacactgccacctcattacccaaaagccactgccattccagacctacgcagagtctgaagggcagcacccccttctccttgggactggagggacaccttgcctcaactctcctgcagggcctgaggttaaactctcctgtattccaccatcaaaggacagcatgggggactctagcccttttaatgggctgccaagagcaaaaattcacgcattctagagtatgaaagcccggcagggtgggccttcatttcccatatgttagtgtgtatcgatggagagggtagggagccctgtggggaatgagggcacccattgtcccctgcagagcagttgtggatggagctcctgtaggaataacggactctgattaccacggtgacactcccaaggtgatggctctggatagggtttgcagtctcctttatactcatcactcccatctaatcctcacaagaaccctgctccccacttaatgaacaaagaagcaggcctagaaaggcaagtggcttgcccggaattaacaataatagtttaaccataataacattgccccatctgctcaccatccaatgaacaactcaagtgacagcacagtggttaagagaacagattctgaaacagatgtacctggttcaaatcctggctcggccaatgactagctttgtgccactgggcatgtgattcaattaccctgtgcctcagtttccttgtctgtaaaatggggatgatgatagtccctacctcatgggttgctgtgtggtttaaataaattttcacatgtaaattacttagaaccaagcctggaatgctcagtcagcactccttaagtgctggctgctttggtgcaggctctgagcacagagacaaccaaacatagcacctgcctccaaggtacttacagcctaaagggagaaacagaaaagtgaacaagagctagggtagaaaagatgctcggggcacaaatgagggacctggaatccaggaagggcctgattcctgggccaagtgacaactgggttgagttctgaagagccacagtacaggcactgtgacagcccttatttatgttttccagcttttattgtagattcatgtgcaggtttgttacctgggattattgtgtgatgctgaggtttgggagatgaatgatccatggccctttttatatagtttgtcatttaatccttggaccattttacaaatgaggagcctgaggctcagagaagttaagcagcttcccccggaaaaccaacttggtaagtggtggagctgggattcaagcccacatttgtctgattccagaatcttactccaagtctgggcaaggcgtgggctggccaggcagctgcctgaagggcaattgtctataaccctggggtcagggggatgagaaatgtgaggcctgttaacccaggtctctgggcaagcttccttatataacctgcacattgtcaacgctccactcaggcagctctcccattccttactacataattattagataatgcataagggagaggtttgaatgactagcctgcctgggaggctgcctctctacggtcctgcttccaccacacgggagccctgaaacgagcaggccagctggagaggtggccaacacattcctcacccagaggctccgggctccccagatggccactgccacctgaccacacagagtcactttgccagaaggactgccctgctttaggcctgatctgatctttttccaggaaactcgtctggtgtaagatttatgtgtccaaacttgccagccttcccctttcaccctggactaacagggacaagaattctaatcaatgtgcaggaacacagaaaaaaaacagggaaacagcaggcaggcccaaccccaaaagccccaaacttatttcccaattttgggttgcacatgtatttctactcacataagacagtttgcatccaactggggggaattttgagtttcaattaaactttgctaaaatacaaaactcatttccccttaactgtgcttcctgacaatgaagtggtggtgtcacggggcagaagggctgatggtgtgggttaccacagcaaggtccatgctgcaaagacgggctgcccctcctgctctgggagtcaacgcttcctgggtccaccaggcccagcatttccacaggctgtcatcggtgtgtccccagcacagcacctagctagatctcagcaaatgatttgaatgtgtggggctccctccaggtaagaaaggaacccctgctcacggcactccccagaagtccttggtaactcactttctctttctgttctgaacatccattcgggctggtttaaagcacagctcgctcaagaggcagccctccagaggagatcggggttaattacgtttactgacagctgtcttctttctcctacagtcacttcttcccatgtcctgatttcattgcttgtgaaaagagatggccttccaatgggaaaaggcaaggagtaaaactcacgagagaaagcgtcctggagattttaaggagaaaggcacatcggttctgccagcacaagagctgcctgtttccctatcagatatcaacactcatttagtgcaagggtgaatatcacctttctattgaaaagaaatagagtaccctaggaaaatagcttgcatcaaaacaagagaaaagtaggttctgaaccagaactaaaatatttggacaccgaagctgtgactactgatgcaaagccattaacccataaaaacaaacattcaaacaagacactgcatagctctctttaaatgagtccaaacaccagagctttatcttaaaacaaataaacaacaacaacaaaaaattcctttccccatcccatctccacccacccactaggagtaaaacatattgctagctctgagacttttctaagaacttggtcagagacactgagcggctggtcaatatatttcttacaaatggggctttgagagcggaactagcagctgggtgccaagaacacagtggctctgctcacatctcacatatgcccagacgctctgaaccacagcctaccactgctgccacaggttcaagttctgaaacccaaagagagcacagagaaggcaggaagagaagaaaaaaagacccagatgttgcaaatcagaataagtgctgagtgaggcagtatcatgacatggcaacgataaatgttgaacgttggctctcctcttgtcagctgacccctctgctctgggacccttcacactgtgactccagttaaatcaaccagctgtgcctccaagaaaggcagcatgggtcagtgtggctgcctggactctgctgctgacagctgcagagagaaactcaaaccagccacatagcctggcccaccttatagtctgaacgtgcccagccaaaaagaagaaaagaaaacagctcaaaaaacagcaaaggctgggtacggtggctcatgcctgtaatcccagaactttgggaggttgaggcgagcagattgcttgagctcaggagttcaagaccagccagggcaacatggtgaaaccctatctctaaaaaaaaaaatgcaaaaattagctaggggtggtggcacacatctgtagtcccagctactcgggaggctgaggcaggaggacagctagtgcccgcaaggttgaggctgtagcgagccatgttcgtgcaactgcactctagcgtgggtgacaaagcaagatctcgtctcaaaaaaaaaaaaaaaaaaaacagaaaagcaaaaaacccacagctgagaagcctctggctcaaacccacatacagaagcttgtcggctgctgtgtgtacacataccagccaccatgatcctggccttctctgaccattggtctgtaaggaaataaggtgataagtgggaactgggctctgaaccctggaactgagaagtcaggctgctgcaaaactctccaggatattaatccctctctctgcccagtggttttcaactgggggcagtttagcccccctagggaacactcatcaatgtctgaagacatttttggttgtcacatctgggggtcagggggttgctatcgctacctagtgggccctggtagaggccaggtttgctactatacctcctacaatgcccaggacagctctcacaacaaggaatcatctggcccaaaatgtcaatggtgccaaggctgagaaaccctgctctagagcctaagagtgctgggctcaaattctaacatcactgctgactagcccaggggcctttgtataacttacttcacctgtcagagcctcaggtttatatatatgtgtgtgtgtatgtgtttgtgtgtgtgtatatagatatacatatatatttatattcatatatacatatttttatatattatatatttatatattaaatatgcatatttatatataatacattatataacatataatatatattatatatgaatatgaaaaaattatatattatatattatatatgaatatgcatatataatatttattttttatatatatatatataaattgtctttctgagacgaagtctcactctgttgcacaggccagagtgcagtggcatgatctcagctcactgcaacctccacctactgggttcaagtgattctcctgcctcaacctcctgagtagctaggattacagacactcgccaccacaccaagtgcagggattacaggcatgagccaccatgcccagcctattttatatatttaacaaaacttatgtagcagtttctaagtaccaggcactattcaaagcagttcatacatattaactcatttaatcttcctaatcaccctatgctgtagtgttaacctgacctccccactttacagatgagaaaactgaggtgaagggaaattaagtaaattgtccaagatgacccagctagtaagaggaggacacaggattcacattcagcaatctggagccacaacctacactcttccattagctcactcacagggctgccttacagatcaaagtttacatttattatctaccttagtctctcctatcaaggtgtgcagcaaatgtggcttctcaaccttcattccatgttaaccttatactgtttacattacccttgaacactgagaccaaggatctcaccacttgctttttctattttccttccatcacccagaatggcaaacattcaaacatttccactcccgaaacatgcagcaacgccagaatgtttatccagaaattcaaaatgagctctagtgaggctggcatgaatatactctaacacaatgttttcaaatatcgtggctcaacaacaatgaccagtgctaaggttgctgcgaatgacatcttaggcctgaaattgctctctgctgtaacccagcactgaaggtgactctggcctttgcatgctggctttgaaaggtcccaagtctgtctacttggaaataaattaaaatgttgtctatatttaacagataaccaggccttactaagcaatctaaaacacatactctagaagcacgctgcaagagctcccttcctggccactttgcagaagagaaactaaccttgcgcagcaagtcaggaccctcccccacaaccaccccccagaaaacacaacagtctcacaagttttagtatggtcgcgtctgtaagcaaaagtaaggaagtcataagataagccccacgctggaaaacttgatccttttatgaaaggatggacaggctcactgattcaggtgagaaagaagcccaagtcctgagaggtgcagctgctgaagaccagggtggccccaagcaggctatgtgcaggctcccctgtcctctacctctcagtgaaggatgtccaggagatcccactcctttccccatgaacccagttcccttccatctgcccactttggtctccctgcacataaactcatctccccctacacactccacgtggtctggccccagccttcattccacccattttagtagactgcttccacaatgggctgttcagatccagggggtccaatgttcatatcagggcttcaaatgacctaacattaccagaggcaaaggtgcttaggttaaccaaaaagcaggaccagactgttggcaacccagtgtgctaatgcaggccacccaggccaatcagaagtactgaccagagaaaggcacatttcagactaaataaatatttatcttttttgaaattacttaaagattgcaatttgtttagaggtgtaactggaccccccgcaggcccaagggaaggctgttctagctaacggtaaggagaggagtagaaggcaaggtggaggagggccttctgaggcaggaagtgaggcatcaggacagggtgtggctgggaacatcccccaggaacacatcaagtgactgataaacatttatttgctttatattaggagaatgagaacacggcctatagaaaactgggagtgctaagggcaaagaaacggcttaaagacagagagactatgtttgagcaaagtgagaaaggccattcattggtaccctcagttattaaaataatatataattcaccgctaatcacggcactgcccggatgaatattaattgaatattatatacaacatattacacactgagtgactcatagttacttctaatgaatatcaatatattttgacacatttaacaacgtggagtggtggagggggtacttctagagccaggcttcctaggtgcgattcccagctctgccacttactagctctgtgacatgtggcgaatccctggacctttctatgcagcagttttccactctgtaaaatgggaataaaaacaatgtctaccacaaagtaaaactctcaatacatagtagcttttgttttttaaaaagcttcaggattcaagttgatgagtgaaatgtatgggcatcaaccagattatgagcattcctcttcttcagaagttagtgctgaattatctggtccttccttaaccactgtgaacttgcgtggtgtccaaagacagaacctttcctgtcaacacatgtggaggcaactgcattaggtgcccggcccactgcttttctgactgccacttggccagagctgaaattctactcaagtctgtgagtgaggcccagctcctttccaagttccttgtaatcccactcaaaaaggcatgctttttacttttcttttctttttttttttttttgagacggagtgtcactctgtggcccaggctagagtgcaatggtgcgatctcgggtcaccgcaacctctgcctcccgggttcaagcgattctcctgcctcagcctcctgagtagctgagaccacaagtgcgtgccaccacacccggctaattttttgtatttttagtagagatagggtttcaccatggtagccaggatagtctcaatctcctgacctcgtgatctgccttccttggtctcccaaagtgctaggattacagttgtgagccactgcgcctggccaaggcatgctttttaatgaactccagttctcctgtctcaaagaggtctatcacatggtctttggaaagaagtggtccctgctgtgacagaggatcctgacagcagtcatggagcgctcgttaaagaaaaaaatgattcaatggcgcttgctaacgaactatagggcaagctttatttagggaaaccaccaagattggtgtagggaccaccacagtggtgttttgcagtcagggagagagattgggatcaactccaaatacaaggaaaagtgggaatgcatagccaacgagaatggtgaaggtcagtggatggaaaattactgcagaaacatcagaggtaaggggggattctggctaaattggcctaacaggattcttgctgaaggcaggcaggttgaacagacatcacctggggcacggtagaggatgatgctatggtctgaatgttggtgtccccctaaaattcttatgttggaacctaataccagtgtgatagaatgaagaggtggagcctataggaagtgatgaggtcatgagggctgggattagtgtcctcataaaaaaggttgaagaaagcgtccctacccctccaccatctgaggacacgtagaaggcatcttttctgaagaacaggccctcgtcaacactgaatctgctggtgccttgaccttggactgcccagccgccagaatagtgagcagtacataaattacccattctaaggtattttgctatagcagcaggaacagcgtaagacagatgaggaacccaatcagatatcaagggtgatcagatattgaggatggaggattctgtctaaactggattcgtgctacagttggacagagacaaacacagaagctcaaaagttgacccctagttgaaaaaaatctcagaagagcctaacgtgtggtcatggagagaatctttgtcaggccccagatcaaggacagcatgtggtgggtgagatccacactcttagggagaggagatgctttgaatgacctaattctttattgctgggagaaggaggacccagggtagaaggaaagacctgagagagagggagagagagagagagagagagagagagagagagagagagagaggtgctgggagaaggaggacccagggtggagggaaagggcagaccagagcctcagagcctgccatccccactggcatcattttgctctcacagggcccctgcactctgcacaataaaggagttgtttaacctcccagcatcctgggggcaggaaatattggtttcatctatttgttgtttgtttcagtcttggtgcatcttggaaccaaagttctcactgtatggacacaaaactaatttaggttcttttaatccaacataagaaaaacttagtttcctctagccaccatcaatcaacacaaagccaacagggcggaagggagggcccttgcttcctggcagtctccctggagggggagggggcaggaagtgatctagaatccagtctcagaagaactgctgacaacaccctcaccaaaacgcatcatcatcttgcactcatctctaagtagtgcctcccacagcctaagagcaaaggctcataacttctatccacagggtttctgccatttaccattacctccctgtcctggctcaggcaaggaccctcagggctgagatgcatcttcaggtcagcctgcccacatgtaaacagatgatacatgcacacgtgcgtgcacacacacccacctctgcatgctggagatacacaggacgtggaataagtcctctctgagaatttacgaaggcacctggctgccatcagcacagagtcatcctctgtctgagttctgaaggtagcagtgtctctgcaggtaggaagagagacaaatggagcttccttccagctgaagcaagtagaggctttgttttctctctagagggttgtaagaatttattgttttggagaaataacataaaatctaagagcgctggttcccaggctagaagacagaccagatctattcattcagcaagcattaaaaattcactgcttaattaatacaccaattgctccctccttgcaaagaggaagaacagttcagccccatgggctggcatctttgccactgaggtctgcacaagatgcggatggtgaacacatgctacggccattttggatgtttccttgtagcatcaatgaggaaagaaaacaaaactgttaaaaataaaacctctgccactatatcctgaattatatcagcaagctcctttttaacaagatgttatgtccaggaaatgtatccatttactgattgttcctgaagaaataacttgttcactaggaaataacttaaaccagaaatgtgggctctcatctgatgtggtttatgcatctctaggtgttttcagtgtctcttgtctatttaatggactcccagaagagtaggatgtctacctaaaaagaaaaattaacgtttatactctcctgatgatgtttatgtggaagaaaacaaacatttgtcaaatgtctgttttttattttatttatttatttatttagagatggagtttcgttcttgttgcccaggctggagtgcaatggtgcaatctcggctcactgcagcctctgctgcccgggtttaagcaattctcctgcctcagcctcccgagtagctgggattacaagtgcccgccactaggtccagctaattttttgtgtttttagtagagacggggtttcaccacgttggccgggctggtcttgaactcctgatgtcagctgattgtcactcatccattatacatcatttaatctgccatgagcttaataagcattatagagtctaatcacctaatgagcacgctcatgaaagtgtcaccttcattgaatcatttaactctcctagtagctctatgaagtactattattaccccccagcttataagataggaaactgaggctctgagaataatctgcccaagatcctgtaagtagtaggtctagaattcaagcccagcctgatctttctccaaatctacattattgtccctgaaccaaaacattctcaggccatgatcttctcccctgtcagcagaatctggagcatctcagggttcatgttgaattacaaagccctgccctaaagcagatttattggaagtccagtgcttgtgagagttattctgaagggaaaaaaaaataaaatacatatatatatctcagaaagccttctctgcccaggccaatgcagccagctccctgcttaagaatagctgcccatgggcagggtttcctggccagcaattcaagatgtgcctgtgccggctttactctttaatctcagtttcctcacctttaaagtgggtcccacaagccctgtcctacagggctgctataaggatttaatgtgatgagaatcctaacatagctaacaaagtgcctggtactgggtggtcagtaaatgacagttattgctgctattacttggtagactcccaaaagttattctcacatccagtggagggaagaggagggagcaatcctcccttgggggtagagtattttgcatcaacaggttttagaatttttggtgcaaggtgagagtcaaaatctaacagacttcgtttattatattattgcttttacgttctcttcagacaacgtacccccttattgcctctccctgggctgggcctctctatcccttccctctccccactccctgtgctcccacctagatctcttccaaatttcccagtagagagggaatagagaggcagtggtggtatctttcaccccacatcccagtggtgatcacagcacttcagggaaaaagaaagcagccttcacacatatgggcctccctaaaaagcttcccaggaaaaaggaaatgtgtgtggaaaggccataactgggaatgaatcatctgttaggaaggctgaaggagagggagaaaggggagtggccggaggtgaggctggagaagtaggcagggcccatcgcctggggtggtgcataccttgggaagaattttcaattatctttagttcagcaagaaattacagacatgattagggcccatgcaaacattctggaagggtcaaggcaggatgtgggggaccggtgaggaatctcctgcagcagtcaagcaatggtggcctggagagggagtggacgtcaggatggataagtggatggattcatgcactcgtccttaggaggaggaatgcacaggacttggtgacagcttaagtgtaacaggtggtggagaggagagggtgaagtccggcttctggcccaagcagcttgggggacagtggtgccccttcctaagacagggtgcatctgaagaggagagactcacaggctgaggaaggggctggggtgtgggttggtcatgcatgtgggaaggtgctgagccgagttatgcgtgtgttgagtcatctaagtggagatgctaagaagggggctgcatttacaatcagttcttccaaagaggggtccagatgagatgcatggaaactaacaccaggggacgtgacaccttcacctaggggaagactacattgtaagaagagaaatcctcagacagagtctagggagctgcgatcctcaatagccaagcagaggggtggtggaggcagcagagaaggctatgcaggagaagcctgaaaagcagagagaaaaccaggagaggctggtgcctcagaagcccagggaagaaaacaagatgcagagttttaaacttcacaaaatgccactcagagggcaagaaagacaaagttaggacaatgtcactggcatttattaagacgcaggtcagaggtgctcttttcaggagcaggtgtggctgggcatgcaagggctgaagcggaggagggaggtgacaccatgcacacagcccaggaggctgcctcactcacaccccacttgcttagccccactcacttagcctatttccttcacagccattatcttaatgtgtgctgtcttgcttctttgtttacttgtgaattgccttcttcccttaaggtctgttagggcgagctccttgtctgctctattcacagctgtaccccagcacctaggaggatgcttgacacagaacagggattcaatacctgttgggtattgaatgaatgaaacagaagcagagtaaagtctggctaagaagtgaggagggggagagctgcaaagcccagaaactacccacaagaatgagccagtggtgaggaggaggggtgggttactgtccctgggaagtgggacccccagtttaagtggaggcttagggcagaatcctggacactaaaaggaatgcttaaaagggaatttgaggcattttctggtctgaaagacatccggcccacattgctttcacttaggtcatgttcccccaaaggaaatcctgagataaggattcctagatgagtgattcattgaagaaatgtccccagagtggtcggtaggagagtggagaagcaggacagaaaggggagaggccaagccaagcatgacctcaggccacatcccagcctcagcctgaccccagggagggtcctggaatgtaaaccgaacctcctgcaagtttgtacacccccaccccccactgccagggcaaggtggctgacctttcatattcccaccctaattaatattggctacagactgtcatggccaggacagaaactcccagccactccaactctcttggcaagagggtaatcctttgaagaaggcgatggggcaaagctttagaaacagaggctacagaagctgcaggatgggcacacagaagtggccgaagtgatccaacgccatctgagcagagcgccggcaatgtctgctactaaattgggatagagttttttatggattaccctggaagagcacaccaaacaaaccacttcattctgagggcctggacggtgcagggatagctaccatttagaatcgtttcagtttctattccggtaaagaatccttcaaagaaagacatcgaggctcttacagtgcagagaggtgctcttcttggacaactatagggtgtgaacgtagcacagctactaaaagtgaatgtgacacaacaattaagagagtatggtgagtatttagaaatacttagaagtcaaagcataaaaaactggataacttgggttacattcctgagacatgtttattattatcacagtactgtgatattgtagaatctggagaaataaaatcaattgaaataaaataaaatacatctaccaactaccatttactgaacacctgctatggatccaactctgtgctagaaatgaagcagcatctcccttgctcaaagctgattttcaggctgggaactagatggggctcctgaagcaattcaagaacaaggcaaaaacagatctatggaggtcacataggatgatgattaagagttgagccaggctcagcaactgcctaggatcactcccatttctgctgccagactctctgtgcctcagtttccccatctgaaaaattgagatactaagagtctttacttcacaagattcctgtgaaggtaacaggaggtgatgtgtgcaaggtccttagtatggtgctgatgaatgcagtgagcactgaggccttgttattctgcaattattactggaggtgaggctagaaaagaccacacttgcccgacttgtcctacctttctctcctcaggagggaccaagacatttatgcctggttatgaggtgacattagaaaagaaatcaaaaagcatctgtccttgtttcttgaagccagatgcaaccaagctaagcctgaaccaagagttgatgggcagctgggtggtgtgctcctctgttgagctggccaggagctaaggctgatggctttctgtccagggagccgtttagactcagagtacacacatgcttgcctcttaaaagagtattgggtcagcaaggatgcactgggaaagccatcagcatctttgcatccctactgaccatttcctgcccagcacactggagccagtgctgaccattttcctttttttttctttttttttttttttgagacagtctctttctgtcacccaggctagagtgcagtgatacaatcttggctcactgcagccacctcctgggttcaagtgactctcatgcctcagcctcctgagtagctgggattacaggcatgtgccaccatgcccagctaatttttacatttttagtagagatggggtattgctacgttgcccaggctaatctcgaactcatggcctcaagtgatctgcctacctcggcctcccaaagtcttgggattacaggcctgagccaccgtgcctggtcctgaccattttctgattggcagcagcaggagggccccagggtcaaacaatgcagtcacacaggcctgtgctttaactgtgcctccccacacagcttggtgaccccgggccagtgactttgacctctgaagcctcaattcccttgactgtaaaagaggtcctgaccttggctgcacattaaaatcactgggggagtgtttaaaagtccaaatacccagggcttgcccagaccaacaaaatcagaaccccctgatgagacctactgctgtaaggtaaaatggtcatcttctactcccagaagtggaattaagggagactatccatggaaggtgcttaccgccatgctttacacagagtgcgccgtaaaaggaggccgtgatatggtaccatttggagttcccagactctagaaacacctcccacaggcccacagaggattgtacttgaaacttcattcattgtactttatgccccactttggtgagtatcaaagatcaattgtgcattttgatttctctagttcttttgatcaccctggtccacaatcatgttattcttcaagagagaaaatggccagacccaggaagtgcttctctggattaagggctgtgaggttaaatctttgtttccatctctgccctcaaggacctccaatcccccatcctaataagagagctgccatccacaagggtccttggcccttggcttgcagaagcgggatgagcatctacaaccctggctgtgatgaaggctgccctgacagttacattcttgatagagttgcaggacaaatatttctgaacctgtggttcctttgccgtgtctctagtcaacatagggcttttagccctgtggaacatgaagatttttgtgaactagggtataaggatttaagagtgtaggtggggcctctctaggccctgcttcctacatagttgatgtgtctggacccacaactgagagaaggaacaaagcaaacaggtgggatcccttatagtttatagttatgtttttcagagtaacagacattcagggaaacagaaacagaactttagctcaagcagcaggagggggcagccagcatctgagctggaagaagagctagcaggtgacaaaggaaacaagcactctccatgcagtgttaaggcagtgcttatcatccagtgggaactggggtgccagggtgccaggcaacagagcagttgatggagacagttccagtgccattatgagctgttaaaaggggatctgacgtgtgcattccagaccctgatactacttcttgtccagtcattcaacaacatagtattccctataggcccagcatgtctgtctatgtatctgatttcacaatcccatgacataggtactgttatcctcactttgcagctgaggagactgaggcacatagaggttaagtaacttgtccaagatcacacagttagtatatgacagagttgggatttgaaccctgtgctcttaatttctatgccaaattgtctctagcttagtgagggtgtcaaacaggtcaacagacaattagaatatagtacagtctaagtgactgctagggactagcacaggtggtggcatccaaaatcccattcttatctgatgctcactcataggaagaaaaacagaagtacccacctggtgacaggctagcaggcacaaggatagacagaatgtgcacctgaaggagttcacctaggagagctgaggaggcacaaagacctgcatgtgagtgttcgtggcagcttcatttacaatagcccaaatctggaaacaatccaaatttctatcaacaggtggatggataaaaaatctgtggtggccaggcgcggtggctcacgcctgtaatcccagcactttaggaggccaaggcaggtggatcatgaggtcaggagtttgagaccagcctgaccaacatggtgaaaccccgtctctactaaaaataggaaaaatcagccaagcgtggtggcatgcacctgtagtccctgtaactcaggaggctgagacaggagaatcacttgaacctgggaggtggaggttgcagtgagctgagatcgcaccactgcactccagcctgggcaacacagcaagactctgtctgaaaaaaaaaaaatcctgtggcatatccagacaatggaataccattcagccacacaaataatgaattgctgatctacacaacatggatgaatctcaaaagcaccatgctaagagaaagaagccagaagcaaaaagggtgcatattttatgattttagctatatgaaattctaggaaaggcaaaactctggttttagaaaacagagttttgcaaggggatgggggtaggagggacgaactaagtgtgacaggcatgaagaaactttacgggatgacgggaatgttctatattttgatggtggtgatggctacactggtgcagatacttgtcaaactcattaaattgtacacttcaaaaggtgaattttattacatgtaaattatactcaatttagaaaatattttaacaagagacttgatgtcatgcagtcaaaagtgaactgtgctatgctctgaagctaacggtgagagttacatacgttctgcttcctttgttttttgttccttgttctttctttccccctttccttttttttttttttctctctctctctctccctcctttctgtctctcctcaaagtctaccacctccttttccaagccaagcctaggtgacaggcccctgagctgcaagtgtttccagcactgccattacaaattagtggaaatgatcagacccccaggcagactggttctcagcctgcttcagaggggcagatgttctgcaaaaccagccagtgacccacagagaagactggcaagcccgcaaggctctcattggacccctctgtggcttctgcctcccaggtagaaagcatgcatatattagatttaaaaagaggaagtgcctttccaaaaactactcggctttgggagggatagaggtcatttgtctttgtccaagaaaaacatgttccttccttgtaatccttgataacccctgaattgttttctccaagatagttagggacaggggtaggggagaggggctacagtaaaagagaaaaggaggtagagaggacagaggaagccaatgccctactactctgcggtagcagcaaggtgagctcttaccaccttgaactctgggaaagatggtaaaagagggaacccttcaccaaccagtgcccacatgactacctaagacagcacccatatgaggtgcaaccatatgaaggttcacttctcgctggatgagaagtgaacagagaggttaacagggcaaagaagcagcagtaatgggaaaagaacgtgagactggcacggttccctcccctgggcctgcgggaggcccatggcagccagaatgtccatctgctgtgccccaccactagtaggctcacaggaagggaagagaacaatgacaacccaactgtcccttgcgcagaagttacaccaagaagtgagcagcaggacccgctggcctggcagtaaaccacatcagagttatcagtcggaaacctcttggacaaagagagtttataaagtcccttggccaagaggcatggaagttgagttcagccaagcgcaactcagacacatgggcaatggaaggggagctggggatgccagctgccatccaagtcctgtttgttggaaattgagagagatagtattggagaactagatgctttcactttatttctccaaaagagagctggtctccaggtggtgaagcctataattctataaaaactggagattggagagataggagggtacaactctggcccaagacagaaataagcaaaaacaaaacaaaacaaaacaaaaaaataggcatccataagagaaaaaagtgagtggttctgggcatctagtaagtggaagaggaaagagaccatctctaatcctaactcactctgttccaggtttggaataaaagctgtatcgggagaaataacctgttaaagtagaattgtcaatgtgtagaactgaaaatcggccaaaaatccatcagctttctcaatttactaagaaagaataattaactccctagtacctgatatacttttgcatttaaaggctaaactacctatatctactcaatatcattcacttctagtaagactcttattggcaggtttaaagcacccctacccaacccactagcaccaacttgtcttttatcttagcctggaaagaacatgtatgggttacattactaagaacatagtatcattgaatgaatcattaaatagaccagtcactgtaataaatacatgtggatatatacattctgttaatagacttggcatagtctttcatggtttcaagtgttaaggtttattgtggtattaaagaaaaccttatagactttcattttctgaacgatagtggattcaatatatagccaactctactgaaaacactaagcaaactggatactatagaaaaactcttttgaaatgactgatgagctggcaagttagtaagacgtattcagtgagcaaaaactaagcaaaatctgaagcctagtataagagccaatccctgaagctagcttgaagacaatagccaacaaagtgaccttcacttttatcttttgtggcctcacgggaagaggagacaggataagaatttcccataacataaaggatactatcacatggatccaggaactccaatgaataccaagtatgagaaataaaaataaatatatacctagatacgctttgtgaaactatagaacaccaaacaatttaaaggaaccagaaggaaaacacagattattctcaaaggagacactcttgtctgtagacaagacagtagattttagaggcaacaatggaaacagaggacagttgaataatatcttcattgtgttggagagaaaataactggcaacctagaattctaccctaattctacccagtaaaaacctctctcaaaaacaaggggaaaaatagtgtatttgcaagcaaacaaaatcaagaagttgtcaccaacagaccctcaataaagaaaattctaaaagctgtacttcaggctctattggaaaataccaaaatgaagttggtagacctacattaatattaatcagaatagacttaaagactaaaagaattactaaggaaacaagttttgcttaattataaaagattcaattcaccagaaagataaaacaattcaaacctataggtacctaataacaaaggctcaaaatatataaaacacaaactgacagaccataagaagaaacagaaaaatctacgatcatagtgggagattataatacttctctcagtaactgattgaacaagcatacaaacatcagtaatgatataaaagacttggacaacacagtgaagaagcttgatctgatagagttacatagaacactgcatctaacaatggtaggatccacagaacattatgaaaagtgaccacataccaagccttacagtaagcttcaataaatttaaaaggctgggtagcactcaaacaatatttgacaaccatgaggcaattaagttagaaattagtaacaaaaagataataagaaaaataaacaaacattcagaggattaaaaagaaacacagctttaagtcataagtcaaagaataaatcatagtgaaaattataaagtactcagaaccaaattatatacaaatattacatatcaaaatttatgaagttagagtaaatattgtatagcttacaatgctcataatggggaaaaaagcctgaaaattaaaaagccaaacacttaccttaaaaagctaagaaagaaaaatagctcaaatgtaaataagttagatggaagaaaataataaaaattagtatagacattcataaactagaaaacaaaagatggagaggatcacaaagtcaaggattagagatagtctctaataacattgagaaaattcttaaaagaccatttaacaaaattatagaaggtattacaaatgaaaagtggacataaccacagatcccacagaacattaaaaaataacagcatcttataagtagcttcaaggtaaaaattttgaaaactcagataatatggataaatttctagaaaaatctaatttaccaatattgatttaagaaaaaaattaaaacctgaatacccatgatctattgaagaaattgaatcagaggttaaaaatcttcaggaaagaaagaactccagcctcacagaatctttttttgagaacagataaagaggaaatattctataacttactttacaaattcagcaaaaccatgatacaaaaccctgccaaggataagataagaagtgcaaattacagtacaacacactcatgaagatagatataaaacttctaaattttattagcaaaaaaacctagcaatgtataagaaatgaacccattacaaccaagtcaggtttattctaggaaagcaaggttaagttaacattggaaaattagtttaccagatattaacaaattaaagaaaaaaattatataaatctcaataaatgcagaggaagtatttaataaacatccatgtatataatttgaaagaaaaaaagctctttgcaaactacagaacaggagtagttccttatcctaataaggaatatcaaatccataaaaactctcattctcaagggaaaacgttgaacatgaaaggcaaagcttaaacgtttagaagaccatacaagaactgtccttaaggatgtcctttaaaagacacaaaatgttcaatgataaaggaaagattgataaattttattacattgaaattaagaatttctgccactgtaaagatactaaaaaagatggtgagaaaaaataacacaaataaggagaaggtattttggcaacacagagaaatagtctcctgcatatataaagaactcctacaaataaataagagagatgtaaactacccaattttcaaataaatgggcaaaaggcttaaagaggtacttcacaaaaaaagaaaatccaaaaggtcaacagcgtatgaaaagatactgaccctctttagtaatcaaatgtatataaattgaaagcagattagatactgttacacatccacaagatgggcaaaagtttttgacaatatcctacaaaatataaagtttttgcaagattagagagcagtaggagaaattgcagctggatatagaaattggttaaacacattggaaattaatttttgattaaagtgaaactcatatgacaccatagaattctgaactatcctagcagcactgaaaatgcccatagtctgtggccagtaattttattactatgtgtattccctaagtaaacttacacacatacttagcagggaacttgaaaaaaaatgtttacagcagcactatttataatagcaaaatactggaaataagctaagtgttcattaataatagaatagacatataaactgccatatattcattcaatggaatattatggttcagcaaaatgaaaaaatttcagctacacccaacaatgtgaatgaatccaggacgaaacatttaacaaccagttggtacagagtccaatcaaatgaagtcccagccctagtgccagagctggtacccaagaccccctgccatgccaggtgtaatccctttagaaaggagtggacttggagaagtaccataggagcacctgggaaagacccaggtaagcagcaatttaccaactgatatggaaatattcccattgtttgtcaaccagtgagccttactggtgtggtgtgcatggactaaacgtgagcattaagaacaaaagaataaaacagtgtgattccatttatatgaagttcacaaacacgcataactagacaatatattgtttagggatacaaatgcaagaggataagacaataaagaaaagcataggggaataaaaggtacagaaatgtccagaagatggtaatccctgagaagagaaggaatgggatagggtggagggaggtacacaggggatgtcaaaggttcaagtaacattctttttctcaaattgactggtgagtacataagtgttagtcataatgttattctttagacctttctacacagtttgtaagcattcgtttgcatctaggggctatttcattaaagttatttcaaaagatggtcacaacacaaatttaataagaaactctcatatcaaattgctgcagttcctgccatatcttttctagttgctgggcaaagatgctctcctcaattgtaattggtgtgctcttaaacccacttaaaattctaagagcttctccccagaccactccaaaacattcttgtgagaatctttccagtgaggtacagcaaggcccaacctccagggcacattatgctctggctcatttatttgatacaatcataatcatagtgggtttttttctcaaactttgaaatcttcaaaatgagggcatggagcaaatgactacattctgcttctcttgctaagatttcaatggtgatgctctcattttaagttctttaccagacgcttcagctgtgctatgcccaattcccctcatcaagatttgctgacagtcaggggaagtttctaacactgtattaagtgtatactgagggccagggaattggggggagtttgaggggctgcacacatgtgcaattttttagcaaacccagcagatgcttgtagattcaacactttttcagttatttgtgaacaacccctaatagccacaccacatggcaatttgtcttttctctggagcacaaatgtgaactgtatgttgcaaagccacagcaaagaacaagtcacttagctagagagggagtcttctcaaagacccagtaaccccatcccaagatgccaccagggaaacagaaactctctggaggtgaaagaaacttaatttccttgagtgcaaattgaaaaggcaaataattggtagcctgtgaatagtcataggaacctcttcactctggaatggaacctgattcaggaggaagtcaagagcctatgcaaatatttctgcatttgcaaacttggggatttgccaagggcttgagatgtatccactgaaaatgtcaagcgtctactgtgtagaattttgatggaggaggatttcaaaattcttcttctatttaaatccaatcaattcatgtttatcagggcatctctgatctttttgtttttaagagacatatttgctctattgtccaggctggagtacagtgatgtgatcatagcccatggcaggctcaaactcctggactcaagagatcctcccgcctctgtctcctgagtagttagaattacaggtgtgagccaccatgtccataattttatttttattttttttaagacagggtcttgctatgtcgcccaggctgatctcaaactcctgggctcaagtgatcctcctgtgtcagcctcctgagcagctggcattacaggcatgagccactgtatccagctcctctgatcttaagatagtttcaacatctaatgctaagcctggaagtccaatgaaagactcaatagactaaaattggtgactgagattcggaggagcatatcgtgtgtttataacactgcttttattttttccatatctttctactatttgtttattagcttttctttggatctcagttattcatacataacacatgtttaaaaagttgatcctaaaccccaattcaagggtccaccgatgctcagagatctcaagatttctgagactagcttccctatacttctccctggctttgctccccaaatctgaaaggcattttcagatcacccctacttcatatttagatataaagcttccccctttatccacaagaattccagctgcacctggcatttcaaaaacacttagtaatgaggaggggagacccatcagtcatgtactcaccacttccattgttgtcctgcctcccaagcacatatttccaactgtgaaacctcccaacagggcagtcctctggatagtgtggttcagtcacttcccaccaccatgcctcacctcctctgccttccaagccctctgggacttcagggaataccttttctccatcatattacaattagatacagggaacctttggagagttctgagtatttgtgattatattcaataacctgttactgacagtttcttttagttaaagaattttttcaagtaagttaccaaaacaatgaatgtatgtacatctagaaactgagaaatactcttccatgacttttagttaggtcctcacgttttccacatatgtattgaatttttaaaatactattttaaaagggtctacatttattttcctctacttttgtttttcctcttgcctttgttttggagcaaattttaactgaacacattgtcagagggtcaggccaagtttggcactgctcgtgtatctcagccaccttccagttttcagcacgatgtctgaactgaaaaaacaccattgcttaccataagggtgtggccatgacagcttgaacaacatccgggtagtggtaagtctacatttgctacacagatgtaagaaacagatagcagtagggtctacctctcctgctccatcttttccatcaccaggtctcttccaactccagaattaaagtcatcaagttggaacaactctaagtgtgtttcctgatcataacaagacaggttgaggttcatgaatattttctttagtattaaatgttagaacataaccactaataataacagtagcatagtagttccctgataaattttgacaaaagatcataaagttctcaatttcaacagcagggctttatagttgtaatataattttgaccagtaagccaccggctatccagaaacctcacaggtgccattatcatggatagttgcagttttttctctaagaatcatgcaaaaaaaaaaaatcttttggggatacttcagaactctgtctttttaaattggatgaacaaaatataattttaacttctatggatacatgtgggtcattgtgagcatcagttactatgttataaaacagagtaccaaagatccatcaaaatacataaaatttcactgaattgcttacattaaatgctcatatcagctttagaattccatgccttgaattcttgtgccttttaaatttttttttagtttttctgttttttactcttacttcttactgatacttgataaaagagctttaataatccttgcacagtacagtatcagttgcttccaatttgctaggtgcatttgacaaactaataaccaagcctcttaaaacttgaagtaaatgcagaggcctgaaagagggtataaaatttcctccaatgatcaaaattcataaactgtagctcatggacttatgacctttctcttgatttgccatctaggtcccaactggataagtgaaattatgtaaatgtgagttccagattgttgtggtattatcctaatacctatcaactacatagcatgttactaaacgtatctcatttttcttctcaagatagttcagtggtcttggtaaggttatgatggttacacctactttacagataaggaagaaaattggtcacgggctttggccaagtctgacccagaatgctagtgctgcctgttgatacagccagtgttttccagccctgcccgcctagtgcatctgcagatttgtaaatacactttgactccacaggaaacaggatggagaacagcatgtcagggactccttgatgggcaggatggagggcaaaaaagagccttaaagacattagggaattcacagagtagggagtgagagacaagttaaatgctatccagttgtcacacagctttcttaatgttatctttcatcaaatcatgtcctagaacctgccaggacttcagactaaatgcatcttcttcttgcctgtacctttcacacactaaatgtctcaacagctcacttggcaaggacccaaaggcagcacacacttctccactccaaggagggtggctgccactaaacacaatgggcggagacagctcaacaatagtgccagttgagcacatcttgatccactgccacagagttcacagtagtagttggccctcaaagcaaacccactggggtgttgagggcaaaaaaacaatcttagccttaaggggccagactttgccatcaaattaacaaatctgcccaacagccccaggctgaggcgctcaggggtgtgacaggagggcccctgttaacaattctgtatcctgtgggtgccttaactagatggagtggagaggaagcagagagctaagtgtcacaccaccctctcctcctgcctgcaggtgtcttagttggacagctgtccaccttccttgcaaaaaactcccacaatctttaaatgcaactatgtaaagggcctccagcctctgcaagccatcacaactttaaagagcatatgtcaaacagctcagacggcatctgaggtctattcttcagccccacagtatagcccaaccccagagcacaagtgacaccctagtggacaggaactcctccctacactggctgctcagcaggaccatgaagaacagctgggacctggcctattaccttggcttcaggattcattttctgcctggaattgggaaactggaggccctgcaggggtccttctcctgggtccaactgtctccagggtgcaagaggggtgaaattaccaaatgaaagttcagataagcaattactggctgaaagagacacaggagggtcttcagatcaacactgacccagagctaataccacactgtcctcagagggacacacgatcactgacctgtattcttcacatttaagttgctagaattattcctccttgcccccactctctccctgcccccagcatacacataattacataaagacgtcttaaacaactgtagcacccaacttcttcagtctgggggagagccaggagatggtggggagctgtttgggcacacgtctgatcattacataatcacacaaacatgggctggagaacactgccatgcagatcagttcagcaaacacctcattctccctctttcctcttccctccccccgtaacacccaaaatgcacaccagagttaacaaaaccgaagcactccaggtagccagtgggcacctggctgctgtggttacaatgccaagggctaccagaaacgtcagcgtataccagaaagagggccagggtgctgctcacccagcgaccagatctgcagaccctcttcctgcaaccactgcccccgaagttcaaggaagggcctagccacagaaatattcctgacctgcaacagaaaccaaaccagctacgttaaaggaaaccaatgccgagcctccaagttcctctgcaccactgccacactcaggagtcctcagcagcctggacaatatcattagggaccattcggcaccatcagtgtttccatttaaaagatagtaaaatgtggggcataacttggaggggacactctctctgctagcagggaggcaagaatcccctatagaataggagtttggtttgggtttggttgggtcaggttgggggttgggaaatgattttgctttaggaatattttcagggggctaggattaagggggaaaaagaaagctatcccctctgtctcagcagccagcatcatacgaatctcactctcaaccaagcaggctactgcagtccgcctaaacaatccggagcagcagccaaggcagcacaagaaaacgccggtgccacggaacgcgatgcctaagccccccagccgaggctcctatggagccggccgccagtgcgcgggtgcagagcccagcagagcctgctgcaagcagcgctggagcgcacggcgcgcatagggttacagccccgccgccgccgccgccgccgccgcctgtgattgacgcgcgggggtcacttgaggctcgcgccgctccccagcaccaggccgagcagcgcgctcagcccaccgggggcactggccgccacgcgcagcccacccggccggcccctgcgtctcggcagccggacaccttgcctaagaaaggcatacacaaaatggaatcgcagctcgctattctgcttcgcggtgcggcctcaggcaaaaacacaatcacaaggtaaaatacagcgcaaggaatccatccgccgaataaaaacccagagtcccctaccttcggccttgggatggcaaactggtcctgtgttctctgacccacggatccagccccttcttcatgaattattccggccaggcaggattttgtgcatttttttcatgaacacctgtttcaagtaaggggtaaagaccttattgaaagaattgtccttaaaaaataacctgtgcatacgtatgtccatccaggcatgcatgcgtgtttgtatacacacatatgcacacggaatagccatgtacattgaagcaccaaactaggcagctggataatgggagagtcggctggttgtgagcatgctcgcgccgggaacagatccaccctctgttattcctctgaataaatataaatcacgatcagaaacccaaacagaagcatccctcttgaattcgtgctgctgaaaaacacggaat

SEQ ID NO: 1746 - DNA, 188737 bp, Homo sapiens
aagaggaaactaaaaccacatttattaatgctgtttaggtggagaaaagttggaaacaacctaaacatcaaaccataagagatgaggtaaacaaaggatgctgtagctatgtaaatgagtactcttacattacaattgctgtaaactaagcttgttgctctagaaagttgttcatataagatattaagtgccaacgtgttttatgaaagactatacatgatattgtgacactacacttacattaaaatatatgtgtacatattatatatgtatgatactatatgactaaatgatcatcttgtctttggggtaagtaggatttggaagtagctttttcttctttttatttgtctacacttccaaagtttttgtaacaagcatgtgctgctttgcaataatgaaaaatagcaatgctaacatttaactgaaaaaagaaaagcacaattatcctggagtagggcaggcactaaaaaggcgggagtaagagcgatgagagtagaacgctgagctgaggctggcctccttcacggccaccttcctccaggggtggatccgtgttccagtcacctccaaacacacaaagatgtcagtgccacagaccatactttctctcacacatccagtcaaagcaccaggaggggacagagtcaccacagtgcaagtctcagctgggattgggcaggggagaggagaagggcatcaaggagctgaccaggagacacactgatctggccaggcagcctcttgcagaagtggatcccgttaacaatgaaacagatatgacatgaacttggcaacttctgagaacaggaatgtctagtggtgcttctagcctaaagtgacccagtttcagataagacagtttaatccagaactcagagggagaaaagattaatattttctcctagggaaggatacccagagctaccacagctgaaatgggaataacatgcttaaaggtggatatgagatggccaaagtcccatgaggaatggcctccaggtatgatgatgaaatccagtgcaggagggaaggtctcttctcatagtatccaattgcaaaactggtcaaaattcaaccattttctcagggttattctaaaagctgttggacttgtactgcttctttggcttctctggctcttgttccagcttttgcagttacaaaatgagaaagacctcgctgtgctgtcctccattcagtgggttctggatggattgccagatgatgtgaagggctcttggtcatggctggtacctgcaaacacggagagtgcttatcaccattggactctactgtgccatttccatcatgtcaatcatggatagacatgagataaggaggatggaatcggcagtgggcaggacacaataggaagcgagggaggggagagggcaacagggtggaagggtagagagaattgcaggaagaaggagggacccaggaatggcccaacatcctcagagatgaaagattacagaaagagggcagaaggcgagagcagagaggccatgccagcttgggctggagcagtcagattcctcaccacacccttgtccctgctgtgcccatctgctgccctttctttgccttctggccctgtaggagccatcccagccccacatcccaagccctacctgtgactacccctcccctaagccctaccagagaaatgaacttacttctacccttcgtgggccgcatgcctccagctccagctcttcttggggctccagagtgtgccagtttcccttcaagcaccagtgtcctcaacctctggcatggtattggaatctgtgccttcagaacctcctttcttcccattcttcaggacgtttgtccctcgactggacaagatccagcaggagtgggcaacacaggaacaaatccgagacaccagactgagagggacaggaaggggaaacacggggcagtcctgggtgatctggaccatctggtcacctcattctagttcacgagtggacatttagataagggaaaccaaactgaatcagaactctaaactcagtgtgcagcagggtcaccagattgcttattctatggcacctgagacctttcatcaccactgatcttcacgacagatgcacgcagatatatctaccaaggacttagaaacccaagacagtttcatactttaaaaatgtgtggaaactaaccatgcacaaacttctccaattacatcagtctccccagaagcacatccaacagcactctgtcacaacttctggaagcagcctgcctccttgctaacccctcctccatgcagatgctcacctagaggagtggatgggacataataccaaggaggagagtgtgggtccagtcctagcacaggccaggaacattttctgctttagagtcacaggactgttcaccaagccaagctgaataaacatcttattgcaatatttgcacagacatgcaactacttgctgtgaccatgacagtgactggaatgtaaggatccatcagtggtagacccaaatcttttttttttttttttccaagtcttgccctgtcgcccaggctggagtgcaatggcgcaatctcggctcactgcaacctctgcctcctgggttcaagcaattctcctgcctcaccctcccgagtatctgggactacaggcatgcaccaccatgcccagctaatttttgtatttttagtagacatggggtttcaccatgttggccaggctggtctcaaactcctgaccttgggatccacccaccttggcctcctaaagtgctgggattacaggcatgagacaccacgcctggccggtagacccaaatcttaaagcacatactctactctagtggttcctaaactttagcatgcatcagaatcatttgtagactttgttaaaacacagagttttggttacactcctacggttttttaatcagtaggtctggggtggaggctgacagctagagtttctaacaagttcccaagcccagctattgctggtccagagaccacactttgagaaccactggtctaccaccaacagtgttcaatagtatcacctgtcttatatcaaaggaaccactaatgactcactcgcactcagccctgtaacctcatccaaagcagaggcacagaaaaggccaccacacacacaaagaaaaactgtttacaaaatgtttttattttaaggttaagaataaaaggagccttagggttcatataatctaactacctcacttaatataatattaattaaactaagcttagagagggtaacttgcacacagaaacaatgaaacaatcaatagaacccaaaccaggaaccccagcagcactactctcaaaatcgcaaacgtggagtcctagaaaatctcctaatttttgtcgtcattagagtcacaaggctcaagagtctgcaactggcaaattagggcttccccttctggtcctccatgccgaagcactcaggccatgccatggtcatttcttagtaaggctatgatggaagcaattcttggttccctccaagttcaactgtgagtccactgcctagaactcagaactggttttctcagaaatcccatagcacacgtggagggttcctgggagaactcttcctactaggcaccacattgttgaactgcagtgatgatagcccacaggatctaaccatcatgaagaatataatttcctaaaattccattctgagtttcaacttggacctgtgctggtccctcttcctggaaaactgctgccccagttttctcatgtcaggctccttctgtatgtttcctcttgcagagtatctcctgatcatctacccaagtagttctcactcccctcctgccagttacactgcatctcatcagccttctctacactccttatagccctagaactatataaaacatttgttcatcatctacttgctcattaccccctgaaagtaggatgtgagcttcgagagggcaggaactttacctttctgtctaccactataaccgcagcacctagaacagtgcttgggacacagcagattctctatacatatctgtctaatgaacaaatgaatgtacagaagaatgatgagagagcaccttcttcttcttcttttttttttttttttttttttttttttttttgagacagagtcttgctctgttgccaggctggcgtgtagtggcatgatgttggctcactgcaacatctgcctcctggattcaagcaattctcctgcctcagactcccaagtagctgggtctacaggcacgtgccaccacacctggctaatttttgtatttttagtagagacaaggtttcaccatgttagccaggatggtctcaatctcttgacctcgtgatctgccagcctcggcctcccaaagtgctgggattacaggcgtgaaccatcatgtccagatgagagcaccttctttcaacgtggtttccaaagttggaatttgagactttccttcctgtttctctcattttcaatagtaggagttagactactgagctttaatagaacgtggaaggagaaaaacgtgcccttaggctggtgttctcaatgacaggacagagaagaggaagttgcagggattgggggtggtgtcgatttacttctcagctctggtgtcctttcgcacagaaagcatgctggtgagtcaggtcttcctggatacagggcttgggaggcaatgaggtgtactggaatgagatgtttttgagaccaaagagttgggttcaaaccctcaaaaagtcatgtaaatctctctgagcctcatggggctggtagaaaatacccaagggatagggtgtttgtgaggatcaaggaagttaacatatgtggacactctctgtaaatagtaaaataatataagttgctattaaatgattattgataagaccacataggctctggagagatccaaataggtgaaatttctcggcatgcatctccattcagtcttgctgttttgccttccttagttctaccagcactctcagaccccaggctgctgcgtgggagccccggctcaagagcagaagccctaaggtgctggcatgggctcctcagagccccgtggggctgccagcagccacagcacagccatgagcagggcagccaacaggaagcccaggagaagaccactgtgagaggccacagagggacacagggacaccgtcatcggccctgagccaggggcaggtgtaagaaacaagccggaagccctcacttttggcccaaatgctttggataggccagaatcccagagacaggaatatcagagaagccagcttccctcttatgaccaggccctggcttcttcatgtccttagggtgggttctacactccactcccaaaagcagggcctatacttcttcccttgccaagaaggtggggtggatggtattgggatctttggatggattcccaagattggagaaggtctcctttctcagtcttcatgggctgcactgccaatttctcattgaccaaactttaatgttccaggcaacgaggctcttggctataaggtgtcctcatgttacagaaatcacctcctctgacccagttactcccaaactgtttccactcttccttaagtgataaccttaatgacaagtctcatgcaaacagtaatttcttatcctttcttccaagagttcagttcactccagcaactggctactaactacttacagctgagcacagatttcacgcagaactgtgtaaagttgtccttgggaagacaaacacagcagccagttcctgccaccaagcagcacacagtctgggtgggaacagagacttcacgtccccaccacgaatggctgtgttttagagttcattacctgaaaagaaacagggtgggaggcatgtggggaataaagtgagcaggctggaggaggtcttcttcaagaaaacagagactggcccagctctcttctggctccaaaatgctgtgtttattgggttgtctggatcagaggcaaattcttggatttctgacaatgttgctatgatgtaatgagggctagaatcttcttgaatcaggaaagtttcagggaggttctattagtctgttctcacacggctataaggacatactgagactgggtgatttataaaggaaagaggtttaattgactcgtagttctgcatggctggggaggcctcaggacatttacaatcatggtgaaaggtgaaggggaagcaaggcaccctcttcacaaggtggcaggaaggagaatgaaagcaggaggaactaccaaacaattataaaaccatcagatatttcgagaactcactatcatgagaacagcatgggggaaactgcccccacgattcaatcacctccacctgctctctcctttgacatgtggggattatggggattacaattcaagtgagattttgggtggggacacaggcaaaccatatcagaggtgttatatagtaaggagcttaaaaaacagaaggatttcaacgtgtagaaagggagaggaagggagttccaggctgagaggagtgagtgagggaaagtaggagtgaagagggtacccagaaactggatgatccagcagctttagttcagtggggtttgaggcacttgggaactcaccaaggcgaacctgccacaagctacccagggtctccacctgccaaccttcagcagcggctctaggctgctgatgccagctagagaagcctgtctgtaaatgatgatgaatgtgtgagctcaccaagggagaaggccagaggagctcacacatcgaggagctggctttcaagggatggggaaagaaaggcaccagagaagcagagcgaagacgtggaaaccatagagccttactaagtgtgttcactcacccggctgtacctagggccacctgttgtcctcttggatggaggcagatcggctttctctctccctctctctctccctctctctgtcccacctcctctctctctctctctctcagttctgggctgggacagggaagaacagcaggactctattacttcaggcaaattttgacagatgggccaggacctgcatacagggccacccagcaggcgctggggaagggagcctgctaaggggctgactgcagagccaggcccaggtctgaagggccacgggtgcctggtttcaggttggaaagggtttcaagttgggcagggttggcaatggagcatcccactgaaaacagaagagcctcacccccaccccactgactcctgttcgctcacccctctgagcttctgcccatgccgatccctgtgtctggagcactgctcagggctccctcttggcatattcttgctgcacttttttttttttttttttttttatactctaagttttagggtacatgtgcacattgtgcaggttagttacatatgtatacatgtgccatgctggtgcgctgcacccactaatgtgtcatctagcattaggtatatctcccaatgttatccctcccccctcccccgaccccaccacagtccccagagtgtgatattccccttcctgtgtccacgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaaccgtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttcttgctgcacttttaaaacctgcttccaaactcaccttctccatgaattccctaactcttgaagtcaaaaatcgatcttttcctcccctatacactattctcacaacacttttcatacacaaaaatcagatatggctctatctcccccactggaccatagaactcctcagattagaaacggcactagggtcacaaattcaaatgctcacagagccaggcagataacataaatgggtgaagctgctggtttaggtgacatgggtggtaattgtcttggtgatggccagacaataggagtcactggaagctgtgatgaatcagaggggctggaatgattgattgattgagacagagtcttgctctgtcatacaggctggagtgcagtgatgcaatctcagctcactgcaacctttgcctctcgggttcaagtgatcctcctgcctcaccctcccaagtagctgggactacaggtgcatgccaccaaaggggcctgctgcccctcctgcccatatggagaataccagagcatgggaatgtgacctgtattaccagaactgcaattttcagggagaggccaggtatctgcattcttatatgaaattaccccatctttatgtgtcagcagcaaatccaaatttaagacaccatgttgcaagccaaataaaatgcatctgcagccagatgcaatgaaagcttgttgattgaaaagcaaatgaacaaatgaatgaaggaatagaaaagaaggagcagatgggtgggagggggaaacaggatgggtgcccaagtgtcaagatgccaagcggtgggctgggcacgctcaaggtgaccccgttgccaagctgtcagtgtgaacatcagcacggtcttgcttgttggctaaggggaagagaaaagcctatggccctgtgaacttagcaaccagcttctccaaaaacattacaatcagaagctcttgttgcagccaaaacacaggtgcagaaaacaagcgggcgttcgcacatgcacgtgcacaaggtgtgcagaagttgaaggctcagcatgccacaaattccgcactccctccaagcacaccttatgcctcatgttacagatgtcttgagggaggaagggagggacaatttagcaaattgggaggtgcagcaggggaaaaggagtcatccagccagaattctccccatctctacccagaaactccctctccttgctttgttgacggcgctgaagcttgggggaggcataagtgagcctggtgtgggactgaccctcagcctccaggaacactatcggcaggaacacagcccgtgtgggatgcctggggttgcaaaagaaaagttatttcaggttcaactgagttataatttattttttctaactgatcattactgctgcggctctataaataaccacctagggagtctgcttttctgctcccaaatcctcaaaaagcattgccaggttctctgtggtttctggcctgccaagcacacagcacatttcttttctgtgcagcccttcagggaatccttctgcagtgcatgccaaggaatctgctgagttctgcccaactcagtcctccccttcctgatccaattcctctcctccaaactggccatccagccctcctcccccattccacaagaggcccctctccctggacacaggtggttcccaagccaaggtcccggcttctctctgtttactctgcttccatccaactgcaaccctccatgcttagaagacaagagttatttgtactacagaaatccagctgtggcatcatttgaggtcaagcccaggaagaaaagagggttggtctgatggtatcaccagtaaaatatcaagggtcaataccaccccaggaagggtggctgtggtttacatgaaatcaatttaagtgatttaaagaagaatgtatttcaagtacaactcagtttaaccaagtatagaaaaaaaaaaatcatgttcctgatgatgttctaaaggatgtacgtttaggccctttctaaataacatggggttttctccttaaacagaggaactagacgggaactaatattcatcaagacccactccacaccaagcaattttgtttcattttcacaacatgatgcctatgaggtatgcatcctcatgcccatcttgtagatgggagtcctgagaaaaggacttgctcaaagtcatgcagaaggaaagaggtaggggtgagactcaagcccaagtttttcccctgctacctcctattacctctctaagctagaagactggagtttcaatgtatgtttatttttctaactttcagattacttttgcagctcagaaagcaaggacaacctggatatttcaccacagttccttaacagccatataactctttggagttagcctctccaactagttaactgtgaaatctcaatcaatcaatcaatctctctctctctctctctcaccatttattacgacaatgaccataaaggctatggtcattcaggttgctttaatggtctaaaaatgagagcttatgtatttttgaatagttttaaaaatgatcattcctaacatttacaaaataatggaaaacataagttttacccagtaatcaatgctccacggaaggttaggtggccctgcagatgctaccacagcactctgctctgttgggacaccttttccaccatattggaatggactgtttccttgtctgactctccttctaggccggtgatccccaaagctttttggtcatatgccctaacaataaacatttgagtgtacctgcctatgtgcacatttgtttatttataaattatattcatgccctgtcattcacaaaaatgggaaaaaggatgagatgtgtgtgggtcatcttcctatgtgtctatctacttctcaatcataatttcttcctgccccacaatggaccatctcaccttccatggtctccaacaccgacatcccactttggagaccactctcctaggatatgtgctcatcatccctcatttattcatttcccactgtctccagtaacacctaccctatgctgggtactatgctaggtgctggggatagtgggtgaaccacatggacaaggatcatgttttccatagagcttacaatccagcgggtgaaacagtgtcagataatgtcagagagagaaaacagccacaagaaagtaaaacaagatgatgtgatgttaagtgatggagaatgtctacaggggtaagagggaagtcacgatggaccagaccagcagctcagcaaaggcctctgtgacctgcatgaggagggggtctagtgggagagggggtgcctgggcagacagaatgtcaagtgcaaagcttccgaggcaggaaagaaggccattgtggctggattataatacatcagtaagaagagaggctggagaagctggagaggttggcagctcaggctggagagtcctgaccccactgcttactggctgggtggccttgggtattaatgctatatgctgcccagggttattaaaggaattatgtaaaggattgaaagagtaaatctatgaaacatcaacatcagttagaagaatgcccagcacacagttggcatcaacaaatgactgcccctagggtctgtttacttatttatcattagtctcccctgtggcatggaagctgggcctggccagttttctaccctgccgaaccagagtagctggcaccatgcccagcctatagaaagaactcaatgaaaatttggtaaatgaatgggttttaaaaatgggtaatggctaaggaaaatcagaatttggctaaatattaaaaaatagattttcgtaaacaattttttctaattataaaagtaatgtcatgtcttcaatattttaaacaaaaatggggtcatattctacataccgcttagtacctattttccactccacatgtctgttacaagaggcaggagaatgtaagggtagggatgtgggctctggagacagattgcctggattcacatcctacctccaccactggccacctagagcatctctctgaagttaccaagccaaaggacatttgggatttttaaggctttttaacacatattgccaaatagtctttaagaaataggtgtgagcccatctcctcaaaccttcatctacgctgactgctaacctttagacaatctttgccaatttgttaggggaaagaacaacctttcattgttctaatttgcctttctttaattaccagggatgactaacagtttttcatttgccttgttcctcttgcgaattgcctgttcatgtttaaaaaggaagcccgttttcataattagatgcagcagagtaggtggcctcaaagtgaactccctaccgctgggaagggttgagcagggccaggtggttgcccatcagggaactgggcatctctgtgccttgtggacagcagaactggatgagctctgaagtcctttattacactgggatcatttcactcttgtccagaccagcaaaggtagcaggcaaacctcaaagaaaagatggcttgcggatcaacaactggattctgaagacctccaccaggatttcccaaggtggatttgatgcctaaacatctctcataagcttctgcataaagacaccccagttatatcggagagaagagtcaaatcgacatggttatgcctctagtagctacagcatgccacagtgggggaattccttaaatctcccccttgacaagatggaaaaccttcgtggtcatagatcaaatcctaccacaacaaacatgttcataatcaaggtcagcatagcacaaagactcctaaggtggggccagtggtctgtttatctcaagctataacttttttccctgctttgcatttggctttggtacaagaatttgacataaacaccctcctaaccccactcccctacaggtatttacatagcaattttctcctgagctggtcaaaaccctgctaggacttggagaattccattgtgtttgtagtaagcagacacctggagccagatagctcttagagaataaactattcttggattggaaagggatctgaatgtatctgacgccctccttttgcaaaaattttgcagtgttttcagaggaccttctacattttcactaaggggatatttccccctaatatctccaccattgccattgttggagtttcctgctgggtctggcccccacaggtataatgccagctggaaacagaacactcacatctcttaaattactccactaacgaagaagtcacacgtggaattagaattctggctaattttcctgtgggcacaccttaagcacacaaacctgaaagcagcagagcagcgaaactggcagccaaaataaagcaaaaagaagaacatcttccaggagggaggtggaatcagattgaggcaaagccaggactaggttcttggcaacgtgattaaaatcccgaactacgagggaggagaggccttgctgccagcccctcagcacactcgagccagggcactggaggtgggtggtggttaaaagctgtgtgccattcacagcctatagcactgcctgtgtccgtcagtatgggcagaatggctaatgactccaaataaaactcctacaccatgctccatctggggaccatgttatagctgaatacacaaagtcactttgtagcttgcccgataagtccactttaattcctccaaaataattcatggaggcctgtgagcacactgcaccaggccaagcactagggttataaaaaagaaatgaaaaaagaaaaacctagttgctctactctaagggcttatgatttaaccaaggagatgagattcacaatggtagctggcaatacggtaaatcaaggcacaaagaatccaggagtgtgttctgctagaggcccaagagggcagctggcattttcaggaggatgcaggtcagcctttatgggaaaatggattgagtttaccttgaagggtggggaaattttaggcaggtggctaagaagtgagctggcctctggggatgtggggagactgtgagcgccgcatgagacaggctctgcatcctgcacatgctgcctgcatttccagccctgggaggaggatttgtgcaagggaggcagagatgagagcgttgataggaaggaaggaggccagatttcagagaggtctgaatcccacacagagaagcttgggctttctccaataagctgcagggagcagttggagacttgtgaacagcagattaacataattaaataaaaacttcaagactttagctttttgtggggatgcagactagacgagaggtgatgagaacattagaaagcttttacagtgtagaccaggctggccacggtgttggcaacgggagagaaagaaatagatctggaagataccacaaagcaaatatctaaagggcttggaaacaaatttggccggggggcggatgaaggatgagtcaggggcagttctgaattttaaaacttgggggatgtgaggtggaggtggcatcgtcagacataaagacacaggttcgagcagctttacaagaacttaaaaaggccagaccacccaaaggtggcactgactggaagcacgaggctacggacaatgcttcctcatttcaaaggggagttaacaagttaagtgaagttttatccaccaatgaaatggctgtctgtccaaacaaataagcaacaagtgtgggctctgcactcctctccacctctcttgctccttccgttgatgctcccctaacatttatctgaccataagctaagagcagtcatgagaacaagatagaaatcctcagaaatccagaactctaatccttccttctgctgaaatactgtagggcttagttattttcacacttatgcatatgcttcagtgtgtaagaactgagtcattgttttcttttctcctcccctctcccctctctttccctcctctttgccacccagcacctcctctgcctccacccccaagccactgcaaacatcctggcatgcatctctccccatccatttctgcatggctgtcaacatttcccattccctccaagcttgcctcctgcctcctatttctttagacacactgggagtctaagaaatgaactacagattcaacaggactgtggaccacagatcttgacaaagacaggcagcttgttgtgaaaagagaattggagggcaggtcagagacttaggttttaggagtcaggcaagggaatcagataaagatccctgaaaacaagggatatcatcactgcccagctttactgacgtagagacaagttttctcacttggcagatatagacggaagataagcaggttccctttcagatggtaaccccaagtgcagtggctcacagctgcagttattctgaatggcagcgggagggaaggaaacaatgaatgcacacacacacaagagcaatgcttaaggtgaaatggacttgaacagtctcaaatgcacacctcctccagttcctggaaggcaaggatgagtcaaacagaagttgaatttcacaggcgttcctcctccactgtcacatacgttcccagacgcagagtcatctgtgcacatgtcacccagcatcgactgctaccagcaactgcctcctgggaagttaagctgcagggtcagatctgcttctgctggggagctgaaagtaaactgcgtaaggtgggggtgatcccagtaatgtgagggcaggaaaaagcagagaacgctggaaaaggatggcaggaattaacatggctctgaagagaggagccaaggatcacctgatctgtagagcctggaatctgcagttatttctagtttcctagacaaccctgactaaactaggaagacatctgaactccggctcaaaaataatataggttcttggaatgggacaaaagaagaaaggaaaggggaggtgataccatgtgccagttcagggagtggggaccagaccttcagagaaaggaaggtcttcccaaatggaagctgaaatcccagtgggcattatgctttctgtacttttgcatttgtagccaagagcatgattctaattctggttctccagcggaggtgcgggcagcacatgtgcatgagttcgtcaaaattgatctaacggcacacataagatctgtacatttcactgtatgtaaattagatcctagtaattctacctctctcaattagttggttgtgtgaccttggacaagtcatttaaatttttgtagtccaggattctccatctgtcaagctgaagctaagaagctggcctctaagtttctccctggctctaaaatttacgattgtgagagctgattattgcaggaaatgagcaaatacatccagattaagaagggccgcaactattgatagaagctaagaagaatttctgaatgggattagccatctgcagaaaattccccctaaatcatccatcctggaatcagacgtggagagaggtgaagattccatcctctgcaccaaaaggaagtggcagcccctcctggctctgcattttcccctccttcccatccgctctcccctacagactctctaaattcttccactggagattccccaagggctcaggattgggacaggccttttcttcccttccttccaaatttcctttgggtttatagcaccctggtcgggttcacaggaagggaaaggagagggaagaaaccattcacatttgggtgtgcgtagcaagcagagagctggagggttacagaaacttagaggaggtcagagccagacaatcatctccccatcctatgtcttatggataagaaaatgaagatgcagaaaactagtgtgacttctcaccatttctaaagccccggaaagaacagatcaaggaggcagctgtggccatcttcaggctggttctttcacatagagatgctcctacttactccataaatagtttgtcatgggcaactttcagacagaggagctggaactaccctaaccgggcactggaacatgtgtaagtagaccacctggctcacctgtttctcttctcagaggggctctgagtcatgaggagaacctctggatatgcagaatggataaactgcttctgtcaggatggaaaggaattcacagatgtcttgccagcagctaaccagtgacacagctgaatggtagcaggcccatggaaacactctggataagaaagactatcaaaggagcatcaggtccagattgcaaattgctttagcagctaacataggcataaagacagaacgacccactctaatccaagggggttacgcttcagcgctggctgcctctgactctcacccttgacccagcccattcatcagtatgttgataagcagattctcttcacagagctccttaatctggtttcccagggaggtcttgcagagattaatgagagcactgtgcttcctgccagtttttgaggctgggacagttaaacagcaagggtgaaggagcttgtcataaagtacacaaaccatcccatcattggacttgaccccattaggtggttaactcaaacatcttctcaatgtagacacttggatctattttttttattcactctctccttggtagccagcaaaattaaagcccttcctcatatcatcgttcacgccatcttttataatagtcacagccacaacagcagctggggctaaacaaagattaggagcaataaggatcagatgggacagacaggagatctggtcctaccaaggggcatcaccaatgagctggacccactgtgcagcccacctgtcaaatgccatttgccacctctggcggtgatagcaggggcagctggggctgaatccatgaatcctgaggtctcacagaagtacagccacccctgtcatctagcccctcccctcagaatatgctctggggagctgtcacatcccacactgcaggctgatggaagacacagacacactcttgggtcctggcattatcgctgtttcctctggttacctttaaagaagggcgtctctgagtgctgggtcctccactggaaataatgtggggaaactggatgagctctgcagagatgagaattattttgaagcaaagtaagaaatgaccagggaactctagattggaatacagcttgtgaattcctaggtaggtgtagactcaagagtttataggaacttatatttgctgttattttttaaaagtcttaaaagttaaaatttacagcaatagcaagaaggaggacaaagtgcaacagctttaactatgagctaataccaaggttaacactatctgtccattacacgtagctttgggatttggcaaaaaggaaaaaaaaccacataacacggagctttgagctcataaataggtcccaaagacttgacaaataaactaacaaggcttttatggtagaagggagcatcgaaatctgaggccttctgtgccttctctccccgctgctgtgatggcagctggcaactgggccctactgtccattaacaaaacagagagacggataactatccagccgaggccagcttcctcacaccaggcagatccacagtggactctcaggaatcttcagcaccctttacaccagcagtggtcaaagtggggggtgcagctgccttgggactgagagatggggatggacacatctgcagggaggggtcaggctctagcccctttccccaggccaccactcctcagaggctggtcctccaccccagcttcagggacaggggatgcatggtggaaaccactgcagctgctgcattagcaaccttcaagagccaaagattctcttctctctagccagagagggaaggcaaacaggttagggtgacctgcagctcagggtcggccccaggccaggccactgcctgtactgactcctgggcctctatgcagtgcactccactttctagggcaggctgcttgccaaggattcacagtggacctggctgctccctgtgggactcactggatctggacccaggaccaagcctgcttgccaggagcagaaggtcaggttggtttaaaaaggtaacctctgtcctttcccagttccgttcctttctcttccccagctacctcctcctcttctccaaatcagccttctcttggctcagtttctgaccttgggtattttccccaaggaacacatccgaccatcaggcactcaaaggagcatgagcctagtcttttcctcaagcaaatcaccccggtacagtcagcagctgcagagcacagggagctcctggcatgctaaaggtcatttacagatcactgaaaaatctggacaagatgctaatgtcccagctcaatgcccatgtcctgacttaaaccttgactgtgtcttaaggacactcaacgtcaggatacctatgacagaaagagggacttctgagtatttcaggcataacaggcaaaacagacatctttaaagcttgcaaaatatatgattctgtcattcctctgcatcctcaccaccaccatgatggagagccagggccagtctttccaatcatcactcaagcttccagtggctattgggcactctccctcttagagaggggacactccagcaggaactccaggtagagagctgttctgcagtgggcatttctagctcagggccagcctccgagactctccaggagtggcatgaaatgaggtggatggggcttccttgtcctggccatcatgtgcctacagcaggcattggcaagctttttctataaagggccagaaagggttatggaccatcttctttgatgtttttattttacaactctttagaaatgtaagaatcatccttagtttgaggtgccatataaaaacaggcggcaggcaaatttggctcacaagcaggctgcagtttgcagaccccctcctagaggaagatgctgaggcctcaccaagcagcccctccccaccttccctctctagcctgactcctccagactcattccagctgcacgtggcacctgtactaggccgcaggatggccttcttgctgcaggcatttcaatgagaaaatatgctgcatggatcatgagtgattctgtctccctcgtgcttaaccttggaagcacaaggccctgctggcctcacctcaaggtctcacctgcccatactcatgcgaccttgtccaccatctctccactacgaggtgccatctggtaaatggcctaacttgggttcttcctcccacgcctcctgtgtaggttcagggcagggagaccaaggtaaatcctgtcagttctatctgaaggcagagcctggatccaatcacttcccacccctccaatgctatcacctagaacacagccacagcctcccatctggactccctgcttcgatctctgccctcccccctccccttccaaaagctcccagaggctttccatctcactcaaaataaaagccaatgtctctgagcagtgaaagccacccaccatggtcatccaggtcctatcactgacctgctgagccccaactggcccgcatggccacctggctggcctcagtgcctcctctttcccctagctgatactaactccagccacactggcctccttcctaccctgcttttcctcttagccatgaacaccatcagtagttatataatagtttgtgggggtttttttttttttggtcttgtttttctcactcaaatataagctctgtcaaatagagtctgacttcagtgttacactccagggcccagtgtcagccttgggtaggtgctctacaaatatacaaatatttggagaatgcatggggacaggatgccctgctgatgggtgagagatggtggcactgtcatgacactgtgtatcaatttgcacttggatacttttatgcaaataagtctcttgctcttaagtcccctcctcccccgccttagtagccagatgaaccgataagacactgaaaacagatacacccctggagacactagtctccaattttttgtttatattcaaccctaaagcaataacaacaaactcatattccaactgaactagtcaattatctcaggggaaaacaacaaacgattgctttatggtttagagcacacctgtgcgtggctctcccgcactcaccacaaccaccctcccatgagcacagcaaggaaagagaaagcatgggcttgctcagcagaggtctgggtttcaaatcctgacactgccatctataggtggtctgattctggacatggtaccaagtacactaggccttagctttaccatctgttaattggggatactaacacttatttcgtaagactgttgtaaggcttaagtgaacaattaaaacaaaacagacacctaaagcataatgactgtgcacattaattgctcaataaataggaatttctccccttttgtaagtgaggaagcaacagttcagaatgtgaaatgatttgcctgagatcagaaggcttgttcccagcaaaggtggggttcaaagcaatggtttctgtggatgtattttttccctagcatccagcctccttcctgttcatgtctacaccctataggctacttatgtcagtagaataaaacaggtgatggctctcccatcgacctgcttgttgaggattttgggacagttccattctaggctaatgctcattactaaagacaatgctcattaataaagacaacgctcttaaggaggtcaccccctcacacggagaaatctgtgtgtcacaagcaagggatcaaaaaagctaagagaattcacctgccctggatatcaactgcccttaagagatgcaaactaaaggtgactgccttcctttccccaagagacaaacggaaaccccactcagtgtgagaagagcacatgccatggaggccccagaccagtcagtgcccagtgaggagatgacagagcctgacgcagctacatctgagatcagatgccaaggacacagcaaagactgatgaagccatacgtgagacaccaaagtacgaaactcacattcaactcaaaggtttccatgtttgatgactgttatctccctgcacagtgtttttctttaaggagcacatgtgttctataatcctataaagtaaatttttgaaaaaaacaaaatgagaaacaaagggacacacagaaactcttgcaggtgacggatatgtgtattaccttgcctgtggtgacagcatcatgggtgtaagcatatgtcccaactcattagactgtacacattaaatctgtacagttttttaatatcaattataacctcaataaagttgaaaaaataaagaaaatttttgtagaacaaaagccttctcccattagctttcatcatgacattgaaatgtgttcctcttgaaacatattggcccctgacattataaaaatataaattattaaggaacaaatcttacaagtaacacgtttggaggacaaacaataaagagatggcctaaacaatgtctaaacagatttgaaacggagcagaatgtgagtgcgtctgactaaaagaggaggcttttctcaagtgtcagtcctgagacaaggaccctgggactgctgacatcccaaacatagtgcccctatgactccaagaagggaaggtgctgcaggggtgacggtccctccccaccccaccatcctcatctggctgatccctgctcatgcctcagaccttagctgaaatatcacttccccaaaaaaagccccccagcactagattgggtgactcattcactcattcactgagtcatccattcaacaagtgattactgaccccctagtatgagtcacattcgacttatcactctctcttttcaacgttgcaattaaataatcacacacacaatactgatttactgtctgtcaccctccctaaactgtcagttccaaaaggacagagattgtatctgatttgtcatttcattcccagcgcctgacacagtacgtgcaacatggtaggcatcctgtccatactggccgggtgaacgtacaaatgaatgaattaaagcatttgaaagctccattcatattctaaaattccaaaatgcaccctgctgtctactttacacagggataattgatgttacaatcaatatgacttttaaatttaacaaacgaaattgttttatttattaatctactagtaagtgaaaacaataagatgtaagacaacaggaagaaagttactctccctgagaggacagaacctgcaggtgttatcctgggactggcagaagcagcatagggtcatcgctgaggggagtgtggatagagtcaggctatctgggttagggtcttgacccctccactgaccagctatgtgactctgggcaagcaacttaacctctctgtcttccagttttcaaatctgtaaattgagaataagaatatcagcttcagataatttcattaacaagtaaatggattacgacacgtgaactgcttagaacagtgcctggcacgtgctaagtactcactaaatgtcagttgtttttattttctggaagaatgggaacaagatgggttaaaaccaaggacttggacatactgtcactaaattcacaaaccactcagaccaaatctccaagatttcctattacaaaatgaagtaattcaaaggcaggtggctggatgggttatctactccaacttccagacttactgctttacctatagaggtgatgatgccttatccatctgaaattaagggccaggtcaaacaaaccctcaaggtttctccaggactggagtctgggatttgattttatacaccccacagtgcccagcacaatgacgaacatgcatttaaagcttagaaaatgttcactgtgttaatttacaatgaataccatttaaagctaaaaaaaaaaaaacccctgcatattctaaagtatattatctagcatatgtgctagccccagaagaataaaatgcagaagtgaacaggagttgcttcatggaactgaaattaattatacacaattatctctgagatctttaaacagtaagtgaacaatgaaaatgtagattcagaattctcctggtaatgaataagatgatgaacatgtttccacagagggtgggatcaggttgatctgctgaaataaccagatagcaggataatttcactatctacgtgaaacattatccaagaatctgtgcgttactcgacaattaaatcagttcaaatgtcttatcaatgatttcatagaacaaccttcaatgagttaacaggaacccgtagataaaagacaagaatagggctacgtcaagaagctcaaaatcctcagctgctgataatgcaaaaccttggccacattgatgagcccaagaccaccagatctctttatactgagtcattttttaaagaaaacttttattttatatgttagttttccttataaaaataagttgtattgaggtataatttatatacagtaaaatgcaaccatttcaagtgaacagtgggttttgacaaatgtatatacccaagtaaccactaccctaatcaagatataaaaacttccataatgccagaaagttccctcatccttgataaaagaaaaacttcagccgaattaaatttaaaggagtttaattgagaaatgaatgactcgcaaatcaggcagcccccagaatcacagcaggttcacaaagactccaatgcagccatgtggtggaagaagatttacagacaaaagaaagggaaatgacatagtacagaaaacggaagtgaggtacagagtggcgggattggttacaagttggcatttgccttatttgaacacagtttgaacacttagcagtttataaatggttgaagtatggccacagggattggccaagacccagctattgttacaggcacatactcctaaatcttgtctacctattaagctaggttgcaattcatccacaagaactcaaatatagaagtacggagtccttctcaggccatatgcagtttgctttaacacactctttctcggttaatccctgctcttatctccctctatcccaccccaaggcaaccatagttttgacattccccctatagattagttttgcctattctaggatttcatgtaaatggaattgtacaatatatatatacttgttgatatctggcttctttcagtctaatgctttgaaaatccatgcatgtttttgcatgtgtcggtagtttgttcctttttattactgaataatatctatttgggtggactgcaagttgcttatccattccccagttgatgggtatttgggctgcttttagtcttggactgttttgaataaagctcttatgaacatccacgtacaagtcttccaccaacatatgtgttcacttctcttgagtaaatacctaggagtaaaatcactgggtcatatgctgtgcatgtttaactttctaggaaaatgccagatttatcctgaataacagaaatgatcaactgatttactattaaaggacttactggattttataaggaaaagaggaaacgagacgaaagaaaatgtagtgcatctgaaagcacatgggggctgctttgctgaaggggctggcaggcggcttcccaggcagggtctgctcaggactgctctagccagatgcctcccctggtgtttacttcacccacaggaaaatggccaccttcaccccaccttcagtggacgtgcagccccttcggtgctcctctcttcatctgccttcagaggtagtcctgattaacctgttgccagcagaattttctaggagagacaggacttgggggtaccactaggccccggggacatgcactcagctggcccaggcaccgataacctagcatgtccttttagaatttgggggatcccggcacccactgttctcagctttgggcctcagctaaggccaggacaagcatcatttaatgtcatgtcatataattagtatggaaactacaaaaacctatatgtttacaaaacaaccactgatctacattatttcagaggtaatgatacttttacatgagataacttcccaagacactaagctgaaattagataaatttaggttttctgtattctcgctgacttgtgtttttcacactggctttatcttggtttctgagggagaatcaattctctttaactctcttccagaatacctcactaccttcagaaaggaagaaggagggaaaaaaggacagagggaaggaggaggattagaattcctcatatcagagaatcccagagctttgaagctttaaagtgaattcaagagtgggattcaagagaccaaaccatggggtctaggggaaataaggaacccctctcccagaaggtggagaagcttctcaaagcaactggcccaggcagccttgtacttgcttcattctggggtcaggaagaagctgcaggccctccttcccaccctcgcttcccttctcctccacactgtcaactctgctccaggaaggggcagtatccccagtgtctgctgggccagcacagccatctctcacccacctgagttcataatgactcctgtgtagagcagacttcccttggcttcactgaaaccattccttcttgtcttagaaagcaatcagaaatatagttaactgccttaaagttcccttatcattgaaatgaactagatcacagaagtgcctatttgcattttttattcttattcactgggtttttaaaaggagccaagagaggggagaggaaatgcatttacttgctgggatttcacttgggatgttcatgttcgtctggaaagcaaaataaaggcatgaagattgcccactgatttcctttcatttggagaattctgcttgagttaggcttagctggctagcacataaacctgtcaagagaaaagtcttcctcttcctgggcctggtatgtctaccacctggggcttcagagacagtattctaggagattcacagtgtctaaggttcgaaatgtggacttcagcagcagggcagctgccaaacgctttcctgcccttgcagaaagccaccaccaaactcaccaccacctccctcaccgtggcctctctgtttcagtatctgagcagcgggtgaggaggactggattctagaagataaagagagactccacggtacagaaagtaagccctcaataggattctattagaaaacagctggaaggaactgtggagtcactcagtcccatggctgattttacagacaataagcaaacaaacaaacagaggccctgagggatttagttagcggtctccaagtgccagtccctgaggaaaggattctcctccccagctacctttcccttctccagtgtgtccacctcaggaaaagggcttgcatcctcccagctgctcacacacaacttgggctggccttggtgctggctctgtcctttctcccaccagatctgccttccgccctcgccacttgtctctgcccagggctcacttggaaggaccacatcaatgaacaaccttggcaggtcacagggagggatggagcgggggagagaacagcaaataggcttctgccctgcaagagagggagagccagaataccagcctggcttgggctgctcccgaaggtcctggctgctgcctgcaatgcagcgccttccttcagggctccagcaccatcccctgtcctcagcctttaaggctctactgctctcagccccagccctgcccttgaggctcccctgtaccctgtctttgtagatggtgcctgggaactgtcccgcttggagagtgctgtttgctaggatacacactgactcccatggctcccctccagctccccatccatcctgctcctggccacggcctctggcctgaagggctgcaaaacagccttccaactgggttcctggcttcccttctggcccctcttcatctgctgtccccagcagcatacagagctatcccatgaaatataagtcagaccatgtcatgccctggcttaaaacctctcaatggtttcctctggcatctccagtaaaaatcagaactccttgctgacttttgagagctgctctagacagggctgctctctgcagcctcctcttgtgccccgagcttcaggacactccagcagctgtggggcctcctttcccttactcatgaccccaggctctgccctgtctctgggcctcacacatgctgtccctgtgcctggcaggtgccccgtcactggtacaggctgtccccacccctctaggagagccttgccttagcagggtacatgccctgcaccttcttctctccacgaatttttattctctatccctggactgtgctcatttctttccaaacacctaacaaatttgtaattatgtgattttttgtttactttttaaatgactctctcccccaccgggatgcaagttccacatgggtacgaactaggtctgtcttgttctccacctgacatacaacagctactctagtcacatctacaaaacagcaactgggtttgggttcctataaagtggacaactctcctttctggggaaggattgcttcataatctgagattatgttccttctactttgttggggagagtgttaagttttttttttttttcttttatgaaaggatagtaagaataaggggtattcatcaaaaatttttaaatgataacctgatataattctccaaaatgtttttaaaatttttgagtctatgatatcccagattaagcaatgttttgggagtcacagtgttgggtcctagagaggcaaagagataggtgaagatagtgacagagaagagaccggctttgcagtcagactgcagggcctgggttcaagtcccaactctgctgcttggtagctgtcaaactctgagcgagttgcttaaactctctgtgccttagtttcctcatctgtaaaataaagataataatagaacctgtttcagaggactttataagaattaagtgaattaatacttgtaaagttaataaaacagtgcctggcctatagacaatgcttgacaaacattactgctatcattattatctattattattattattgctattgttattattactaaacccaggtctcctaaatccccaaccaggactcttttccctttaaaatgttatctcccagcattgtctctttaaatgttatctggccactcttaaatgtaagactgaaattcagcacttggaaaactatcccactccagccaagcacattttttgaatagctaaacactaaccctgataaaatgtatccatttaggatagaaatgtttctacaatatgttacatcttgtctactttctaactgggttttttgagatgagtatcattacagaaattatctgctgtgcagcctggaaacagcaaaaggaaaactcagcacgttctacagacgtgggttcaaagccctgctctgtcctccctccaagccctaaacccctcctgagtttcagtttccttactgaagaagtgggaaggccatgtgcattgagaggttactgtggttttgagtccagtgaatacacacactgctaaatcctaaaactcttctttcttttttggttaataatattaaactcatccaggagaataccttaatttaagactccaggcagaattctcctttccccaagctctgccaacacccaaacccctccccagaagacagcctggttcacacaacagaggaacagacccctcacgactctgcagggggaattcctttctgggagagaacacatgtccaatagggccagtccccactcaggctgctgctgtcactcagccagaaggcaggacaggcttttgaagctgtgatatttctgagtttggttttggacaaaaacaccattcttcctcatagcctttcacaccctgattcaagcaattttaactgaattctatttcccttcaatagaaggctatttgaagatacaaaaaccatatttgtgaatgaattctaggattgtatttgcagagtcactcctgttggatttcgtgctctataccaagtgtatttctacctctgggcctcagaaccatttctcacaccccccaacaatatctcatgccctcatatcccaaatatgcaattacctatcagttgtgaaaggtaaaaataaaattcatatgggtttcataggtcaatggttcatgttaaaggagacccatattaaataatattattaagtagatatttataaggctaagaataaaaggtggggaaatgggtgggattcatcttatctttctaatgttcattacctagaacctggaaaccaaatcaatgaattttctgactacagactcaacaaatatcatttgtttttaatgataatcagataatttaaatcagataatctaaatcaggtaatttagaaatatctgatttctaaactagtcctggactacacttacaaagaaacagcactgctatagagaaaggatgaagacataaattggagacaggaaacaggaccagattcagaacactattcctgcatatgagatttaaagaaatatacatacataattttacaactcctacaaagcctaattttatttgtaaaatataccagggtatcttagcaagtttctttggaaccacgcaactaagagtgctttttaattaattgcacatctagcaatccacaaatacgaattaagcaccatgagttggcactgaggagaatttaggtctgttctcccacagagcaagcaatttgcgaaactttgctctaaaacacataaaaaccctggccttagctaccaattttaaggatgttctattctgcaagggttcatcttcattctctccaaaaggatatgagggtcctgctgtatttcaatggaaccagacccccaaggctcagaaatcaatcatttcacaagaaaaaaagggtaagattatatctaaacatttcattagcataaatctgaatgtgtgatatttggtcattttgtcttagtttacaaccacctttgcaagtgataaaatatagattgatggtggggagagggtaggagaagaaaacaccacactcacatcacgggatctaaattccaccagcaggggtgggagctgaactggcctaacctgaatgtatgtacaaaagaattccttccttcctctctccctcccttccctcctccctcctcctccctctctttctaactccctcccttccttcctctccttcccccctccctccctctcttcctccctcctcctccctctcttcctaactccctacctttcttcctccccttccctctcttcttccctcccttccttcctccccatctcctgccctctcttcttccctccctccctccctcccctccttccttttttttcctacctttcctttccatcaacaagcccaggtgatggcagggataccgcatactccacttgtctcttccacggctggggatggctctatcagcacttgccccatttttaggttttacttcccaggtcatcccagatttataatccatgcataatgcaggcacctaagcacttctgggcccctactagaaatccagaggcgaacaaggcccagtgcctgcctgttctcaagtctccatgcaatgggcaccctagcggaaagaacacactctgagattaatctggcattgcaggggacttgcaggacctgttccaggtgcctgacattatctatctagaagaggtctccctttcagcacagttattgcctacatgaaggtggcctctctcaactgcacaggatgtgccattcgccaaggaatactaggcatccctccatcgtccagacagatctcaagtgagatgctcaatccctataagggttggtttcccctcagtggattacaacactcagatcccaactttccactgcacaggataccttgcagccatttggttttgaatgaccttctcttcccctcttcctgaaaatataagtttccttattgaagccaattaaagccaattctgctttaacatattctggagcacttcacagcatgctttaaattaagcaggaacaccctggtctagtggtactgcctccaaggcagtcctcccttcatctccctgcctccagccaataccctgcttctctgtctcctcagtccacctctgcctgctctgtccctggtttcctccacctagaaaagtgcatccaactgattttaagtacctctgacttaggggtaccacactgtgaaacctctgcttctatttcctcttctataccttgcattgcaagaaaatctaggctttttattcattttttagaaaaattagggaagtcacagcctaggtagttactagaagaaacaggcaaggccaagaaaaatagccaactcacatagagctcttcttaggtgcctagcatggtcttaagtgctttatagatactgaccattaaacctcaccacagtcctatgatgtagatattattagtgtgcccattttacagatcatgagcatgaagcccaaagaggctaattagcttgcctgggatcatcctctcttttttcttttttctgagatgggtctcactctgttgctcaagctggagtgtagtggcgtgatcatagcccactgtagccttcacctctcagtctcaagcgatcctcctacctcagcctcttgagtagctgggaccataggcatgccaccatgcccaagtagagatgggggtctccctatgttgcccaggctggtcccgaactcctaggctcaagcaatgcccccacctcagcctcccgaagtgctgggagattacaggagtgagccaccatgcctggcccatcctcttaataaatggtagggctgagatttgaacctaggggcctgactcaggagtgagtactgcttaccaggaagggaatgtggtcagcatgacaacaaaggcatctctgtcctccttaaatgcagcaccaactctgtaaacacacagcaggagctctagatacaccacgtttgtacacatttactgagtctacatttccatgtcaccttcaggaagagtggattggcttgggtgaggagaaggaagaagagcggagacttccgcccttgagagattctattttaatttttaagaaaacactgaacagaccaagccctggatttcaagatcagttttcgaggtctccagacatgaggcagtcatctgaaaaggaagacatgacagaggagtctgacctctgtgtggcctccttgctctccctgcactgccttcagatctcccagtgaataggaaaggaggggagacctgcatctgtggggcgagcatcccctaatcctgataggcttcaaaaggttgcgaaaggggccacattctctagtactaagacaatggcattaaatctaaatttcttgataaccaaactaaggcataaaggccagttaactatgtctagttctaatataacactctggaacatgccctgtgttatcttagcctagcttcctagaaatactgaatcgcaatattccacaatgcaagttcctcccactaaaggcctctttggagaaaggagttggctgtgacaaaggctgtagtatatagaggatgatcgttatggtggtgatgacaacagtgctgatagattagacaatagcaacaatgaccatgagggcaacgaagaccatgagttgtgcaacatctaatacaggtcaggggtgaatacttttgtgctgactgcttttcaagcattattatgttatatcttcacaacaatgatgagaggtgggtatcagcacaatgccccctttgaagatgaggaggagttagatgagaaaggccaagtctctggggcaagttgccataatttgggtcataacatgaacccaggccaatctgactccaaaatttcacattcttatccactgctcatctctctcttcctattagaaaaccttattatagaaagttctaaaaacgatatgctgattagtcaaattttctggtaaatacatagtaatcagttccaaatactcaattgaaaaaaattgccaaaatgttcatggtccccagtcctgccttagtaaatatagcacactaaatataaatctagttctactttattaatagacacatgatggactatctcccagctatttgccagaacaatctgttcttattgtagagtatttcagatgtaggtacagcattgagaaggaccatacactcagcccagggcatgctctgaaactacggtattaaacattaaaatctttttaaaaatgtgttttattatttgcctttttcttacaaaacttcagtccaaattatttgggttgataagtagaagtttcactgtagtaaactgtaccaatggctgcctgtggtatgtccagagtgtaagagagttgatgagaaacaacaaaagaaacaaacaaaaacttgaaaatataacaaaacttggcataaaaattaaaatgaccagccccctgatcctaaggaaagtccattttctcataggggcagtcagtatatttttatcttgtggcttaatgtttttgtagacacattaaatcataaaaatccaagaaaccatatctcactcccaaaccacacaatgtattttaaggaatatgtcccttttctaagaaactgcttgattttcaggaagtggtaaagtggcaggtgtgttcccatgatcagccagagaaaccaaataaacgttccactgggcaaacctgtttctcacagataaacagctgcgagctgcacgcgggagggaaaaggatcgtaaagactgcccctatgtctgcctgacactttctggttttctgtttcaattgaaaaggaagatggcagcctacaactgagcagaccctactgtggccaggccaatcccagcccctgcatgggacaggagtttcaaaatcccagcactagacagaaggctgtggtcatctctcctctaggtagacctgggaagggataattaaactaggagttgcaggagaagcagatttcccatgaaaaagacatcatcacacaattaatagctaggcttgataggaaggggaaggaatgtccctttttacttacttccaaggcagcctccaccttgcttctcataccacccatcacattggaaacaatcaccagtctgtatcctcagcagactgtgagctcctggaagtcccctgggcacataacaagcactcaatcaatgagaattattgttattacagtgtgtgttcaagaaatatctgttgagtgagtggaacagaggaaggaatgaaataacttgactttccatttggaaagtgtcttgctaaatccttgctgttagagttcaggagttgggataggatttcctatactgccactttggtttgtcatgttgtaagcagggttaaaggcaaatttttaaaaatatgagacagggctgaactggctttctgtctagaaattctagattaaaataagggtctgtctaggagcggggagccagctggctatttaggaggcttggaggttaaagcgaagtctaaatggagtaagagacactattccaaggggtcccctggtcacacagaaaatacaggggcagcattcagactacccaggagtctgcaggacttggtatgaaagagcaaaaagaaaaaaatatatagacaacctaggaggtctgaggactcacagacactgactggctggggtgggactggcaggagctgctgggaaggctggggcagcttctcagtggtcctggcagtaaatactatccaggaaaagtgtgccttgcagtgagagagctgctgggaaaacggcctggacaatcagactgcagtgctgtgagctagattgcccttcccctagccaagaggtgtctcccaccacccttcccctaagcagcataagagtgaaacggggtggacagctaatgcccactgacctcctgctatggaccacaggcactctcctgcgaaatgcttgtgaggttggtgacatcaacattacactaatgacaaaactgagcctgagaactgcaactcacctgcaatggtacacctgacagcagaaccagaactttcactgaaggcttacctctccagggccaaaagagaacctgtgaccccacaggatcgagcctgccccctcaatgcctgtcagaggcagcctggtgggtgcagaatgtgatagcaagttgctgttggcacggcctgctcttctgacagctctgcaggttatttctcacaactttgctgccagcttctccctgcctgtcgctgacccctgtcccagagccacctccatctggaaacacccaccccccaactctaaagttgtaaccatacatacttaagctagaaaatttaaaaggacaaagcagaaaggaattaagaaaaaaatggagtaacctattattttacagagaaataattttaacattttggattaattccttcacatacttttcttttgagatggagtctcactctgtcacccaggctagagcagtgcagtggcgaaatcttggctcactgcaacctctgtctcctgggttcaggtgattctcgtgcctcagcctccctggtagctgggattacaggagcacaccaccatgcctggctaacttttgtatttttagtagagatggggtttcatcacgttggccaggctggtctcgaacacctggtctcaagtgatccacccaccttgacctcccaaagtcttgagattacaggtgtgagccaccacgtcatgagccccctccagtaattttctatgcatttagatgcagatactgtttgcctgtctttaaaatggtgttgcaccagactaactgtttagaggtccacttccctgctcagctgagcactgacacatgcaacctgccacctgggaggatgggcaggcattcccgaaatgccatcatggctgctgctaaccatcccgggattgcaggcaagtgcggctgatgcagaaggacgttggggaatgcggacatcaggggtttgcaaacttgtgtttctccctccactgcccatcctgccagcctcagaaggttagccatggagggtgggccaatcccaacatactcaaaaatttaaaatcctgaagggttagcattggaagggattttagaggctatccagcccaatcccctcacttgcaaatgaggaaagcagagctgagagagatttagcttgtgctgggttctaacagtggctccttgccaacctcaggctcctcctggtctaccgtctgtgcctggactctgctccagcacccccacccacccacccacctgccccacttggcagagggcagcagccagagaaggcaggcccaggtgggggacaagagtctcaggactcacctttcaaatttaaagaatctctcgttaccatcaccataactcttagcccaaccattcctcttcagatccaaggatatctaagtctgactgtggaattttgttgcggaggattggatacagctgtcaaattccaaaggcatccagtacccatgctctccacagagcagtcccttattatacaagctctgcaccagctgagaaccatgttccagtctcatattgctcagaatctcctctgagcttcacataactcaggcacaatctccctgaatcatatggcataggaaagtcatgagcagtaagacttggttcaagaaaaaataccaagttctgaccactcaaagtacccttaggtgctctcattcatgtgagctttccgtttcctgctctccagccccatttcttatttgggttagggatcccctagggctgctcagtggtagggggccactgaattcaaagcaggccactgtactcgaagtagatggctaggaaaaaaaaaagggccagtcacagtggttcatgcctataatcccagcactttgggaggctgaggcaggcagatcacttgaggtcaggagtttgagaccagcctggccaacatggggaaaccctgtctgtactaaaaatataaaaattaactgggcatggtggtgcatgcctgtagttccagctacgcggaggctgaggcatgagaatcacttgaacccaagaggcagggggtgcagtgagctgagatcacctctgcactccagcctgagtgacagagtgagactccgtcaaaaaataaaataaaatccttccttccttcctccttcccttcctccttcccttcctccttcccttccccctcctcttcccctttcccttcccccttcccttccattcccttcctttcctttcattccctccctccctcccttcttccctccttccttcctatttctgagcacttctttcccaggcacaaggtaaacgagctttcaaatatagcacactgaatacccatgataattctataaaatggatcctattcttcccattttaaagatgaagaccccaaggctcagagcagtgaggtgcagatttactgtgatgctaaggaagaaagtttcagggccctgccagcatggacccctttcaaggccctagcaatatattcttagaatcatgtaatttttaaatgaaatttgcagtagtaagatattttaactgcaattgatgaagagcactgtatctttcaactctgatgtctcctcctgatacatttcccctcatgttcatattgaatggtgttacagtagctataggtgttttgggatccagcataagggaaagttaatttggggataaatttagtttgggtgtagtgggatttatgtctattgttcacagtcacgttaatgcaaagtcaagtgattgttagctgtccccatggcttccagtgctaagctttccacaactcaatggctttgagactcaaaggtgcaatacctggcacctgagacataaaaataggggagaaaaaataggattgaaatatacagagcggtccgggtgcggtggctcacacctgtcatcccagcattttgtgacaccgaggcaggcggatcctctgaggtcgggagttcaagaccagcctgaccaacatggagaaaccctgtctctactaaaaatacaacattagttgggtgtggtggcacatgcctgtaatcctagctactcgagaggctgaagcaggagaattgcttgaacctgggaggcggaggttgtggtgagctgagatcgcgccattgcactccagcctgggcaacaagagtgaaactccatttcaaaaaaaaaaaaaaaaaaaaaaaaaagaaggaaaagaaaagaaaaaagaactatacagagccagaagctagagcatagaactttcttccagtctttggacatgtggaattgaaggaaaatttagttttcactgatgcctattcgaaaaagaaagttttctcctatcagaaatgtatttgataatataatgaatacagttataaatataccagacattttccccctttttggtgggaattacacaaaatatattttatcaaaattcctgtattgtaggacccaaacctatggcagtaaaacaaaaaaaagtggatgtctgtgtctgaagccatgttttatgcaatgtaactatcaataataaaaaataaatattgtcagtcatgctagaagaaaagctaaattttctttgcaacctccctttagaaaaattacaaaatcactatcatatgaagaggtgatcaaagtgtattcagccaaaatatattcagggaaaaaagtattatggaggtttcacaggcaaataataaaaatattttgttatttttctggattttataaagtttgtgatacatgtcaggttttaaaaacgtatattgaatgtgatttattttcttattctaaataaatattcaccatggtacctaattttgtatttgtaattttatattctttttcttaaagaggtcccccagttgcttaaacttcaagccctacaaaatctcaacccatccctggaggtgaaataactttcccagccaggaagtggcagacccaggactagagaacttggtccctgactttgggatcccctgaacttcacacatttgtgcccagtcatccatagggcagcctgggctacaagggtcagggtgctagtggagaaggtcaaaggatgatgaatttgtaaactggataccatcactgcagccagcacatgtggcttctacctcacctgagcagacagcaagaggttttctgaagacctgagtatgcaactgacaaatcccgactctgttaaaaccaagtgcccagattaaagataaatagccccaaatccccaaacaatataattgaatctggtttgattcttctgggtgtcacattccctaaacttgcactgtccaaaatggtggtcctggccacatgcggctatttaaattaataaaaatgaaatgaaataaaaaatccagtccttcagttgcagtaaccacgttttaaatacttaatagccacatgtggccagtggtttctgagtcagacagtggagatatagaatgctcccatcacacccccaccccaggctctactgttaagcccagctgaacttttttttttttttttttttgagactgagtctctgtcgcccaggctggagtgcagtggcgtgatctcagctcactgcaagctccgcctcctgggttcacgccattctcctgcctcagcctctcaagtagctgggactacaggcacccaccaccacgcccggctaatttttttttttttttttttttttgtatttttagtagagatggggtttcaacatgttagccaggatggtctcaatctcctgacttcgtaatctgcccaccttggcctcccaaagtgctcggattacaggcatgagccaccacgcccggcctagcccagctgattttaaacagtctttactaagacatatctaagcccttcttctcaagaagagtgtttgcaggtgagtgtggccgatatgtgaggagagaggagaaggaggagaaaggaaggcctatccagagagaagagagggacagcccagctgagaaggggccaaagagggggaaaaaggaaatagaacctaaagtgactgaggtgttaggccttgtagagaataagggcatcatcagatgtgagccaaggaaatgattcagatcacacctgacagaataaggaggataaattagctccagaatcagttatcacatacctcatgtaccccccaacatacacaccatatacctcacaccccccacacacataccacacacacacatgccccccacaccacatacctcacacatgcgcacccccacatacctcatacacataccaaacacacacacaccacatacctcacacatataccacacacacatgcccccataccacatacctcacacacacaccacatacctcacacacataccccacacacgtacaccatatacctcacacaccacatgccacatacacacacaaagaccacacatgccacacacacacacaaagaccacacatgccacacacacaccacataccacatacacacaccacatacctcacacgctacacacacacacacacaccacacaacacatacaccacacacaccacacatacgccacatacctcacacaccaaacacacacaagcaccacacacacaccccccacatacctcacacatcacacacacctccatatacctcacaaacacacatatctcacacacacacacaccacatacaccacacaccccacacctcacacagtcccaccccacatcccctgctacacacaaactcacacactttaaagtgtgctttgcattccaagtctttgctgggaaaccttagttgcagctttacgtggctggaatatcaaaaggcaggagttgtggagtcactgacaataacatcatccaccttctcaatgtccccgacactgccacctcattacccaaaagccactgccattccagacctacgcagagtctgaagggcagcacccccttctccttgggactggagggacaccttgcctcaactctcctgcagggcctgaggttaaactctcctgtattccaccatcaaaggacagcatgggggactctagcccttttaatgggctgccaagagcaaaaattcacgcattctagagtatgaaagcccggcagggtgggccttcatttcccatatgttagtgtgtatcgatggagagggtagggagccctgtggggaatgagggcacccattgtcccctgcagagcagttgtggatggagctcctgtaggaataacggactctgattaccacggtgacactcccaaggtgatggctctggatagggtttgcagtctcctttatactcatcactcccatctaatcctcacaagaaccctgctccccacttaatgaacaaagaagcaggcctagaaaggcaagtggcttgcccggaattaacaataatagtttaaccataataacattgccccatctgctcaccatccaatgaacaactcaagtgacagcacagtggttaagagaacagattctgaaacagatgtacctggttcaaatcctggctcggccaatgactagctttgtgccactgggcatgtgattcaattaccctgtgcctcagtttccttgtctgtaaaatggggatgatgatagtccctacctcatgggttgctgtgtggtttaaataaattttcacatgtaaattacttagaaccaagcctggaatgctcagtcagcactccttaagtgctggctgctttggtgcaggctctgagcacagagacaaccaaacatagcacctgcctccaaggtacttacagcctaaagggagaaacagaaaagtgaacaagagctagggtagaaaagatgctcggggcacaaatgagggacctggaatccaggaagggcctgattcctgggccaagtgacaactgggttgagttctgaagagccacagtacaggcactgtgacagcccttatttatgttttccagcttttattgtagattcatgtgcaggtttgttacctgggattattgtgtgatgctgaggtttgggagatgaatgatccatggccctttttatatagtttgtcatttaatccttggaccattttacaaatgaggagcctgaggctcagagaagttaagcagcttcccccggaaaaccaacttggtaagtggtggagctgggattcaagcccacatttgtctgattccagaatcttactccaagtctgggcaaggcgtgggctggccaggcagctgcctgaagggcaattgtctataaccctggggtcagggggatgagaaatgtgaggcctgttaacccaggtctctgggcaagcttccttatataacctgcacattgtcaacgctccactcaggcagctctcccattccttactacataattattagataatgcataagggagaggtttgaatgactagcctgcctgggaggctgcctctctacggtcctgcttccaccacacgggagccctgaaacgagcaggccagctggagaggtggccaacacattcctcacccagaggctccgggctccccagatggccactgccacctgaccacacagagtcactttgccagaaggactgccctgctttaggcctgatctgatctttttccaggaaactcgtctggtgtaagatttatgtgtccaaacttgccagccttcccctttcaccctggactaacagggacaagaattctaatcaatgtgcaggaacacagaaaaaaaacagggaaacagcaggcaggcccaaccccaaaagccccaaacttatttcccaattttgggttgcacatgtatttctactcacataagacagtttgcatccaactggggggaattttgagtttcaattaaactttgctaaaatacaaaactcatttccccttaactgtgcttcctgacaatgaagtggtggtgtcacggggcagaagggctgatggtgtgggttaccacagcaaggtccatgctgcaaagacgggctgcccctcctgctctgggagtcaacgcttcctgggtccaccaggcccagcatttccacaggctgtcatcggtgtgtccccagcacagcacctagctagatctcagcaaatgatttgaatgtgtggggctccctccaggtaagaaaggaacccctgctcacggcactccccagaagtccttggtaactcactttctctttctgttctgaacatccattcgggctggtttaaagcacagctcgctcaagaggcagccctccagaggagatcggggttaattacgtttactgacagctgtcttctttctcctacagtcacttcttcccatgtcctgatttcattgcttgtgaaaagagatggccttccaatgggaaaaggcaaggagtaaaactcacgagagaaagcgtcctggagattttaaggagaaaggcacatcggttctgccagcacaagagctgcctgtttccctatcagatatcaacactcatttagtgcaagggtgaatatcacctttctattgaaaagaaatagagtaccctaggaaaatagcttgcatcaaaacaagagaaaagtaggttctgaaccagaactaaaatatttggacaccgaagctgtgactactgatgcaaagccattaacccataaaaacaaacattcaaacaagacactgcatagctctctttaaatgagtccaaacaccagagctttatcttaaaacaaataaacaacaacaacaaaaaattcctttccccatcccatctccacccacccactaggagtaaaacatattgctagctctgagacttttctaagaacttggtcagagacactgagcggctggtcaatatatttcttacaaatggggctttgagagcggaactagcagctgggtgccaagaacacagtggctctgctcacatctcacatatgcccagacgctctgaaccacagcctaccactgctgccacaggttcaagttctgaaacccaaagagagcacagagaaggcaggaagagaagaaaaaaagacccagatgttgcaaatcagaataagtgctgagtgaggcagtatcatgacatggcaacgataaatgttgaacgttggctctcctcttgtcagctgacccctctgctctgggacccttcacactgtgactccagttaaatcaaccagctgtgcctccaagaaaggcagcatgggtcagtgtggctgcctggactctgctgctgacagctgcagagagaaactcaaaccagccacatagcctggcccaccttatagtctgaacgtgcccagccaaaaagaagaaaagaaaacagctcaaaaaacagcaaaggctgggtacggtggctcatgcctgtaatcccagaactttgggaggttgaggcgagcagattgcttgagctcaggagttcaagaccagccagggcaacatggtgaaaccctatctctaaaaaaaaaaatgcaaaaattagctaggggtggtggcacacatctgtagtcccagctactcgggaggctgaggcaggaggacagctagtgcccgcaaggttgaggctgtagcgagccatgttcgtgcaactgcactctagcgtgggtgacaaagcaagatctcgtctcaaaaaaaaaaaaaaaaaaaacagaaaagcaaaaaacccacagctgagaagcctctggctcaaacccacatacagaagcttgtcggctgctgtgtgtacacataccagccaccatgatcctggccttctctgaccattggtctgtaaggaaataaggtgataagtgggaactgggctctgaaccctggaactgagaagtcaggctgctgcaaaactctccaggatattaatccctctctctgcccagtggttttcaactgggggcagtttagcccccctagggaacactcatcaatgtctgaagacatttttggttgtcacatctgggggtcagggggttgctatcgctacctagtgggccctggtagaggccaggtttgctactatacctcctacaatgcccaggacagctctcacaacaaggaatcatctggcccaaaatgtcaatggtgccaaggctgagaaaccctgctctagagcctaagagtgctgggctcaaattctaacatcactgctgactagcccaggggcctttgtataacttacttcacctgtcagagcctcaggtttatatatatgtgtgtgtgtatgtgtttgtgtgtgtgtatatagatatacatatatatttatattcatatatacatatttttatatattatatatttatatattaaatatgcatatttatatataatacattatataacatataatatatattatatatgaatatgaaaaaattatatattatatattatatatgaatatgcatatataatatttattttttatatatatatatataaattgtctttctgagacgaagtctcactctgttgcacaggccagagtgcagtggcatgatctcagctcactgcaacctccacctactgggttcaagtgattctcctgcctcaacctcctgagtagctaggattacagacactcgccaccacaccaagtgcagggattacaggcatgagccaccatgcccagcctattttatatatttaacaaaacttatgtagcagtttctaagtaccaggcactattcaaagcagttcatacatattaactcatttaatcttcctaatcaccctatgctgtagtgttaacctgacctccccactttacagatgagaaaactgaggtgaagggaaattaagtaaattgtccaagatgacccagctagtaagaggaggacacaggattcacattcagcaatctggagccacaacctacactcttccattagctcactcacagggctgccttacagatcaaagtttacatttattatctaccttagtctctcctatcaaggtgtgcagcaaatgtggcttctcaaccttcattccatgttaaccttatactgtttacattacccttgaacactgagaccaaggatctcaccacttgctttttctattttccttccatcacccagaatggcaaacattcaaacatttccactcccgaaacatgcagcaacgccagaatgtttatccagaaattcaaaatgagctctagtgaggctggcatgaatatactctaacacaatgttttcaaatatcgtggctcaacaacaatgaccagtgctaaggttgctgcgaatgacatcttaggcctgaaattgctctctgctgtaacccagcactgaaggtgactctggcctttgcatgctggctttgaaaggtcccaagtctgtctacttggaaataaattaaaatgttgtctatatttaacagataaccaggccttactaagcaatctaaaacacatactctagaagcacgctgcaagagctcccttcctggccactttgcagaagagaaactaaccttgcgcagcaagtcaggaccctcccccacaaccaccccccagaaaacacaacagtctcacaagttttagtatggtcgcgtctgtaagcaaaagtaaggaagtcataagataagccccacgctggaaaacttgatccttttatgaaaggatggacaggctcactgattcaggtgagaaagaagcccaagtcctgagaggtgcagctgctgaagaccagggtggccccaagcaggctatgtgcaggctcccctgtcctctacctctcagtgaaggatgtccaggagatcccactcctttccccatgaacccagttcccttccatctgcccactttggtctccctgcacataaactcatctccccctacacactccacgtggtctggccccagccttcattccacccattttagtagactgcttccacaatgggctgttcagatccagggggtccaatgttcatatcagggcttcaaatgacctaacattaccagaggcaaaggtgcttaggttaaccaaaaagcaggaccagactgttggcaacccagtgtgctaatgcaggccacccaggccaatcagaagtactgaccagagaaaggcacatttcagactaaataaatatttatcttttttgaaattacttaaagattgcaatttgtttagaggtgtaactggaccccccgcaggcccaagggaaggctgttctagctaacggtaaggagaggagtagaaggcaaggtggaggagggccttctgaggcaggaagtgaggcatcaggacagggtgtggctgggaacatcccccaggaacacatcaagtgactgataaacatttatttgctttatattaggagaatgagaacacggcctatagaaaactgggagtgctaagggcaaagaaacggcttaaagacagagagactatgtttgagcaaagtgagaaaggccattcattggtaccctcagttattaaaataatatataattcaccgctaatcacggcactgcccggatgaatattaattgaatattatatacaacatattacacactgagtgactcatagttacttctaatgaatatcaatatattttgacacatttaacaacgtggagtggtggagggggtacttctagagccaggcttcctaggtgcgattcccagctctgccacttactagctctgtgacatgtggcgaatccctggacctttctatgcagcagttttccactctgtaaaatgggaataaaaacaatgtctaccacaaagtaaaactctcaatacatagtagcttttgttttttaaaaagcttcaggattcaagttgatgagtgaaatgtatgggcatcaaccagattatgagcattcctcttcttcagaagttagtgctgaattatctggtccttccttaaccactgtgaacttgcgtggtgtccaaagacagaacctttcctgtcaacacatgtggaggcaactgcattaggtgcccggcccactgcttttctgactgccacttggccagagctgaaattctactcaagtctgtgagtgaggcccagctcctttccaagttccttgtaatcccactcaaaaaggcatgctttttacttttcttttctttttttttttttttgagacggagtgtcactctgtggcccaggctagagtgcaatggtgcgatctcgggtcaccgcaacctctgcctcccgggttcaagcgattctcctgcctcagcctcctgagtagctgagaccacaagtgcgtgccaccacacccggctaattttttgtatttttagtagagatagggtttcaccatggtagccaggatagtctcaatctcctgacctcgtgatctgccttccttggtctcccaaagtgctaggattacagttgtgagccactgcgcctggccaaggcatgctttttaatgaactccagttctcctgtctcaaagaggtctatcacatggtctttggaaagaagtggtccctgctgtgacagaggatcctgacagcagtcatggagcgctcgttaaagaaaaaaatgattcaatggcgcttgctaacgaactatagggcaagctttatttagggaaaccaccaagattggtgtagggaccaccacagtggtgttttgcagtcagggagagagattgggatcaactccaaatacaaggaaaagtgggaatgcatagccaacgagaatggtgaaggtcagtggatggaaaattactgcagaaacatcagaggtaaggggggattctggctaaattggcctaacaggattcttgctgaaggcaggcaggttgaacagacatcacctggggcacggtagaggatgatgctatggtctgaatgttggtgtccccctaaaattcttatgttggaacctaataccagtgtgatagaatgaagaggtggagcctataggaagtgatgaggtcatgagggctgggattagtgtcctcataaaaaaggttgaagaaagcgtccctacccctccaccatctgaggacacgtagaaggcatcttttctgaagaacaggccctcgtcaacactgaatctgctggtgccttgaccttggactgcccagccgccagaatagtgagcagtacataaattacccattctaaggtattttgctatagcagcaggaacagcgtaagacagatgaggaacccaatcagatatcaagggtgatcagatattgaggatggaggattctgtctaaactggattcgtgctacagttggacagagacaaacacagaagctcaaaagttgacccctagttgaaaaaaatctcagaagagcctaacgtgtggtcatggagagaatctttgtcaggccccagatcaaggacagcatgtggtgggtgagatccacactcttagggagaggagatgctttgaatgacctaattctttattgctgggagaaggaggacccagggtagaaggaaagacctgagagagagggagagagagagagagagagagagagagagagagagagagagaggtgctgggagaaggaggacccagggtggagggaaagggcagaccagagcctcagagcctgccatccccactggcatcattttgctctcacagggcccctgcactctgcacaataaaggagttgtttaacctcccagcatcctgggggcaggaaatattggtttcatctatttgttgtttgtttcagtcttggtgcatcttggaaccaaagttctcactgtatggacacaaaactaatttaggttcttttaatccaacataagaaaaacttagtttcctctagccaccatcaatcaacacaaagccaacagggcggaagggagggcccttgcttcctggcagtctccctggagggggagggggcaggaagtgatctagaatccagtctcagaagaactgctgacaacaccctcaccaaaacgcatcatcatcttgcactcatctctaagtagtgcctcccacagcctaagagcaaaggctcataacttctatccacagggtttctgccatttaccattacctccctgtcctggctcaggcaaggaccctcagggctgagatgcatcttcaggtcagcctgcccacatgtaaacagatgatacatgcacacgtgcgtgcacacacacccacctctgcatgctggagatacacaggacgtggaataagtcctctctgagaatttacgaaggcacctggctgccatcagcacagagtcatcctctgtctgagttctgaaggtagcagtgtctctgcaggtaggaagagagacaaatggagcttccttccagctgaagcaagtagaggctttgttttctctctagagggttgtaagaatttattgttttggagaaataacataaaatctaagagcgctggttcccaggctagaagacagaccagatctattcattcagcaagcattaaaaattcactgcttaattaatacaccaattgctccctccttgcaaagaggaagaacagttcagccccatgggctggcatctttgccactgaggtctgcacaagatgcggatggtgaacacatgctacggccattttggatgtttccttgtagcatcaatgaggaaagaaaacaaaactgttaaaaataaaacctctgccactatatcctgaattatatcagcaagctcctttttaacaagatgttatgtccaggaaatgtatccatttactgattgttcctgaagaaataacttgttcactaggaaataacttaaaccagaaatgtgggctctcatctgatgtggtttatgcatctctaggtgttttcagtgtctcttgtctatttaatggactcccagaagagtaggatgtctacctaaaaagaaaaattaacgtttatactctcctgatgatgtttatgtggaagaaaacaaacatttgtcaaatgtctgttttttattttatttatttatttatttagagatggagtttcgttcttgttgcccaggctggagtgcaatggtgcaatctcggctcactgcagcctctgctgcccgggtttaagcaattctcctgcctcagcctcccgagtagctgggattacaagtgcccgccactaggtccagctaattttttgtgtttttagtagagacggggtttcaccacgttggccgggctggtcttgaactcctgatgtcagctgattgtcactcatccattatacatcatttaatctgccatgagcttaataagcattatagagtctaatcacctaatgagcacgctcatgaaagtgtcaccttcattgaatcatttaactctcctagtagctctatgaagtactattattaccccccagcttataagataggaaactgaggctctgagaataatctgcccaagatcctgtaagtagtaggtctagaattcaagcccagcctgatctttctccaaatctacattattgtccctgaaccaaaacattctcaggccatgatcttctcccctgtcagcagaatctggagcatctcagggttcatgttgaattacaaagccctgccctaaagcagatttattggaagtccagtgcttgtgagagttattctgaagggaaaaaaaaataaaatacatatatatatctcagaaagccttctctgcccaggccaatgcagccagctccctgcttaagaatagctgcccatgggcagggtttcctggccagcaattcaagatgtgcctgtgccggctttactctttaatctcagtttcctcacctttaaagtgggtcccacaagccctgtcctacagggctgctataaggatttaatgtgatgagaatcctaacatagctaacaaagtgcctggtactgggtggtcagtaaatgacagttattgctgctattacttggtagactcccaaaagttattctcacatccagtggagggaagaggagggagcaatcctcccttgggggtagagtattttgcatcaacaggttttagaatttttggtgcaaggtgagagtcaaaatctaacagacttcgtttattatattattgcttttacgttctcttcagacaacgtacccccttattgcctctccctgggctgggcctctctatcccttccctctccccactccctgtgctcccacctagatctcttccaaatttcccagtagagagggaatagagaggcagtggtggtatctttcaccccacatcccagtggtgatcacagcacttcagggaaaaagaaagcagccttcacacatatgggcctccctaaaaagcttcccaggaaaaaggaaatgtgtgtggaaaggccataactgggaatgaatcatctgttaggaaggctgaaggagagggagaaaggggagtggccggaggtgaggctggagaagtaggcagggcccatcgcctggggtggtgcataccttgggaagaattttcaattatctttagttcagcaagaaattacagacatgattagggcccatgcaaacattctggaagggtcaaggcaggatgtgggggaccggtgaggaatctcctgcagcagtcaagcaatggtggcctggagagggagtggacgtcaggatggataagtggatggattcatgcactcgtccttaggaggaggaatgcacaggacttggtgacagcttaagtgtaacaggtggtggagaggagagggtgaagtccggcttctggcccaagcagcttgggggacagtggtgccccttcctaagacagggtgcatctgaagaggagagactcacaggctgaggaaggggctggggtgtgggttggtcatgcatgtgggaaggtgctgagccgagttatgcgtgtgttgagtcatctaagtggagatgctaagaagggggctgcatttacaatcagttcttccaaagaggggtccagatgagatgcatggaaactaacaccaggggacgtgacaccttcacctaggggaagactacattgtaagaagagaaatcctcagacagagtctagggagctgcgatcctcaatagccaagcagaggggtggtggaggcagcagagaaggctatgcaggagaagcctgaaaagcagagagaaaaccaggagaggctggtgcctcagaagcccagggaagaaaacaagatgcagagttttaaacttcacaaaatgccactcagagggcaagaaagacaaagttaggacaatgtcactggcatttattaagacgcaggtcagaggtgctcttttcaggagcaggtgtggctgggcatgcaagggctgaagcggaggagggaggtgacaccatgcacacagcccaggaggctgcctcactcacaccccacttgcttagccccactcacttagcctatttccttcacagccattatcttaatgtgtgctgtcttgcttctttgtttacttgtgaattgccttcttcccttaaggtctgttagggcgagctccttgtctgctctattcacagctgtaccccagcacctaggaggatgcttgacacagaacagggattcaatacctgttgggtattgaatgaatgaaacagaagcagagtaaagtctggctaagaagtgaggagggggagagctgcaaagcccagaaactacccacaagaatgagccagtggtgaggaggaggggtgggttactgtccctgggaagtgggacccccagtttaagtggaggcttagggcagaatcctggacactaaaaggaatgcttaaaagggaatttgaggcattttctggtctgaaagacatccggcccacattgctttcacttaggtcatgttcccccaaaggaaatcctgagataaggattcctagatgagtgattcattgaagaaatgtccccagagtggtcggtaggagagtggagaagcaggacagaaaggggagaggccaagccaagcatgacctcaggccacatcccagcctcagcctgaccccagggagggtcctggaatgtaaaccgaacctcctgcaagtttgtacacccccaccccccactgccagggcaaggtggctgacctttcatattcccaccctaattaatattggctacagactgtcatggccaggacagaaactcccagccactccaactctcttggcaagagggtaatcctttgaagaaggcgatggggcaaagctttagaaacagaggctacagaagctgcaggatgggcacacagaagtggccgaagtgatccaacgccatctgagcagagcgccggcaatgtctgctactaaattgggatagagttttttatggattaccctggaagagcacaccaaacaaaccacttcattctgagggcctggacggtgcagggatagctaccatttagaatcgtttcagtttctattccggtaaagaatccttcaaagaaagacatcgaggctcttacagtgcagagaggtgctcttcttggacaactatagggtgtgaacgtagcacagctactaaaagtgaatgtgacacaacaattaagagagtatggtgagtatttagaaatacttagaagtcaaagcataaaaaactggataacttgggttacattcctgagacatgtttattattatcacagtactgtgatattgtagaatctggagaaataaaatcaattgaaataaaataaaatacatctaccaactaccatttactgaacacctgctatggatccaactctgtgctagaaatgaagcagcatctcccttgctcaaagctgattttcaggctgggaactagatggggctcctgaagcaattcaagaacaaggcaaaaacagatctatggaggtcacataggatgatgattaagagttgagccaggctcagcaactgcctaggatcactcccatttctgctgccagactctctgtgcctcagtttccccatctgaaaaattgagatactaagagtctttacttcacaagattcctgtgaaggtaacaggaggtgatgtgtgcaaggtccttagtatggtgctgatgaatgcagtgagcactgaggccttgttattctgcaattattactggaggtgaggctagaaaagaccacacttgcccgacttgtcctacctttctctcctcaggagggaccaagacatttatgcctggttatgaggtgacattagaaaagaaatcaaaaagcatctgtccttgtttcttgaagccagatgcaaccaagctaagcctgaaccaagagttgatgggcagctgggtggtgtgctcctctgttgagctggccaggagctaaggctgatggctttctgtccagggagccgtttagactcagagtacacacatgcttgcctcttaaaagagtattgggtcagcaaggatgcactgggaaagccatcagcatctttgcatccctactgaccatttcctgcccagcacactggagccagtgctgaccattttcctttttttttctttttttttttttttgagacagtctctttctgtcacccaggctagagtgcagtgatacaatcttggctcactgcagccacctcctgggttcaagtgactctcatgcctcagcctcctgagtagctgggattacaggcatgtgccaccatgcccagctaatttttacatttttagtagagatggggtattgctacgttgcccaggctaatctcgaactcatggcctcaagtgatctgcctacctcggcctcccaaagtcttgggattacaggcctgagccaccgtgcctggtcctgaccattttctgattggcagcagcaggagggccccagggtcaaacaatgcagtcacacaggcctgtgctttaactgtgcctccccacacagcttggtgaccccgggccagtgactttgacctctgaagcctcaattcccttgactgtaaaagaggtcctgaccttggctgcacattaaaatcactgggggagtgtttaaaagtccaaatacccagggcttgcccagaccaacaaaatcagaaccccctgatgagacctactgctgtaaggtaaaatggtcatcttctactcccagaagtggaattaagggagactatccatggaaggtgcttaccgccatgctttacacagagtgcgccgtaaaaggaggccgtgatatggtaccatttggagttcccagactctagaaacacctcccacaggcccacagaggattgtacttgaaacttcattcattgtactttatgccccactttggtgagtatcaaagatcaattgtgcattttgatttctctagttcttttgatcaccctggtccacaatcatgttattcttcaagagagaaaatggccagacccaggaagtgcttctctggattaagggctgtgaggttaaatctttgtttccatctctgccctcaaggacctccaatcccccatcctaataagagagctgccatccacaagggtccttggcccttggcttgcagaagcgggatgagcatctacaaccctggctgtgatgaaggctgccctgacagttacattcttgatagagttgcaggacaaatatttctgaacctgtggttcctttgccgtgtctctagtcaacatagggcttttagccctgtggaacatgaagatttttgtgaactagggtataaggatttaagagtgtaggtggggcctctctaggccctgcttcctacatagttgatgtgtctggacccacaactgagagaaggaacaaagcaaacaggtgggatcccttatagtttatagttatgtttttcagagtaacagacattcagggaaacagaaacagaactttagctcaagcagcaggagggggcagccagcatctgagctggaagaagagctagcaggtgacaaaggaaacaagcactctccatgcagtgttaaggcagtgcttatcatccagtgggaactggggtgccagggtgccaggcaacagagcagttgatggagacagttccagtgccattatgagctgttaaaaggggatctgacgtgtgcattccagaccctgatactacttcttgtccagtcattcaacaacatagtattccctataggcccagcatgtctgtctatgtatctgatttcacaatcccatgacataggtactgttatcctcactttgcagctgaggagactgaggcacatagaggttaagtaacttgtccaagatcacacagttagtatatgacagagttgggatttgaaccctgtgctcttaatttctatgccaaattgtctctagcttagtgagggtgtcaaacaggtcaacagacaattagaatatagtacagtctaagtgactgctagggactagcacaggtggtggcatccaaaatcccattcttatctgatgctcactcataggaagaaaaacagaagtacccacctggtgacaggctagcaggcacaaggatagacagaatgtgcacctgaaggagttcacctaggagagctgaggaggcacaaagacctgcatgtgagtgttcgtggcagcttcatttacaatagcccaaatctggaaacaatccaaatttctatcaacaggtggatggataaaaaatctgtggtggccaggcgcggtggctcacgcctgtaatcccagcactttaggaggccaaggcaggtggatcatgaggtcaggagtttgagaccagcctgaccaacatggtgaaaccccgtctctactaaaaataggaaaaatcagccaagcgtggtggcatgcacctgtagtccctgtaactcaggaggctgagacaggagaatcacttgaacctgggaggtggaggttgcagtgagctgagatcgcaccactgcactccagcctgggcaacacagcaagactctgtctgaaaaaaaaaaaatcctgtggcatatccagacaatggaataccattcagccacacaaataatgaattgctgatctacacaacatggatgaatctcaaaagcaccatgctaagagaaagaagccagaagcaaaaagggtgcatattttatgattttagctatatgaaattctaggaaaggcaaaactctggttttagaaaacagagttttgcaaggggatgggggtaggagggacgaactaagtgtgacaggcatgaagaaactttacgggatgacgggaatgttctatattttgatggtggtgatggctacactggtgcagatacttgtcaaactcattaaattgtacacttcaaaaggtgaattttattacatgtaaattatactcaatttagaaaatattttaacaagagacttgatgtcatgcagtcaaaagtgaactgtgctatgctctgaagctaacggtgagagttacatacgttctgcttcctttgttttttgttccttgttctttctttccccctttccttttttttttttttctctctctctctctccctcctttctgtctctcctcaaagtctaccacctccttttccaagccaagcctaggtgacaggcccctgagctgcaagtgtttccagcactgccattacaaattagtggaaatgatcagacccccaggcagactggttctcagcctgcttcagaggggcagatgttctgcaaaaccagccagtgacccacagagaagactggcaagcccgcaaggctctcattggacccctctgtggcttctgcctcccaggtagaaagcatgcatatattagatttaaaaagaggaagtgcctttccaaaaactactcggctttgggagggatagaggtcatttgtctttgtccaagaaaaacatgttccttccttgtaatccttgataacccctgaattgttttctccaagatagttagggacaggggtaggggagaggggctacagtaaaagagaaaaggaggtagagaggacagaggaagccaatgccctactactctgcggtagcagcaaggtgagctcttaccaccttgaactctgggaaagatggtaaaagagggaacccttcaccaaccagtgcccacatgactacctaagacagcacccatatgaggtgcaaccatatgaaggttcacttctcgctggatgagaagtgaacagagaggttaacagggcaaagaagcagcagtaatgggaaaagaacgtgagactggcacggttccctcccctgggcctgcgggaggcccatggcagccagaatgtccatctgctgtgccccaccactagtaggctcacaggaagggaagagaacaatgacaacccaactgtcccttgcgcagaagttacaccaagaagtgagcagcaggacccgctggcctggcagtaaaccacatcagagttatcagtcggaaacctcttggacaaagagagtttataaagtcccttggccaagaggcatggaagttgagttcagccaagcgcaactcagacacatgggcaatggaaggggagctggggatgccagctgccatccaagtcctgtttgttggaaattgagagagatagtattggagaactagatgctttcactttatttctccaaaagagagctggtctccaggtggtgaagcctataattctataaaaactggagattggagagataggagggtacaactctggcccaagacagaaataagcaaaaacaaaacaaaacaaaacaaaaaaataggcatccataagagaaaaaagtgagtggttctgggcatctagtaagtggaagaggaaagagaccatctctaatcctaactcactctgttccaggtttggaataaaagctgtatcgggagaaataacctgttaaagtagaattgtcaatgtgtagaactgaaaatcggccaaaaatccatcagctttctcaatttactaagaaagaataattaactccctagtacctgatatacttttgcatttaaaggctaaactacctatatctactcaatatcattcacttctagtaagactcttattggcaggtttaaagcacccctacccaacccactagcaccaacttgtcttttatcttagcctggaaagaacatgtatgggttacattactaagaacatagtatcattgaatgaatcattaaatagaccagtcactgtaataaatacatgtggatatatacattctgttaatagacttggcatagtctttcatggtttcaagtgttaaggtttattgtggtattaaagaaaaccttatagactttcattttctgaacgatagtggattcaatatatagccaactctactgaaaacactaagcaaactggatactatagaaaaactcttttgaaatgactgatgagctggcaagttagtaagacgtattcagtgagcaaaaactaagcaaaatctgaagcctagtataagagccaatccctgaagctagcttgaagacaatagccaacaaagtgaccttcacttttatcttttgtggcctcacgggaagaggagacaggataagaatttcccataacataaaggatactatcacatggatccaggaactccaatgaataccaagtatgagaaataaaaataaatatatacctagatacgctttgtgaaactatagaacaccaaacaatttaaaggaaccagaaggaaaacacagattattctcaaaggagacactcttgtctgtagacaagacagtagattttagaggcaacaatggaaacagaggacagttgaataatatcttcattgtgttggagagaaaataactggcaacctagaattctaccctaattctacccagtaaaaacctctctcaaaaacaaggggaaaaatagtgtatttgcaagcaaacaaaatcaagaagttgtcaccaacagaccctcaataaagaaaattctaaaagctgtacttcaggctctattggaaaataccaaaatgaagttggtagacctacattaatattaatcagaatagacttaaagactaaaagaattactaaggaaacaagttttgcttaattataaaagattcaattcaccagaaagataaaacaattcaaacctataggtacctaataacaaaggctcaaaatatataaaacacaaactgacagaccataagaagaaacagaaaaatctacgatcatagtgggagattataatacttctctcagtaactgattgaacaagcatacaaacatcagtaatgatataaaagacttggacaacacagtgaagaagcttgatctgatagagttacatagaacactgcatctaacaatggtaggatccacagaacattatgaaaagtgaccacataccaagccttacagtaagcttcaataaatttaaaaggctgggtagcactcaaacaatatttgacaaccatgaggcaattaagttagaaattagtaacaaaaagataataagaaaaataaacaaacattcagaggattaaaaagaaacacagctttaagtcataagtcaaagaataaatcatagtgaaaattataaagtactcagaaccaaattatatacaaatattacatatcaaaatttatgaagttagagtaaatattgtatagcttacaatgctcataatggggaaaaaagcctgaaaattaaaaagccaaacacttaccttaaaaagctaagaaagaaaaatagctcaaatgtaaataagttagatggaagaaaataataaaaattagtatagacattcataaactagaaaacaaaagatggagaggatcacaaagtcaaggattagagatagtctctaataacattgagaaaattcttaaaagaccatttaacaaaattatagaaggtattacaaatgaaaagtggacataaccacagatcccacagaacattaaaaaataacagcatcttataagtagcttcaaggtaaaaattttgaaaactcagataatatggataaatttctagaaaaatctaatttaccaatattgatttaagaaaaaaattaaaacctgaatacccatgatctattgaagaaattgaatcagaggttaaaaatcttcaggaaagaaagaactccagcctcacagaatctttttttgagaacagataaagaggaaatattctataacttactttacaaattcagcaaaaccatgatacaaaaccctgccaaggataagataagaagtgcaaattacagtacaacacactcatgaagatagatataaaacttctaaattttattagcaaaaaaacctagcaatgtataagaaatgaacccattacaaccaagtcaggtttattctaggaaagcaaggttaagttaacattggaaaattagtttaccagatattaacaaattaaagaaaaaaattatataaatctcaataaatgcagaggaagtatttaataaacatccatgtatataatttgaaagaaaaaaagctctttgcaaactacagaacaggagtagttccttatcctaataaggaatatcaaatccataaaaactctcattctcaagggaaaacgttgaacatgaaaggcaaagcttaaacgtttagaagaccatacaagaactgtccttaaggatgtcctttaaaagacacaaaatgttcaatgataaaggaaagattgataaattttattacattgaaattaagaatttctgccactgtaaagatactaaaaaagatggtgagaaaaaataacacaaataaggagaaggtattttggcaacacagagaaatagtctcctgcatatataaagaactcctacaaataaataagagagatgtaaactacccaattttcaaataaatgggcaaaaggcttaaagaggtacttcacaaaaaaagaaaatccaaaaggtcaacagcgtatgaaaagatactgaccctctttagtaatcaaatgtatataaattgaaagcagattagatactgttacacatccacaagatgggcaaaagtttttgacaatatcctacaaaatataaagtttttgcaagattagagagcagtaggagaaattgcagctggatatagaaattggttaaacacattggaaattaatttttgattaaagtgaaactcatatgacaccatagaattctgaactatcctagcagcactgaaaatgcccatagtctgtggccagtaattttattactatgtgtattccctaagtaaacttacacacatacttagcagggaacttgaaaaaaaatgtttacagcagcactatttataatagcaaaatactggaaataagctaagtgttcattaataatagaatagacatataaactgccatatattcattcaatggaatattatggttcagcaaaatgaaaaaatttcagctacacccaacaatgtgaatgaatccaggacgaaacatttaacaaccagttggtacagagtccaatcaaatgaagtcccagccctagtgccagagctggtacccaagaccccctgccatgccaggtgtaatccctttagaaaggagtggacttggagaagtaccataggagcacctgggaaagacccaggtaagcagcaatttaccaactgatatggaaatattcccattgtttgtcaaccagtgagccttactggtgtggtgtgcatggactaaacgtgagcattaagaacaaaagaataaaacagtgtgattccatttatatgaagttcacaaacacgcataactagacaatatattgtttagggatacaaatgcaagaggataagacaataaagaaaagcataggggaataaaaggtacagaaatgtccagaagatggtaatccctgagaagagaaggaatgggatagggtggagggaggtacacaggggatgtcaaaggttcaagtaacattctttttctcaaattgactggtgagtacataagtgttagtcataatgttattctttagacctttctacacagtttgtaagcattcgtttgcatctaggggctatttcattaaagttatttcaaaagatggtcacaacacaaatttaataagaaactctcatatcaaattgctgcagttcctgccatatcttttctagttgctgggcaaagatgctctcctcaattgtaattggtgtgctcttaaacccacttaaaattctaagagcttctccccagaccactccaaaacattcttgtgagaatctttccagtgaggtacagcaaggcccaacctccagggcacattatgctctggctcatttatttgatacaatcataatcatagtgggtttttttctcaaactttgaaatcttcaaaatgagggcatggagcaaatgactacattctgcttctcttgctaagatttcaatggtgatgctctcattttaagttctttaccagacgcttcagctgtgctatgcccaattcccctcatcaagatttgctgacagtcaggggaagtttctaacactgtattaagtgtatactgagggccagggaattggggggagtttgaggggctgcacacatgtgcaattttttagcaaacccagcagatgcttgtagattcaacactttttcagttatttgtgaacaacccctaatagccacaccacatggcaatttgtcttttctctggagcacaaatgtgaactgtatgttgcaaagccacagcaaagaacaagtcacttagctagagagggagtcttctcaaagacccagtaaccccatcccaagatgccaccagggaaacagaaactctctggaggtgaaagaaacttaatttccttgagtgcaaattgaaaaggcaaataattggtagcctgtgaatagtcataggaacctcttcactctggaatggaacctgattcaggaggaagtcaagagcctatgcaaatatttctgcatttgcaaacttggggatttgccaagggcttgagatgtatccactgaaaatgtcaagcgtctactgtgtagaattttgatggaggaggatttcaaaattcttcttctatttaaatccaatcaattcatgtttatcagggcatctctgatctttttgtttttaagagacatatttgctctattgtccaggctggagtacagtgatgtgatcatagcccatggcaggctcaaactcctggactcaagagatcctcccgcctctgtctcctgagtagttagaattacaggtgtgagccaccatgtccataattttatttttattttttttaagacagggtcttgctatgtcgcccaggctgatctcaaactcctgggctcaagtgatcctcctgtgtcagcctcctgagcagctggcattacaggcatgagccactgtatccagctcctctgatcttaagatagtttcaacatctaatgctaagcctggaagtccaatgaaagactcaatagactaaaattggtgactgagattcggaggagcatatcgtgtgtttataacactgcttttattttttccatatctttctactatttgtttattagcttttctttggatctcagttattcatacataacacatgtttaaaaagttgatcctaaaccccaattcaagggtccaccgatgctcagagatctcaagatttctgagactagcttccctatacttctccctggctttgctccccaaatctgaaaggcattttcagatcacccctacttcatatttagatataaagcttccccctttatccacaagaattccagctgcacctggcatttcaaaaacacttagtaatgaggaggggagacccatcagtcatgtactcaccacttccattgttgtcctgcctcccaagcacatatttccaactgtgaaacctcccaacagggcagtcctctggatagtgtggttcagtcacttcccaccaccatgcctcacctcctctgccttccaagccctctgggacttcagggaataccttttctccatcatattacaattagatacagggaacctttggagagttctgagtatttgtgattatattcaataacctgttactgacagtttcttttagttaaagaattttttcaagtaagttaccaaaacaatgaatgtatgtacatctagaaactgagaaatactcttccatgacttttagttaggtcctcacgttttccacatatgtattgaatttttaaaatactattttaaaagggtctacatttattttcctctacttttgtttttcctcttgcctttgttttggagcaaattttaactgaacacattgtcagagggtcaggccaagtttggcactgctcgtgtatctcagccaccttccagttttcagcacgatgtctgaactgaaaaaacaccattgcttaccataagggtgtggccatgacagcttgaacaacatccgggtagtggtaagtctacatttgctacacagatgtaagaaacagatagcagtagggtctacctctcctgctccatcttttccatcaccaggtctcttccaactccagaattaaagtcatcaagttggaacaactctaagtgtgtttcctgatcataacaagacaggttgaggttcatgaatattttctttagtattaaatgttagaacataaccactaataataacagtagcatagtagttccctgataaattttgacaaaagatcataaagttctcaatttcaacagcagggctttatagttgtaatataattttgaccagtaagccaccggctatccagaaacctcacaggtgccattatcatggatagttgcagttttttctctaagaatcatgcaaaaaaaaaaaatcttttggggatacttcagaactctgtctttttaaattggatgaacaaaatataattttaacttctatggatacatgtgggtcattgtgagcatcagttactatgttataaaacagagtaccaaagatccatcaaaatacataaaatttcactgaattgcttacattaaatgctcatatcagctttagaattccatgccttgaattcttgtgccttttaaatttttttttagtttttctgttttttactcttacttcttactgatacttgataaaagagctttaataatccttgcacagtacagtatcagttgcttccaatttgctaggtgcatttgacaaactaataaccaagcctcttaaaacttgaagtaaatgcagaggcctgaaagagggtataaaatttcctccaatgatcaaaattcataaactgtagctcatggacttatgacctttctcttgatttgccatctaggtcccaactggataagtgaaattatgtaaatgtgagttccagattgttgtggtattatcctaatacctatcaactacatagcatgttactaaacgtatctcatttttcttctcaagatagttcagtggtcttggtaaggttatgatggttacacctactttacagataaggaagaaaattggtcacgggctttggccaagtctgacccagaatgctagtgctgcctgttgatacagccagtgttttccagccctgcccgcctagtgcatctgcagatttgtaaatacactttgactccacaggaaacaggatggagaacagcatgtcagggactccttgatgggcaggatggagggcaaaaaagagccttaaagacattagggaattcacagagtagggagtgagagacaagttaaatgctatccagttgtcacacagctttcttaatgttatctttcatcaaatcatgtcctagaacctgccaggacttcagactaaatgcatcttcttcttgcctgtacctttcacacactaaatgtctcaacagctcacttggcaaggacccaaaggcagcacacacttctccactccaaggagggtggctgccactaaacacaatgggcggagacagctcaacaatagtgccagttgagcacatcttgatccactgccacagagttcacagtagtagttggccctcaaagcaaacccactggggtgttgagggcaaaaaaacaatcttagccttaaggggccagactttgccatcaaattaacaaatctgcccaacagccccaggctgaggcgctcaggggtgtgacaggagggcccctgttaacaattctgtatcctgtgggtgccttaactagatggagtggagaggaagcagagagctaagtgtcacaccaccctctcctcctgcctgcaggtgtcttagttggacagctgtccaccttccttgcaaaaaactcccacaatctttaaatgcaactatgtaaagggcctccagcctctgcaagccatcacaactttaaagagcatatgtcaaacagctcagacggcatctgaggtctattcttcagccccacagtatagcccaaccccagagcacaagtgacaccctagtggacaggaactcctccctacactggctgctcagcaggaccatgaagaacagctgggacctggcctattaccttggcttcaggattcattttctgcctggaattgggaaactggaggccctgcaggggtccttctcctgggtccaactgtctccagggtgcaagaggggtgaaattaccaaatgaaagttcagataagcaattactggctgaaagagacacaggagggtcttcagatcaacactgacccagagctaataccacactgtcctcagagggacacacgatcactgacctgtattcttcacatttaagttgctagaattattcctccttgcccccactctctccctgcccccagcatacacataattacataaagacgtcttaaacaactgtagcacccaacttcttcagtctgggggagagccaggagatggtggggagctgtttgggcacacgtctgatcattacataatcacacaaacatgggctggagaacactgccatgcagatcagttcagcaaacacctcattctccctctttcctcttccctccccccgtaacacccaaaatgcacaccagagttaacaaaaccgaagcactccaggtagccagtgggcacctggctgctgtggttacaatgccaagggctaccagaaacgtcagcgtataccagaaagagggccagggtgctgctcacccagcgaccagatctgcagaccctcttcctgcaaccactgcccccgaagttcaaggaagggcctagccacagaaatattcctgacctgcaacagaaaccaaaccagctacgttaaaggaaaccaatgccgagcctccaagttcctctgcaccactgccacactcaggagtcctcagcagcctggacaatatcattagggaccattcggcaccatcagtgtttccatttaaaagatagtaaaatgtggggcataacttggaggggacactctctctgctagcagggaggcaagaatcccctatagaataggagtttggtttgggtttggttgggtcaggttgggggttgggaaatgattttgctttaggaatattttcagggggctaggattaagggggaaaaagaaagctatcccctctgtctcagcagccagcatcatacgaatctcactctcaaccaagcaggctactgcagtccgcctaaacaatccggagcagcagccaaggcagcacaagaaaacgccggtgccacggaacgcgatgcctaagccccccagccgaggctcctatggagccggccgccagtgcgcgggtgcagagcccagcagagcctgctgcaagcagcgctggagcgcacggcgcgcatagggttacagccccgccgccgccgccgccgccgccgcctgtgattgacgcgcgggggtcacttgaggctcgcgccgctccccagcaccaggccgagcagcgcgctcagcccaccgggggcactggccgccacgcgcagcccacccggccggcccctgcgtctcggcagccggacaccttgcctaagaaaggcatacacaaaatggaatcgcagctcgctattctgcttcgcggtgcggcctcaggcaaaaacacaatcacaaggtaaaatacagcgcaaggaatccatccgccgaataaaaacccagagtcccctaccttcggccttgggatggcaaactggtcctgtgttctctgacccacggatccagccccttcttcatgaattattccggccaggcaggattttgtgcatttttttcatgaacacctgtttcaagtaaggggtaaagaccttattgaaagaattgtccttaaaaaataacctgtgcatacgtatgtccatccaggcatgcatgcgtgtttgtatacacacatatgcacacggaatagccatgtacattgaagcaccaaactaggcagctggataatgggagagtcggctggttgtgagcatgctcgcgccgggaacagatccaccctctgttattcctctgaataaatataaatcacgatcagaaacccaaacagaagcatccctcttgaattcgtgctgctgaaaaacacggaataaattcagcctgcagacacagaatctaatcagcagctgttttctgaatccagagccaacccatgcctcgcttgtcttttccactaggagtccagaccttttttgaaagggggtttaaccttttaaagacacagtacaccaattatcacttcggaatagctgtcactcccagcgcaggaagccagtcccatgcctaaaggcacagtaggcttgcacacagtgataaggatttcatttattggtgctttttaaaaaacaacatatatgtataatatatgtgcatatatatgcacatatatatgcacacatattatatatatatacgtggagagaaaaaatgcaaatgcaagtcataaatatttattgcactgatgagcttctcagtactaattggcacgttatgtaaacactatgatccttcacttctgaacacccatgttcacgggtcagacgagacagggcactcttgtcagcaagcgtgtcacacctcaccagcctctggctgcagatcaggggccggggagcctcaacagtgcctgaagggagtggggtctctgcacctgagagctcaacacgggcactccttgccctgccctgccttgctctgcagtctcagggtccatgtccacaaatcaaagaatagttctggcactatttctaaagtcgaacataatccagagccacatcgcattccaagacatactttctttcaaccagaatcaggaatcagaactaccacctgaaccttagttagagtctttacgattcagacttaggcccttcttcaagattttgttattgagttctgttgttttgtttttcacttttcttttaagggtcagcatggaggtatggaggtagaaaaacagggtagggggagagacaacctccagcctaaatttttttgaaaaaaattattcttcgagtacttcagccacccagatggtgtttactgcagttttgttctggcttttaaagaggtagcgctgagaagaaacaagagtcctaaccttgctcacgtgtgttaagaaggcaaatgtctttgacagtttctttttcaccccagccccagagctccagcatggcgctgtctgctcctccgctggttcccgcctaagagcagcggcagtggctcacctcgggagctacaggggcgctcctacagccgctccagcatcacagcccattccctcccttgcctagtcctgccaggcaaaccgtgaaaacaagtgcactgtcaccctcccacctcatcacaggcgctcctgtgtggacccctcccagcgacacacacacactctcttccttcccctcttccagggccctttggcagaaaattatcatatttcatgtgtcatcgcccaagcaagctgggtccatcactgattggctgggccctggcagccggaaatgtcaccagccacacagcgtggagctggctctcccgcggccaccacagacctgagcccaggaggctctgtgacaaggcacagacctaccacagagagcctgtcactctctccctggtccagcccctgccccctgcttctccatctacccagccccccggggaataggggctgcgaggggatggtgaaggagtctcagtgacattcctattttcccagcatgtttgagaagaaactaaagatgtctccaatcaggtttataaatttggagaacttgtttttgacaaaaacattctgtcttcacactaaaaaaaaatcagtaagactgggtgaaaacaagatggtttttttttttttgttttgttttttaccccaggagagtttactagatgctgctgtttatttcccatctaacatctcaggcaccaaggtataatcatgtcacagggctgtccgataattcagaaggtgattcgagtccatcctcttacctttaaagagaacagctccagaaaatgaggctttgtaacttggctttgcaatgtatcatgatgccacacaactttttaagggttaaatgatctttgtagtgaccaacatgaatcacttcagctgtaatttaatcttagtccctcctgctgtatcttcagcaggcttagtgtgactcaccatttaagtctcaccttattctgttctcctgagtaaactaaactctatctctctgtccttttcagtaaaagtttttctcaaccctttaattatgctgctttaaagaaaaagcctcccagagttacatgagtctggaaggtcatttggtccatctatccatatgatgtgtcagaactctccactatttccatacgggggcttttggtttggggaatggtaaattcactggcaatgctgggaaccagggaaagatgccatcaataaagcagacattttgaataatatgggaagatacaaagtagatgggacatgggaggaaaaactaattagtactgataaactcatgattctgcaaagaccctgatatggtttggctgtgtccccacccaaatctcatcttgaattgtagttcccataatccccacatgtcatgggaaggacctggtgggaggtaattgaatcatggaggcaggtttttctcatgctgttcttgtgatagtgaataagtctcatgagatctgatggttttataaagggtagttcccttgcacacgctctcttgcctgccaccatgtaagatgtgcctctgctcctccttcacctctgccatgattgtgtggcttctccagccatgtggaactgtgagtccattaaacctctttttctttataaattgcctggtctcaggtatgtctttattagcagtgtgagaaccgactaatacagacccctaagaagtaactgtacaggtttccagaaaacagtcttggaaaatcccaaactcagagaatcaggattggaggagaatcataggcagcagtttaaaggcaaattaagggacatcaggaacatggtcagtttctccacacagaatggctggacacagaaataggtccacagcttctttggaaagtgagaggtttgttccaaatataatagaagccaaaggttgaataggggcaggatatcagctccttttgaaatgccactgctcttccccaaaaagtgcgcacacacacacaccacacacacacacaccacatgcacacaaaagagatttaaaaaatcagataaaatataagatataacagagagatccagaatatccaatcaatattagcctaataggagttccagatggaggcatcattaatgaagaagaaatcaataatcaaggaaataacagaagaacatttccttaacctgaagaaagtctttaggccttagatcaaatgctgtgctaggcagcaggactactgaaagaatacacacttccagatgtactctgatactccaagagcaaagacaaacaatgacaagcttcctcataaaggagaaaaatcaggttgcttaaaaggaaagaaaatcagactaataccatacttctcatctgtaacactatgctaaaagacactggtataatttctgtagaattctaagggaacattattacaatttaagaattctaccagctgccaaactataatttctcttatgcaatgaaaaagaaaggtatgttcaaagacacagaaattatatcacccaaacaccctttattaaaaaaaatttaaggttacttgaagatctcttccagctgaggaacaaataaggcaggataacaaattcaagaaaggagaagatatgttatataaaaaatgtaatgaataaagccaacaaaatatgtggtcaaatataaaaataattgagaatatagttgtaaaatttaattgttagaagtcttgaaagataagagtataagtacatttattccagatttgaattcacatctatatctatctcttacatatatgtgtctggaattaaacttccatataattataacaaaaaaatagaaaatctcaatggaaacaggtaaaaatcactaaaaaaggaagaaggaaggagggagggaaggaaggaaggaaggaaaggaaggaagggaagagagagataaagaaaaggaaagaaagagaggattgttatggcaggccaataattccatctgtttcctcttcttcccaagaccacattaaaatgaaaataaggattttttttaggttgaaatagatgatgacaaaacaaaaacagtaaaagagtcattgatcaaaaaaattcacaaagaataataaaggaggacaattcatcagttagaaatatatactttaatgctacagtaaacaaaatggtatagtacaaataaagaagcctacaaagtggattgatggaagtcaagaaacaaatttagctataatggttactacatggtagttaagtaataaaaactgaattttaaatcagtggaggaaagaatgtgttattcaataaatagtgttggactgtggctatgtatttgaaaaaatataagttttacctctaactgatatcttgttaaaaatatattctattttcatataggaaattctgccatttgtgaaaacacggataaacctagaggacattatgttaagtgaattaagccaggcacagagaaacaaatactgtgtgagcttacttataagtgggatcttaaaaagtcaaactcataggagtagagagtagaatggtggtaccagaggctggaggaggtggcggggggaagggaaaggagcaacattggccaatgggaacaaagtttcagttatataggaggaataagttctggtgccctactgtacagcatggtgactacagttaataataataatgtcctgtatatttcaaaatagctaaaagagaagattttaaacgttctcaccacaaagaaagggtaaatatgaggtgattaatatgctaattagcctgatttggtcattccataatgtacactatgcatatattgatacatcacattgtacccataaatatatacaagtgttatctgtcaattaaaaataaaataaggctttaaaaatattctattttcacatacacaaaaattccacaagggaaagataggtgttatgattgaccaatactgtaaatcatagaattctatgaagtttttttttctaatagtggaaagaaaagcatgtggtcatccagtctatgcttagataccattgtgataggctaattactggcccccaaagatatctaccccctaatccctagaaactgaatttcaccttatatggcaaaagatgtgactacgttaatgatcttgagatgaggagagatcctggattatccaggagggccctaaatgaaatcacaagtatccttataggactgacgtaggagacgggctagagggcaacgtgactacagcggctgagattggagtgatgcagccacaagccaaggaatgccagaggccaccaggagcagaaagaggtaggaatggattctcccctgagcctccggagggagcatagccctatcaataccttgattttggatttctggcctctaaaactgtaagcagagaaatgggttattttaaataactgagtttgtggtcatttgttatggcagccatagaaaactacaaccaccatgatgagaaacatagtacttcctagggactatcattattattattgccaacaacaatacttactatgtacctggtgctgctaaattatttatatatcttacctcacaagtcacatgcaaggagatggtagagagttggagttgttacggccctaccacttagtagcaaaatgtccttgggcaagttatataacctcctaacactgactttttctcatctattaagtagaggtaagaaaggtacctacccactggggttgttgacgataaagtgagaccatctatgtagagtgcttagaacaatgcctgggaataaaggttccataaatgataagtgatcatgagaatgtccttatgcagctgtagtctctgttccagagctttttctcactgatttttgttcttctctttgggtacatacaaaacaagggtatctccaaaccacctgaatgtccttcaaatatctgaagccattgatcaggtcattaagagtctgagcttctctaggctaaaagtaaccaatgcctccaatcattattgttcttagaaattcacctggagtcccttccctaacttggtcacctcccctgaacacattcttgtgcatcataagatgtgactccagactcaccaccatgcttgttctagaacagaggtctgcaaactacagcccttcgtgcaggctaatttttacagcccataagccaagaatggatctgacatttttaaaggattgtaaaaacaaaacaaaacaaacaaaaaacagaaaagaatgtatgacagagactatacgtggcttgcaaagcctaaaatacaactgaccctgaacaactcaggggttggggctctgacttttcatgcagtcaaaaattcatgtataacttttgactcccccaaaacttaactgctaatagcctattgctactggaagccttagtgataccataaacagtcaacacatattttgtacattatatgtattatatattgtatactgacaagtaagctagagcaaagaaaatattaagaaaaatcataagagaaaacatatttaatgtttattaagtggaagtgaatcatcataaaggtcttcatccttgtggtcttcacattgagtaggctgaggaggaggaagaagaggaagagttggtcttggtatctcaggggtggcagaggcataagaaaatctgcatatagtggacccgtacagttcaagctcatgttgttcaagggtcaagtgtattcactatctggtcctttcagcaaaagcttgccaactcctgttctggcagatactgttcttttatcaatgcaatagaatattgcccaaaactttttggcaatcaaattgcatgactgtacatactgtcttaactgtaaggctgcaaatgtttctgtcagtatctattcccctctccccttcttagtaataaaattcttagctaggaacatggctacccagccaaagactacatttcccagcctgtcttataggaaggtgtggccagaagaacaggttctagccaatgggatgtaaacagatgtgaaatgtataatttcccagccatactcttaaagggaaggatcatgcttcccttcctttttccttttgccattggctgaaatgtggacctgatagccatgtggatgagtggtgcagagcaacgagatagaaggatcctatccctggtgctgccatttcaccctatactgtttattctcaatctgtgagagggaaataattgtttagcttattgaagtcattgttctattaggtctttgtgacagcaactgtatctgtgccctaagccatacaactatcattttcaactccctcgtactttttatatttgcagctaccaagccacacacctcccctgacctgcactcacacagttaatttcctggaccccactacaagaccttacatttagccctattatgtttcatattattcgaatcagcccatcattttgccctgacatctgggatctaattctgtcactcaaactagcttctatcctttgtaatttcacatcattcttcaaaaggcactttatttgtggcactcaagctaaacacagtgctcatcaaaacacctgatcaatattaagtataatgcagtggggaggctatgacctcagtttgtaggggaaggaaatagcagatcaaaataaggtccaaatgaagtagaaggaggaaaggaaggagatgagcagttatggagagcttactatgttccagtcactgtgctgggaacttcccccatcgtgaagttttagtgccttaagtacccctattagtgccttaagtggaatagtcataaatttgtgaacaaagaaaggaatattaagagaaatttttaaagtatgttagctaaagtttcttgcagcctgaaggtcctacttgaggttgtgtatcaaaaaccctatggagttttagggaaaatatggatgcttccaagttgctacaggagggtcttggcatatgtatatctttaaggctccatggctaactctgacaaccctgataagccactgtgagtttcagctttctagcacactagaaagtttgaggcagagactctgctcagctaccagctcctggagtctgactcagctttctgtctcaggcgaggatgtagccttgtcaggctgtttgggttcaagaaccaggagagtctgatgttggtaagaattcccttctaggaagtattaagcaaagtgattggagtatttccctgagtcttgtaagcttctagtacaaaaggagtgtggtgtagcacaaatgagtttctctgatctggtgagatcctcctttgggtacccatttgacatctcccaattgggcacccttgggagccacccaatcctgcactgagacaggccacctggctcctggtcagtttgtgtactctggctaaacaaactctgtatgtgtgttttgggggtggggtggagttctcttgtggcaacccatagactacccaaaaatgctgcaagacaaacataccaaagtcatcaaaaagtcattaaagtcatgactagagaatagtgaataaacaccccaaatcacatgtaatttattacattcacctagggtaaaaaacttatgtgccttcagggccaatcaaataacgtaagtgtgcaaagtagcttggcataagcaaaagagaactggagtgttcatgcctctctacatatctaccttttaaaaatgaaaaagctgaaagctgtgtagctaaaaacaattggaatcagaagatggaccaccagtttgcaacccttctccccgataatcacagtccacaaaagcaaggagaaaaaaaacttcatacctctcttagaaggataaaagaattatcttttaaaaacggcttgtaggcagggcacagtggctcacgcctatagtcccagcactttgggaggcagaggtgggcagatcacgaagtcaggagttcaagactagcctggccaacatggtgaaaccccgtctctactaaagatacaaaaaattagccaggcgtggtgacgtgtgcctataatcccagctactcgggaggctgaggcaggagaatcgcttgaacccaggaggcggaggttgcagtcagccgagattgcagcattacactcctgcctgggtgacagggcgagactccatctcaaaaaaaaaaaaaaaaaaaaggcttgtaaaagcatgtattgctttttaaagcaatttttaagaaacagttaaataatatccctaaaaataggatgtctttaaatgagttgggtcagatgaccctattacagtaattctcaaattatagtccaaagactacagtgggttacaggagtgcccaggtggtatgcaaaatgttcttccacaagtctcactcacagtctaaagtgtcccttatagcacagaggattcttcatttatttctttcagggctacttcatcagatgctctccctactttttttctttttattttgaaataattttagacttatagaggaattgtaaagattgtacaagttcccatacaccctttacccagttttcactaacagaaacatcttacataaccatagtacaattattaaaactaggaaattgagattggtacaatagtattaattgacctacagaattttctctaatgttaccagtttttccactgatgtcctttttcattccaggattcaattcaggatcccacattgcatttagttgacatttctccttggtctcctctgttctgtgactattcctcagtctttccttgtctttcttgcccttgacccttttgaagagtacttggcaggtattttgtagacagtccctcaatttgggtttgtctgatgttttttcgtgattaaactgggattgtggagttttggcaagaatgccacagaaatgatgcacccttctcagtgcatcaaactggggaagggagacatgctgttaatatgtcttactggctgggtgaggtggctcacatctgtaatcccagaactttgggaggctgaggcaggaggattgcttgagcaacttagtgagacctcacattatcccttggttaaggtggtatctgccaggtttctccaatatgaaattactatttttccctttgcaattgataaatattgggagtctcaaatactttgagactatgcacacaccatgtttctcaaacttatacccattagtttaacagctatcaggtgaactgtctgcagcaactatgactgcagtgttctaggggtgattttctatttcctccacttctctctatttattcactggaattcttctggtaaggaaaaactgtcctttttccccatcaaataatcagtgtattcaacttttatttttatcaaaacagactcatggatagttattttattccttcagttataacccaatatatccttacttatttttttgacctaaattgttccagctttggccaataagagctttttcaggttggttcctgtactctgcatattcccattgttgttgttgttgttcagcactttcttactttctagcaccagaagatgctccaggctcatcttgtagtttgcctacccagtcctggagcctatgtttccaagaagtcctggctccttttattaaataatagcatttagagaccaagattggggaacctgatgtgctcactgctactgggatgtcagtgcttttagtgctacagtgctacaggccatctcagtagacagagctaggaaacatatgtatgtatatttatccatgaatacacacctatatttccgtatctatcagtgtatatgtgtgagtgtgtgtatatgtgtttttatatatatatatatatatatatatatgtttaaacatgagttaatactgatacctctgactctaatcaaacaccatggattcattccatcattctgctttgcttattagtaacttctttctcagacagacacctgcgtcttattatcaataatatatttgcttatctgttcattcctagtatatatgtaaaatagttttagaatggttaacacatacccctgtgaaggacaaatttatcatgtagagtacagtgtctgtgtacagttatttttgtctttagccttacagaattccaaagttacttaggtcagctcccttcttcctcatcatcttcaatgaatttatgttatacacgtgcaatgcagttagattcatttgtcatattctgcattacatcttaggttcctcagtatcctgattgattttgttcttaatttgcacacggcaaaatttacactttatggtgtacagatctatgggtttgacaaatacatagagttttgtgccatataaagcagttccatcagccacaaagttacctcatgttgctcccttgcagtcaactccaacccaaaccccaacccctggcaatgcattttccataaatgtagttttgtcttttctaaagtatcctatggaatagtaaaatatgaactttttgggtctggattctttcacttcgcaaaatggatttaagattcatccatgatgttgcatgaattaatacttgtgcctttttacagatgaatagtgttccattttatggatatatcacttctgttcgcctgttgaagaccatctcagttgtgtccagtttgggtgtttatgtgtagagttgttacaaatattcatgtatgggtttctaagtgaacacaaaatttcaataacttgagtaaataccaaggagtgggattgccgggtcatataataagtatatctttaattttataagaaactgccaaactacttcgcaaagtggttgtaccattgtgcattcttaacaagaacatgaaagagttccagaggctctgcatccttgccagcacacacttagtgttgtcaggtttgttttttcttaactgtagctattctaattgatatgcatgatagttcattgtggttttaactttgatttccctaattaaaaataatgttaagtgtctcttcatatgcttatttgccatcatatgctttctttggtaaaacatatgttcaaatattttgcccattttttatagagttgtttactttcttgctgaagcttgaaagttctttatatattctggatacaagtccttcattacatatatgattgcaaatattttctcacaatctgtggcttgtctttttattcccttaacattgtctttcacagagcaaaatttttatttcaagttcaattcattaatgtttcttttattgattgtgcttttaatgttgtatctaaaaactctttgccaaaccaaaggtcatattttctcctgtgattttttttctagatgtattgtagtttcatcttttacatttagatctatgatctttttctcagttgttttttaaggtgtgaggtaagtgttgaggttcattttctttcttgcatatagatatccaactgttccaacaccatttgttgaaaagactatcatttcttcacccttgtcaaaaatgaggtgattatatttgtgtgggtctacctctgggctctcaactctgttccactgattattgtatctatcattttgtcaacactacacttccttgattattataactttgtaacaagtctcaaaattgggtactgtctgagtcctccaactttgtgctttttcagatttgttttcatggggacaaactgacatcttccaatccatgaatacagtatctgtatttattttactgttctttaattgctttcaccaggattttctagattttagcatacctatcctgaatattgtttttgttagatttatatctaagaatttgtgggtttcggtgctactgaaaaggctattgctctctaaatttcaaagtccatatgttcattgctagcatgaagaaatacaattgactttgtatcttgcaaccttactaaactcacttattagtcctagaaactttttaatgatccttcgggtttttctacaaagacaataaagttacacgtgaaaagacattgtttcctttcttccttttaaatctttttgcctttttttttcttgccttattgtactataggactttccatatgaagtcagataggagtcataagagagaacatcttgcattgttttttatcttaaggggaaagtgtttagtttttcaccagtaagtgtgttgctagctatagccttttgtagatgccctttttgaggttaagaaaattgccttctattcatagtttgcagatagttttaatcatgaatagatgattaatttttaaagtgctttttgtaaatctattgaaataatcatcgtttttcttttccttggttctgtaaatatatttaattttaatttcattggttgatttttccagtgttgaactagccttgcatttttttgttttgtttttttgtttgtttgtttgtttttggaaggcttttaactataacttcaatttccctagaagatatgggattattgaagatataatatttcttcttgaatgaattttagtatgtctgtccttcgaggaattgattcatttcacctaagttgtcaaatttatgggcacagagttgtttgttgcactaccttattattcttttaatatctgtagggtcagcagtgatgtcccttctttcatttctgatattgataatttgtatcttcttttttcttggtcagtctgcctagaagttcactaattttgctgatctttcaaagaaccagcttttggtttgattgatatatccaaattgcttttttgtttcaaatgtattgatttttgctcttattatgttcttccttctgcttgcactagttttaatttgttcttctttatctagtttttttctttttagggtggatgcttaccttactgattgaagacctttcctcttttgtagtgtaagcatttaactctataaatttccatctatacactactttagcttcatttcccaaattgtgatatgttgtagttctttttcattcagttcaaaacgcttttttaattgccttaagacttcctctgacatatggtttatttagatatgtgttgtttcatctccatacatttgaagattttccacttatatttctattattgatttctggcttaattccattatagttcatgaccatgctttctatggtttctagtcttttaaggttgttaagtttgctttatggcccagaacatagtatcatttggagaatgtttcatgtgcactttagaaagaagtgttgtcatgtaaagtatactataaatatcaactgggtcaagttggttgataatgttgctccagtcatctatatttttgatgattttctttccatttgttctatcatttactgaaaaaggagcactgaagttttcaactgtaattgtgaaactatctatttcactttttgattctatcagcttttgcatcatgtattttgaaactctgttgttaggtacgtacatgtttagcattgttatgtcttcttggaaaatcaagccctttataattatttgatgttcctttttatcccagataataatcattgttctaaaagtctcacttgtctgatagtaatataaagacttcagctttattttgattagtgtttgcacagcatatctttttctattctattacttttaacctatctgtctttataactaaagtgggtttcttacagaaagtgtatagctggttcttaatttttcatacaatctgacaatctccatcttttaactggtatgtttagaccattcacatttaatgtgattatagatatggtcaaattaaaatctattttgctagctgtttttttgttccttctgtttttttcttcttttcttttatttttctgacttctctcgttagcctggtttgggggtgtgtggaggaaatggtttctattgttctgattaagctgtagtcttaggcaagcactatatcactgagtcctgaagcagcagccttcccagtgatcccatccctcccctgcttcacttctgaatccagaatgtatatccatcctttccctaggtgttaagatttttttccctgttcccttatctcagatgtaatgggatttcaccagtatccaaagagtgataatgtttgctcccttctacatacatgtcacactaattaaggcttttgttcataggggaggtaggcaagaagggtccaggtagaatttctcacccctctcacagcagtttcttttcctctcctccagcaattcactacaagggagattttctgtagactctcccaaccatttttgtgaacctgtgatggggttcatggagaaatgagtctaagaaagaaagtgtgatctccttttatttattatccctagggctttgcccgcttctactagagttcattaagccagattctgcatattcaacaaccaccttagctgaattcatataggtatgtttcttgcttaggtaagtcagagctcatatctcatttctccctgaagatacctatctcttcctcgattttgggcctactgggtacccagcaaccttaggactccagtgagctcaagaaaagttgtgaactttctattcgtaaagattttttttcaccataagtttaggaacaatccttcccagctgtctacatctttgagaagaaactagaagtctaccttcttataggtacttttgcatcttttgcaacagcaaacagaagaaggtacagcagttggtcagggtaatcactattctcttggaaacttgcttaaagagctttaggaatgacagatgttccaaaaacacctctatctgttgtttttgagaaatgtaagatatacggggaaaatcctataggagttaagtaaagtacaaataatgtaccaatttttcaaaaagtggagggcagaatctgtataaactatcagtcagttataattcaggacaactgtcttgttgaaagcatctaccagcctgcaattgcctggcaaagaatatgatgccacatagtaaacaccatggatggtgaagaataaaataactctagaggctttctagtccacttaatttcagaattgttcatacatgtcaccatttagtgagaaatatgacaggcaactaattactcaaaattaggctaatgacaaaaacattatacttatgttttattatttattctagtttccccaaaggtaagtcttgtcattaatcattaactactccatatattattattattaaaaatgataatgaaacaactacaatttagtgaccactcactactagccaaagactatgcttagctaatagcaaacatgttctcatttcaccttcacaacaactcagtgagagaagtgggactcagagggactaagaaactcgtcaaatccacagaattaacatatgttagaactagaattaattcccaggtcagattttaaagtccttacttttaacttctgagtcagactatcccagatgatgttaattatttcctgtggcccattgagtatttcctgctgtcatttacaatgctggaaaaggtccatccttgcataagaacacaaaagcatcagaaatgccttattagctgagtccagttgtccagccacaagggcattcagtttcagaatggcaacaagggactatttgttgagtgaacatgacaactgacctttctgagattggtttgcaaagagggcataactgtcctccatgttttttaaatgtctctctcactctctctctgtatacatatatatgtatgtaaatatgtgtgtttgtgtaaaatattcttttctttcctgtaatcctgtattatctagcaatttagtcttcttgaaattatatatatatttatattatatattatatatattttatatatataatatatataaaataaactacaactaactctaagaataaagagccctctataagatttctaccatctctaatgaggaaacataatgtgatattctaagatcatcttagatacctggagcatagcaacagcacagcaatgagtttcaaagacaacaatgtgaacagctaccactaaatcttcagttaggggagtcgagctatactcaagtatatttcacctaacctaaacaaacctgtgtaaaataagatagcagactacataggaaagacagtaacaagcaatggcaattgcctgcaagtaaaaaggaagagtgctacaaagaacaaggagaagtagtcaattcagggaaattcagttcaagggtaaatgtaaatcaccctctgtaaccccaagatggagggtcacctgccagaatctctgaactataatacaaagcagtaactaatgcttcccaacctattgcaagtcaagatgcacacagaaaatcaatctattcagatgactcatgtgcgagtcaagatgcacacagaaaatgaatctattcagatgactcagcaagaggcaactgatccaggggcttctgtcacccctcaagcccggcctggcttccctgagaggtggagatggagggatcatatttccacacacctgtaatccattcacaacacaccactgagcttttgtccaccaggtggaaagctctgcaataacttgtgtcaacaagaagtagttccattatgtttggtctactccacttaagaaggtgggaaaatataaaatatcacagagtaatatttccatcaaaagtagttaaatgttaaaacattttgatgcttagagggcaagcttcagttagaaaaattaactcttggaatgcctcatttcctgatgatgcacaaatacaaagtgtgactactctgtcttttattggggttcaaggtatatctatcaaatcattctgttatctcaaggtatttgtggagtctgaattaaccatatcagtacccatgatggttttaaagtattattatactggatgaccatatgctcttatgatgggacacactggaggtaaagggatttctattaataattacactataatcactggtataagccagggctgtcctaggaaaaccatttggtcaccccagtattagatcattctccctatttggtcctaacctttttacaacaaagaaagctatgtttatattcttcattaaaatcataaataaaaataaaacagtgcatgctagtagcaataaactaaaaactgaaatttataaaacagaaaataaaagtggtaccatttataatacctggaatcattctttccagagataacctccattaacagtcttctttccagtcctctttatgtggggagaactgatcccccaacattattatccaaagtcagacaaatggatactgggtggccaaaaataataaatatatattctatacacagagttcacatggagcctacccctctcctgcagtcctggggtacagcatgcaatttggttctaaactgctgggcacaacactttcttcctggtcatgatgttggttcaaggtggtcacaggactcttttagagccagtgagacacaaagaaacttttgctcagacttctaggaagacaatctaggtacttatcaaattgaaactgagaggatcgaaggccttgacctgcactatccaaaatggtagccactagccatatgtagctattgaacacttgaaatgtgaccagtacagaaatgtgatgtaagtacaaaaggcacactgcatctcaaagactcagaaggaaaaaggaatgtaaaatatctcaccaataatttttattttgattacatgttgaagtgatgatgcatatggctcatattttctctctagtggacaatgccagtctaaaacattgaaccattggtacagccaggcctgagggtatccctggtcatggacttttcagatatgtcaactaataatatctattttgcttaagaaagttctgattggacattctagcacttgcaactgagaatcctaactggtgcattgtatatgtagagtcatgccatacattcaagactgaacaaccaatcatgagcacttgttcatgccagcaccttaagagtagtgtgcccagatctgcacaaagtattctatatgtggacaaatcaaccattgtttttatctgttaacaccactgtatgtgtctggggtgtgtcaccagctttctttaaggtcttccagtgccaaagtcttcttctcctggcctttgcacatactttactttctgcatggaacacgctttcctctctttcacttgcctggttccctctcattactcaggacgcaatttaaatgccatctcctcagagctgagtttcctgaccactctattttgagtaggtcacccctgatattgtctctcatagcaccacatctcccctatatggcatggaccaaaatatgtattaacctctgtagaaggctgtttaacatctaccttctccttccccaccataccataccgtgcatcaatgcagaagccatgtatatgtggttcacccatttgtccccagcacctggaacagtaactaacacatagtaaatgctcaatcaacatctactgaatgccaggaatgagtgttaatgagtccaggagaaggaggaaggtcaggggaagatgaagtaatgggggaagggaactaagataattcagtgtaaccaaaccactgatgaatgttgattaatgccatctagaacactcaaaaagaaagtaaggatgagaactgacagaggaagagcaagtccagaatggaaggatttgagcagttagtggctgcctggaccttcctccaggcataaaagcaaatggtcagagatacaaatgatgaagcctgcagttcaaatgcatttctgaactccacacaatgaaaattatgctgagattttgctttctgttagtgacaatctggttcttagtctcattctcataacctaaatacaaaactatgggggaatctgagtcctactctaggaattttcatcagactctgctcaaaggcaagatcacattctttgacttctgcattgtggagcttctcatgaggctgattgaaatgctgctgttcatatcaaagccagcctttctggacttcatcgaatatctagatcccttctattttcctcttcacattcttgttctcacacatgatctttgccactaccctgcttgcttacctcagcttaccttatacctcggaggcagcagtaacggtttttactaaaaccctttaggattgatagatgatagcctctaattatttctctggagataaggcctctctttaaatgagaatggctcttctttttgttttattgtgatatatatttttaattcatttattttataatggaaagttgatcaatacaaaataattcataaaccaagcacccaatttaagatctagcattttattttggaagccctctgtgtgtccctctttggtttcatttcattttttaaagaatgaaaaccactttgttagtgaactccagaatttgggaataaaggggttagaaccttagaatttaaagatgtggtgctgtccaccaggcaggtgctgacgagtctccggaaaggtgggagagccaccgcagtctctcagaggaaagaagaaagtgcttagtcctttttctttttatttttccttctcccactttgatctctcttctttcttcctttttaagaattactacacctcttctctttgctggtaagacgagggaagtcaacagagctccacgattctgtctccttctttttctaacagatggtttccattagggcttaccaggtattttctctgaacagaatcaaacatgcattgaaaaagtaaacatcaggatcatagaactagcagccctttatttattacataaatacaaagattttatagctggaaaagaacttagagataactaaatccaatcttcttgtttcagacctaagaaaaccaagactcagtacttgcctgagttattaaggttattaagctaaatatatgtcttccctctccaaatcattgtttttatttcccatttttctttttttctttttctttattttttatttcccatttttcaattctcattattaatatattttcattattgataatttgatcacattattgattattttactttagtctgaggcacctagccttaggctattagtattttcatttagcaatattaattacaaaatgatttttgaatgatacctaaaagatacctcacattaatgtaaaatactttgttttattcttaacagcatttatctcagaagtcactaaatattcaatcatatttttctgataccctgacattctctgcctcatatttctacttctaatgaaatatacaattgagctgaattttaaaaaatataggtacttcagaatattcctaaatgatgagtgagtcattaagttatttgtcatatcagaaatctacagattgctaacattcaattagttaaccaaaaaccccaaatgcccactaggtgcccaacactgtgccaggcatttttcttatgcaccctctttaaagtgaaaatgtttgaatttcagattttcaagaatatttgcatgtatatatgtatttgcttatttattttatgcaataaattttatttctgttattctcaaggcactgtgctaggcactgttggaggtgaaatgaactcttaagagaacatactatcaagaaagagacaaaaatgtttacataaatatctacaatatgtggcttaggagagtgatcccaaacacaaatgaccacagaggccaggtagtcaatgtaaatgcaagaaacacgttgtgtatacggcaacagggaatgggaaagttatggggagctataaaatgaatgttgcctctaaagaaaaaaattgagaatgaaaggagagaagatttgagaaggtgggggaagtgagagggcacaagtataacaggagagcatgaagagagaggataaagagagaagctggtaaagacagaggagagagagggggaggacaggcggaaagggaaggagggagggagcgggggagagagagagacagagagaaagagagaaaacatcaacactaaaaggtcaggtagaagaggaaaaccagcagagtatggtgtcccaaaaaccacaagagggaacttttcaaaatggtcaaatgtgtcaaattttgctgaaagtatctattggatttgacatcactgaggtcactgacaaccttgacaagaacagtttccatggtgtggtgagttagaggccaggctgaaacatgctgaaaagtggatggaaggcagacagcaggaaggcaaccctttcaagaagttttactgtgaagggaagcaaaggaatggggcagtgggtagagtagggcaagcagtcaaggaagaggtggtttttaaaaagacagttgatgtcgtcaggtttgtctactaatgggaatgatccagaaaagcgggagccattgatggcactggaagacgatggccaaggagccgatcctagagaaagggaatagaatccaggcacacataggaagagtggtctatgatctaaggagggacagacacttcttccatcacactacagagaagaaggaaagggggtgtaaatgcctgcatggtgataaatttggtggtggaagtatgagggaattcccatctgatggcttcaattttctacataaaatagggaaggacatggcttgagaataagcagggagggtaagtgaaatttgcagaaggggaaaaagtgtgaagtaataaccttgggattgtgaaagcaggcccactagagaaacacagtagaaaatacagagcacccggttatgatctggaattataaatttaaggcacaaccagacaactttttattttgtccagcaaagtccagctgatcaaaagggcatgaagaagccatgaattgcccacacatcttgagaaaacaccgtttctaagccatagatcagggctggggcctgaacttctgcacttctaacaagctcacaggtatctccctgctactggatcgctggatcacactttcagtggcaagtgtaatccgccaatttcctttgtcattcttttctcaagtatttcagtaggggacacaggagatctgtcacctctaagtctgaaaaaataatattaataataaaaattaaaacctcaaaaataatagaaaaagggaggaaggacatggagaaagaagatgatttggtttatccaactgtggctgtattagaaatatattttcttgcccttcttcttatctacatttccagctttggcagtctcatgcagtctcacaacttcaaccaccatctttatgtggatgtacgatgtctttcttagatccaaaggcacaattaacacatccatatgggtgtcccatgagcaactcaaatgataacttgtcacctatatttgctctccttgatcttttcatccttttactcttctcattctcactggcctccacatttaaagttgttaaggcctactgatttatccctaaaatatcagtagtttctatggatgcaaattagaactacactaacacatcatttccccttgtcagatatgcaagaatccaaaagtttgatgacataccctactggcatgactgtgaagagtcagagacttgcatgcattgttagcaagaatgcagagtggtataacccctatggaacttttttgcaatgtatggccaaattacctaagccttgatcctttaagttaggaatctatcccaaagacacactagcaatatgtaaaatgatacatgcacaaagctatttgtcaaaacacaatttgtaatagtaaataaatgaaaacaacccccaaatgttcatgaattagggactagttgcattcataaaactgagaattatatgaataattctcagacacagaaaggagtgaggaaaatctctatatattgctatgaaggaatgtaagtgaaaatacaaaattcagaagaatgaacataatatgctactttttaatataaacaggaagatatatacatatttgtttatattttcttttttttttctttttttgagacggagtttcgctctgtcgcccaggctggagtgcagtggcatgaacttggctcactgcaagctcggcctcccgggttcacaccattctcctgcctcagcctcccaagtagctgggactacaggcgcccgccatcacgcccagctaattttttattttttttattttttagtagagacgggtttcaccatgttagccaggatggtcttgatctcctgacctcgtgatccacctgcctcggcctcccaaagtgctgggattacaggcatgagccaccacgcccagccacatatttgcttatattctcaaaaagaagaaatggaaagataaaccaaaaattaataaaatgggttacctataggagaaaggaaagaacaatgggaagaggatttaggtggaagctggatctctttgaatgtatcatattttatagttttaagttcaaaatcatgtaaatgttttgcataattttaaaaaattaaatagaaaagaaacaaagtaatctataaaaatcaaaacaatctgaaatactcagtggcttcccactacctaccttgactccaaattcctgagcctgaattcaatgatctctttagtctgcccagccaaatattcccacttcactttctgaggcccccttctccatcttctctacacacagacaaactattaacattatctgtgtgcctaatttattttgccagctagaccatacttctttgagaatggaatctagttctgatttatttttgaaacctaaaattctcagtgtctagagttattaccagaacataaattagtacggttatggcatctgaaagttattggcaggaaattttatgtttattctgaagaattcaaggaagccatagctttttgataatatgtaaaatatctggctaaagagtaactttctagttacaaaacagaaaaaataattgaagcaatctgatatccatcagcagatgaatggataaataaaatgtggtatatccatacaatggaatattattcagccttaaaaaggaaggaaattctgacacatgctactacacagatgaaccttaaagacagtgtgctgagttaaataagtcagtcacaaaataacaaatactgaatgattccacttatatgaggtacttagagtaataaaattcatagagacagaaagtggaatgatggttgccagggactgggcaggaggtgagaggaagtaggagttattgtttgataagtccagttttaattttgtaagatataaaatgttctggagaaggatagtaccaggttgcacaatatgaaggtgttaaatgccgctgaactgtatgcttaacaatggttaaaatggtaaattttgttatgtgtattttgtcacaattaaaaacaattttaacaaggaaaacaagacatttgggaatatcttttaatattggctccttttattaatgtaacaaagttttaaccaaggctatcctctccagagccattaaggatcacctagggaagagacggctttttgcttagaacatggtaccatgttacctacactctctctgaaacgaatttgcataagaactgttgtttatgggaatgcatcttgacggggcagctgggttgctatgaaatactcaggaacccagcccagctctaggactcacccctgagcacaaacgcaatgttggacacactggtaaaggaccactggaatccagcagcccggatccctttctttgtggtcaagaaaggcaggaaaagggatgcaggactgctacatcagtgagcatcactaatccgataagcagaggtccatgggtggtgatgcaccctggaaaggaaaaagcattaggaccatagaggacgctctaggactaatgctcatcggaaaatgactaggggtgctggcatccctgtgttcttttttcagatgggaaacattccccccaaggcaaaaacaccctgaagatatattctggagaactggggccaatttgaccctcagacgctaagaaagaaacgatttatattcctctgcagtactgcctggccacaatatcctcttcaagggggagaaacctgacctcctgagagaagtataaattataaccccatcttacagctagacctcttttgtagaaaagaaggtaaatggagtgaagtgctatatgtacaaactttcttttcattaagagacaactcacaattatgtaaaaagtgtgatttatgccctacaggaagccttcagagtctacctccctacctcagcatccccctgactccttccccaactaataaggaccccgccttcaacccaaacggtacaaaaggagatagacaaaggggtaaacaatgaaccaaagagtgccaatagtctccaattatgccccctccaagctgtgggaggaggagaatttggcccagcagagtgcatgtacctttttctctctcagacttaaagcaaattaaaatagacctaggtaaattctcagataaccctgatggctatattgatgttttacaagggttaggacaatcctttgatctgacatggagagatataatgttactgctaaatcagacactaacctcaaatgagagaagtgccgccataactgcaggccgagagtttggtgatctctggtatctcagtcaggtcaatgataggatgacaacagaggaaagagaacgattcccctcaggccagcgggcagttcccagtgtagaccctcactgggacacagaatcagaacatggagattggtgccgcagacatttgctaacttgcatgctagaaggactaaagaaaactaggaagaagcccatgaattattcaatgatgtccactataatacatggaaaggaagaaaatcctaccgcctttctggagagactaagggaggcattgaggaagcatagctctctgtcacctgactctactgaaggccaactaatcttaaaggataagtttatcactcagtcagctgcagacattagaaaaaaacttcaaaagtctgccttaggcccagagcaaaacttagaaaccctactgaacttggcaacctcagatttttacaatagaggtcaggagaagcaggcggaacgggacaaacgggattaaaaaaaggccaccgctttagtcatggccctcaggcaagtggactttggaggctctggaaacgggaaaagctgggcaaattgaatgcctaatagggcttgcttccagtgcagtctacaaggacgctttagaaaagattgtccaagtagaaataagccgcccctcgtccatgccccttatgtcaagggaatcactggaaggcctactgccccaggggacgaaggtcctctgagtcagaagccactaacctgatgatccagcagcaggactgagggtgcccggggcaagtgccagcccatgccatcaccctcagagccccgggtatgtttgaccattgagagccaggaagttaactgtctcctggacactggcgcagccttctcagtcttactttcctgtcccagacaattgtcctccagatctgtcactatccgagggggtcctaggacagccagtcactacatacttctctcagccactaagttgtgactggggaactttactcttttcacatgcttttctaattatgcctgaaagccccactcgcttgttagggagagacattctagcaaaagcaggggccattatacacctgaacataggaaaaggaacacccatttgctgtcccctgcttgaggaaggaattaatcctgaagtctgggcaatagaaggacaatatggacaagcaaagaatgcccgtcctgttcaagttaaactaaaggattctgcctcctttccctaccaaaggaagtaccctcttagacccgaggccctacaaggactcaaaagattgttaaggacctaaaagcccaaggcctagtaaaaccatgcagtagcccctgcaatactccaattttaggagtacagaaacccaacggacagtggaggctagtacaagatctcaggattatcaatgaggccgttgttcctctatacccagctgtacctaacccttatactgtgctttcccaaataccagaggaaacagagtggtttacagtcctggactttaaagatgcctttttctgcatccctgtacttcttgtttgcctttgaagatccttcaaacccaacatctcaactcacctggattgttttaccccaagggttcagggatagaccccatctatttggccaggaattagcccaagacttgagccagttctcatacctggacactcttgtccttcggtatgtggatgatttacttttagccacccgttcagaaaccttgtgccatcaagccacccaagcgctctttaatttcctcgccacctgtggctacaaggtttccaaaccaaaggctcagctctgctcacaacaggttaaatacttcgggctaaaattatccaaagacaccagggccctcagtgaggactgtatccagcccatactggcttatcctcatcccaaaaccctaaagcaactaagagcattccttggcataacaggcttctgccgaatatggattcccaggtatggcaaaatagccaggccattacatacactaattaaggaaactcagaaagccaatacccatttagtaagatgaacacttgaagcagaagtggctttctaggtcctaaagaaggccctaacccaagccccagtgttaagcttgctaatggggcaagacttttctttatatgtcacaggaaaaacagaaatagctctaggagtccttacacaggtccgagggacgagcttgcaacccatggcatacctgagtaaggaaactgatgtagtggcaaagggttggcctcattgtttatgggtagtgatggcagtagcagtcttagtatctgaagcagttaaaataatacagggaagagatcttactgtgtggacatctcatgatgtgaatggcatactcactgctaaagaagacttgtggctgtcagacaactgtttgcttaaatatcaggctctattacttgaaaggccagtgccgcgactgcgcacttgtgcaactcttaacccagccacatttcttccagacaatgaagaaaggaaagaacataactgtccacaagtaattgctcaaacctatgctgattgaggggactttttagaggtctccttgactgatcccaacctcaacttgtatactgatggaagttccttcgtagaaaaaggacttcgaaaagcagggtatgcagtggtcagtgataatggaatacttgaaagtaatctcctcactccaggaactagtgctcagctggcagaactaatagccctcactcgggcactagaattaggagaaggaaaaagggtaaatatatatacagactgtaagtatgctcacctagtcctccatgcccacgcagcaatatggagagaaagggaattcctaccttccgagggaacacctatcaaacatcaggaagccattaggagattattgtcagctgtacagaaacctaaagaggtggcagtcttacactgccagagtcatcagaaagaaaaggaaagggaaatagaaaggaactgccaagcggatattgaagccaaagagccgcaaggcaggaccctccattagaaatgcttatagaaggacccctagtatggggtaatcccctccaggaaaccaagtcccagtactcagaagaagaaatggaatggagaacctcacgaggacatagtttcctcccctcagaatggctaaccaccaaagaaggaaaaatacttttgccagcagctaaccagtggaaattacttaaaacccttcaccaaacctttcccttaggcattgatagcacccatcagatggccaaatcattatttactggaccaggccttttcaaaactatcaagcagatagtcagggcctgtaaagtgtgccaaaaaaccccctgcacttcaggccatacatttcaatccctgtacctgaacaatggaacaacttcagcccagaaataaacaccacttctgttttagtaggacctcttgtttccaatctggaaataacccatacctcaaacctcacctgtgtaaaatttagcaatactatagacacaaccaactcctaatgcatcaggtgggtaactcctcccacacaaatagtctgtctacccacaggaatattttttgtctgtgacctcagcctatcgttgtttgaatggctcttcagaatctatgtgcttcctctcattcttagtgccccctatgaccatctacactgagcaagatttatacaattatgttgtacctaagccccgaaacaaaagagtacccattcttccttttgttatcggagcaggagtgctaggcggactaggtactcgcattggcggtatcacaacccctactcagttctacaaactatttcaagaactaaatggtgacatggaatgggtcactgacttcctggtcaccttgcaagaccaacttaactccctagcaacagtagtccttcaaaatcgaagagctttagactttaggctaatcgccaaaagagggggaacctgtttatttttaggggaagaatgctgttattatgttaatcaatccagaatcgtcaccgagaaagttaaagaaattcgagattgcatacaacatagagcagaggagcttcaaaacactggaccctggggcctcctcagccaatggatgccctggattctccccttcttaggacctctagcagctataatattgttactcctctttggaccctgtatctttaacctccttgttaagcttgtctcttccagaatcgaagctgtgaagctacaaatcattcttcaaatggagccccagaggcagtccataactaaaatctaccgtggatccctggaccagcctgctagcccatgctctgatgttgatgacattgaaggcacccctcctgaggaaatctcaactgcatgacccctactatgccccagttcagcaggaagcagttagagcggtcatcggccaacctctcaacagggttttcctgttgagagagggtactgagagacaggactacctggatttcctaggctgactaagaatccctaagcctagctaggaaggtgaccgcatccacctttaaacacggggcttgcaacttagctcacacccgaccaatcaggtagtaaagagagctcactaaaatgctaattaggcaaaaacaggaggtaaagaaagctagtcatctatcgtctgagagcataatggaagggacaatgatcaggatataaacccaggcattccagccggcaatggctaccctctttgggtcccctccctttgtatgggagttctgttttcattctattaaatcttgcaactgcaaaacaaaacaaaacaaaacaaacaaaaaaaaacgtggtaccatgctctcctcccccaccagccccaagagtatttccaacagaaactttcttccctgggaacactttgcaccttgggctttgtataaccaggagtaacacattggtgattaacttaagaggtgttttaagattctgatgcttgtttctaatcaaagctttgtattggcatggatccataataattgcatttgtgcttctgagtagaatgctctatcccatccatgccttcccctctattctcacaggaaaaatgactatgctgtgagctactgccacctgggaagcatttacttctgactttgttttaaaactttgtattttgtactccattaatataacatgtaaataataggggacactatgtgaagagggcaaagagatatgtgggaactctctctgtactttcagatcaatattttgtaaacctcatactgccctaaaaacttaaagactattgatttaaaaaataaaactttgcatctgaaattctttgagttgctgttacagaaaatggtcttattggtccatataagtaaaaatgatactttgttaacagggagatatgttcttgtttaaacatgtaatatatctggccagaaactgaaggcatattgagctagtcagtcaccattctaaccacatttgaactttaaggaagaaaactaattagaatgcaatcccctagtttctgctcctgactgtgctggaaatccccacgtttctaacacatagctttgcttctgtattgccacttagagagtatggtgagacacattaaagtctttgaccataaaagcaattaaatactgaaagaagaagggggcatttgaaatgcccttctaagaattatttaaaacatggaaaacaagcttacacttctagctatgatggagttgcatctatccaactcatggtgatagagttcataacataatgtttaggggaaaaggccaaaaagatagcacactgtatgatcccatttatataaagattaaaacgagacaaaattagagtatggcaatataagcctaaatagtgtttatgtttgatgggtggcagacaatgactgagagagggcacaaataagatttctggtgtgctgaaattgggagtgatctcttcttgtctgggtggagatgagagaacagtgttcattttatgtaaattctacaaactgtaaacttactatatgtgcacttggtgtgtgtattagtctgttctcatgctgctatgaagaaatgtctgagactgggtaatttatcaagaaaagagtttcaattgactcgcagttccacgtggctggggaggcctcaggaaacgtacaatcatggtggaaggcacctcttcacagagcagcaggggacagaatgagtgccagtaggggaaataccagatgcttataaaaccatcagatctcatgagaactcactcactaccatgagaaaagcatgggggaaactgcccccatgattcaattacctcccacttggtccctcccacaacatgtggggattgtggggagtacaattcaagatgagatttgggtggggacacagccaaaccatatcagtgtgcatacaatatatttaaatagtaagtaaccaaaacatgtagttagaaataaattacgtgaacaactagacattccctgacaatggaggtggcagaaactggactggaagattctgaaggcagctttcaactgcatttcacttgcccttccataaagcagcagctctccttcagggctatcttccctgaagatacattctctctagctcatctgtcttctatatccaatttggattttgcaacagagagttaaatttattttatcaatttaacccctaagtcaacatattcaaaatcaaaatcttcatcatctcttgcttctcacttcatgaatttcctcccattctctatcacagataagagggtgatcaacttcctcaatgtttaatgtagaaatctcatcctcgctgcaccattatgtgattcctagttgtctctccaaaatcttcctcaaatttatgccctcttctccaaccacattgctttcattttcttttgttcattcattcattcattcattcattcattgtgaagtgtgtagtgcctgcgaggcccttcaagtggggttaaggatcagcagaagcaagttacttctggtccctgataaccaaagcccttgactttcaccaaagccttgacattcccagttgctttctatgtagtctcatgaaagttcccttcccacttctctcctccctctccactgccaccaattcacaactctcttttccagcacatataccctttacatgtgtatatgcacatgcatgtaaaggacatgcacattatttaaataagcaagacaagttcattaaagataatttggaaaatatataaagtaacaaaagggaaaaaatcctattattcatattactgacacccaaagatcgtgtgatataaaatatcatttatttttaaatgatgatcatcttttttagtatacaagtcaaatcattcccctcttttcttagaaggtgtcaagtcattccactgcctataggacaaaagtccttctcatgagcaatcgactcaaagccctttgcagtctaggcacagctgtccagctgtttttctggtgtcttctctagtcccctgcctgtccccaactttgacacatgggtccgtgacactgctcctggttatgggctgtggatactggatcttctgtgttcctgtctctgctcacattgttccctaggcctgcaatgatctttcctgacttcctcagccttgaaaactcctattcacttttcaagactaggttcaaatttcacttctgctggatcccacttgtgtgacacttgtcactgtgtgctgtgattatgagggaggcagcggcagagctgttaataatactgactctggagtcagactgcctgggttcaagtcagatctgtggcctgctagctgtgtgaccttgggccaattacttaatctgtctttgcctcagcctcatgtataagaggataaaatgctaaaactcttctcagagtgtttctatgaggattaaatgagatgatctggttaaagggtaacttagcacaatgccaggtacataatgagtcctcagaacatgttacttcttgtaattgtcagatgtctgcctcttccctcctagactgtgcacatcccataagaaagatttcttacttgaatttgtagccccaccccatgctcagtttggagtaagtgctttataaatgtctgagaaatgaatgaatgagtacatgaatgaatgagtgaatgatctgccaaatcttcccgacatactctcttgctctacatacttttattgttaaaagaaaccaaggaggaaaattgggataatgagaggaagaaggaaggagatgcaagagagggagaaggagaagaagaggacaaagaagaggaataccaatgaattgccactaataataatggtatttgacttttgtttgcacaaaaaaacaggcatcaatcacagtacccaaggctgcagcagcccttttttctgctaactcttcagaacccagaacatattggcccttacacttagtgcaaagctcagtattccattctggcctttggggaaactgagttgtgtaactggttctctacccagagagaagaccctcagatggcagaccacccgaggtgacacatctaaaaggactgcgcagggcccacccgcaaggttccaggacatggaatagaagagtgtgcaccaggcatcctatgcagggcatcagctcatcctcaaattccccaggacagatgcagcgctggatgtgtggaatatttaaaggttcccttgcagctgaagtaccttggcaaaacctgtttttactgactccagatatactggcttctacttctgttccagagtcagtgataaacccccaagaactcattagtactttctagcatgcataaaaggacagtaagcctttgttttgctgattagggaggccacatacatttttaaaaacggattattaagaaataaatgccaacctttgcagaaaaaaacacatttctctctgtctctcattgaaaaccaaggaggccttcagagacttcaccttggcacaggccaggtggtttcaccccaccctgcggggtctggctccaacctggcagctgtttgcaaggacaggccagtcgtcatcaaggccctatgtctctgagcagggggtcatggccattgtgagtcaaaacccacacagagaacactggcctttctgatgctggctgcaccactgccttgcagctttctgcagagccattaaaccatgaacttggaagtcagtcaggccagggtctgaactccagctcctctgcctacaggctgtggcccagggcaggttgcttcatcgctcttagtccgagtctcctcatttgtgaaataggggtaataatagtatctatctatctctcagcgttgtggtcaggattaaagataatgcacagaaatggttccacaagcttgggacgtgagtcacactcggtaaatgatatccattgttattattctttaggaaccattttctcagcttccaggttttttttttttttctctagtgtttccactgagaagatcaaaattgaggctggggaggctgaattgaaaattataacatctaattgttaggagcattttcaatgttccatgcactctgttggtagtatttacatgttttatctcagttaatcttcacaacaacatatcagccaggtactacaatgaaacccattttacaacagggagatccaagggtgaaagaaataaagtaacttatcttgggaaagaggtaaggaaggaaagaaattgcttggtagactgggtaggggtggggtgggagccgttttagaaaaattgtgatggaaaaaagaaagggaatattaagaagtgtctctgtgggttatgaattggttccctcctatgttctttcagaggcacaagtgaagactggaattctttttaattagtagctccatcattgttatgagaccacctaagtttagagggcatagttaaataggaggaaagtactttcaccagaattgcaaactgtgtcctacaacagcacacaaaaaaaaacccctcatattaaaaccaaccacaacaatgacctcaccgtattaagtcctgtgatgcatcctgccatgcagggcacatcctgaaaggggagaagaggcaactaaggcctccagctactcagctacacttaaccacagtaatccacccctaagtttctcctggggcacagttcctttttgttctctcatttttgtcctttctttaataatgaacgtgtgactcagaggtttaatgagttacccggagaagttaaccagaagggaagcccattgagcagaggcataattaaaattgtgaatggacagaggaatacaatcattgtgggagacagggagcacaggaatgactcacgggttaggttgcttagaaaagggcctccgggacttaagttatttctggggaagatctggaaattgaaggaaaaatctggaactcttctacagtcaaaagatagagaggcgagctgggacctctcctttcactcctgaatgatttaggcttgtagccgggactcacttccagcggaaggtgaagaacagtgaaggctgaattccccagggagtcattacctcctctggtgctaacaccacaagtgtctaatgtcaactacttcttggtttggacgtttcttatagcaaattataacagtcaggagaagggaaaaagcaacgacagcatcatactggattttcactctttagcccaaactcagaaatattttgcatctgttgaggcctgacaggcagagaaactaaggaacataagcacacactggagatggggctgttgtagttaacagaaagtctgcatgcaaacttgaggcccattatctgtttcgtgtatgaaacggtccagggtgctgtgagttcttaggagaaatggaggctgatcctaagcaagaaaaacaatactccctaggtcaggatctctgtagagcaccagccacagaaagcactttccacctaggaatctattccaagaatttctgtaactaaagccagttcagatcagccatgctaatggagcagcagtacaacttcatcccaaatatcacatggtctaagtattaggatttattgtcttatttccatgcttgtgttgatgcttgaagagggccaagattaccctctctttcctcctggaatacagaggcaatcacttcagcaatgtggagaagcagcgatgaaaataaaaagagacaggagcccaagttaggtatgaagtttgaaatccatttttaattttgtttgaatataagcttatatggtttttgaacagcgctgggagcaaattattgaagctacaatatgaaccatggaggagaaggagttggaaggtgctctcactttcagatcttgctcatttaaataaatcctccaaactcctttgtctatgctcagagtggacaagaagtgaattgcttgggtggtctaaaagaccttaggatgggtgagaaggagcctaaaattttcttttagtcaaaactatatgtttattttgtaaatatatgtatgcatatatttggaagtgaaattaatatatgaaatgaattatattagcatgaaagggctcagtgatttatttttcatccttactcaatagcaccaaggcagtaatttatatttttactatactttcttaaagtctacctcccactaatctgtaagccactataaacaaaagttaaaagaactgtccagagtcccaaaaaaactaaaagttttgccagaataatctttatacaaataaaacttcattttatcaaataaagtagaataaaatccaaaactgttactatactcatcctgatacaattcccccaaagtcataattctctaagacactgctaaacaagtaggggttagtttctcatcaatagctgtcagtaaatagaaaactattgagcacagccctagtctaacacagtggagctgaaccacttggggttaagtcctggcttccacataaatagcttaggcaagaaaattaacctttctgagccaatcatgccctttatgctctataaaagcatctgggagaacatcatcatgcaaggacaaactgggcagaagaaagaacgaggaaagttcaacgtgcagtgatccctactgtctagattggacatggaaagaaagctcagaactctagtggaggaggatgatttcagaagggcttgttcatggtccagatctattcttagctaaaggataagatgaatacctaaaaggttataatgcaatccaaaaatccttctagatttagccaactctcagtctgaatcactccctgagtcagggtaggacatggcaccagctcccgtccttgaacaatgcagttacctgagtcagaggctattttgaaaagctaaaactgatctacatctggcatttcaagggcaagccaattcacccacatgcaatcaaccacaggtgagttttccttctattcatagatatcctggaaataggcctgaaagtgtagaagaggcaatgtggagaagcagagtttggcatatatggactcccaaaccactatgaactagctctgagactttgaaaagttattcaatctctctaaacacaaaacgtctcatctataaaatgggtagcagaaaagactgcccattttgagtggcacccagggcaagaaagagctgcggcagctcccggctgcaatacaagcagccttgccatttgggccacgtgaccaggcacatctcaaggcactaatggcagctgtggtgaatgaaggtgctgtgtggtgccttgggcatgctccagtagtgcagaccctgagggttcaggagcgagacaatgccattgtaagtaaaggattatacaccattctgaaaacagctcctggtagttattgaaacttggtgaaaactgaacatctgaacatgaaacagcaagtgaccatatgggcagagctgtaaatcttgaactaagtacagtcagatccagcaagtcataaggtcaagaaggcccagcaacaatcctcataaagtagaagaggtacaccccaggtttcacatgagcagggccgggggtcacaagctgcaggggcagatgaccaggcccacccccactatgtcactcaccactgttgcagcaacccttcttccctcctagatcacaactatggcccattcctggatgacagaaaaggaaaaatcccaaggcttggcttggctcacagataggtcagcttgcctcccaatgggcaaagcttcaggaagcaggactgttcacccactttgcatgaagagaaaagtggcccgtggtaaagacagatgtatacagactcatggacagtcgtgcaaggcttggatggtgggtcaggggcttgggtaaaactagattagaagactgaggaaatggaagtctgtccaagggcatgtggctggacctgtgggagtgggcaccaagtgacatgagctctgtgttgtgtgttaaggccaaccagtgagcactgatgatggaagaggtgcttaactaccactggacaggagacttcagccggcctctgtccttggctatccagggcttatgcaatggctcatgaatggagcagccatgatgacagagatagacgctacccacaggcccaacagcaggagctcctgaattctgaagatgatctagctcctgatgctgctaaacattcaaaccgctagccacaaaagccaattctgagaccctgagatggcaccatccttagaggagaccaactggcttgatggtgacaagttgatttactcccaccctgaaaaggacaatattttatcgtgattagaattggcaaatattccaggtatagatttatttttcttgcctgcaggtctcagccaccactactatccaaggactccaactgactgctatagctgagagtctgatcctgcataaattcacttcagacaaagaaatccaccttacagcaaagaaagtgcacaggaacacatgaccatgtgatccactgctcctgctacttaccacaccatccagatgctgctggcctgatcgagcattggaacaacctcttaaaagcatagttaaggggcaagcttggacataacaccctgtacaggtgaggcactgcccttcgggaagtagcatatactttaaaccaaagccataatatggggctggttcccaagaaacagaatgcataggtctgggaactaaggctgggggacaaagcaggagtgaccccactctttattactcccagtgtcccttgtggaatttgcacttcctacatgtagtaccttatgctccacggggctagagatgtgtccaccaaggaacacagtttttgctaaaattaagttatagctgctacctccaggttgctttaggctcttcattctaagagtaggcaaaaaaactgagttgtcttactggcaagggggtatgaccatgatcaatatgaggaagtagagagactgctacctaatgggagcaggaaggaataggtatgatgtgatacatatgacgggtgacccactagggtatctcctggtacttcaataaccagttttaactcataaactggcaagtacaacaacaacagcctgataagggaatggaaaccaggggctcagaccccctcaggatgaaagttgggccagaaagtccaccacactagccacattggttagccagaagtgctagccaagaaagaagaatctagaaagggtagcagacaaggaagatgatgagtattagtatggcctcaggaccaactgcaaccatggagacggtagtttgtcccaataacccaaaaattctgaccaagaagaatcctgcagaagttatcagaagatagagtaagcttacaatgagaaacaagtggttcttaatggtacaagcagtagctggtagcagaggcaacagttgccttaactagagacatctgagaagtatatgctccccactcctcccccaagtgtcacttgtgacagactgatacaggggaataagagttcaactcccttgcctcaagacaggacaacctgtatggcacatctcacactctagagctcctcgaaggattacactgaagccagacttcttctaaaaccacattttttcctagtttcttctctgtcctatactgctttctccctctgttggaggtttttcctaagagcaatcccttaataaacatcttgcacaagcttcccatctaggccctgtttctaggtgcccaagcaggatccacttttgcacgcccacagtgtttacagccccatacgaagtgctaaaggcatatgagagtttgaggtaatgtttagccaatatccactctcctccccctccactgtgggcagaaaatacttccctgccccactgtggcagattgttctttccaaaaatggctgcaacactatctctcatccctcatgtacttttcacaatgtgaccttcatatccatcccatggagagttgggatccatgtctcttccccatgaaagtgagcaggtttttgtgactgtttcaaccaacagagattagtagaaatgatgccatgtgaatttccaaggctggtcataaaagacaaggtaccttccacttggtcctctgcaacaattgtgccaagttctaacattccttgtaagtggcctgatagtcctaaagccaccaagctgtgtggaagctcaaatgagttcatgcggggtccacatgaaaaagctgagagatacctgggcagctccctgcaatgccagctccaaccatcatcagactgtaactgcatgagagactctgagccagaccactcagctaagccccacctgaatccctgacccacatcaatcaagagacacaataaaatgattgctattattttgagccactaaattccagggaatttttgccatagcaatagtaaccaaggcacccaatgacagtgagcttcgccacatcactgttttgggtcaatagcacttgcatcttgtatttctgccatcacaatgagaaaagcatgtcttggcacaagcatgacactggtacaagaaaattgagagatgtgtgtagctgacctggaaaaaacctgcaatctgggccagcccagcccagatcagccagaccttagccaactgccttgcagatgcataaatgacaaataaatgctcataactgtacactactgcaattgtgtgggattgcattgttgttatgcagcattatggtgataactgatacaaggagaaatatgaaagcgagagaaaacattccctgattccaagaataggatacttcttaacttgtaattaggtgggctttatgcttattatcaataacattgtccaatagcatctctatcccggaaaataatatcactctccaattagtaatactggtcccttttctgaggtcctaaatacataagacaaatgacttcacaggttttccttaatcaggtgcctttggcacctcaaaaagaagacaatggatagatagaaaatattcccagcaaacattagctagaattagaggcaccataagccaagaattaagttacaaacccctgaggtaagagatcagggaatcccataaaaaattggaggggtactgatgcatctaagcagtacattagggttataagtaaaaaagcttcaagagattcacttaagccagaaatataggaaaataaactgcaatacaaaagaggaaagggcaataaatatttaccaagaatgctcaggaccaaagtgggaaaccaagaaaacagaagagaggccaggcccagatctccagatcaaaccaaacctcaaaccagagcttactcaggtcagccttggccaaaaggatttgacttttcctggaaccagtggtttgaaaatcattcatagcacataaagaataattatcgcccagtgtcttttaaaaatggaatacaagttgatcaggaaaaataaggaaatgtcataccaaattactcgacaattcatatttggattttcatgttaatttcgtaaaacacatgtcatttgtgaacttactaggtactccctgggacgtcactagacattgagtgtatgaaagttattatgctctttctctggttcaaaaagttggaccagaagggatgctggaactcttactcatctttgaatggctttggggatactgacttgattctacattcaaattcacctcatcacactaaccagagtggcaaaggtgttgagaatatcaaagtctcttggaaagacaataataaaaaaaatttctgaaagaaagatgtactagagccccaccgaactcaagccaagcattttatcactactaccctagaggttgaggtacacaaaacccattgttgcagggtttttgaacaacagtacaagtgacattttgaaccagataatttttcatcatggagacccgtcctgtgcattgcaggttgtttatttagcagcctccctggcgtctactaactagatgccagtaacaccttctcctcacctgcagatatcaaaaccaaaagttgtttttttttgttttttgtttttttgagacggagtctcgctctgtcacccaggctggagtgcagtggcgcgatctcggctcactgcaaactctgcctcccgggttcatgccattctcctgcctcagcctcccatgtagctgggactacaggtacctgccaccacgcccagctatttttttgtatttttagtagagatgcggtttcactgtgttatccaggatggtctcgatctcctgacctcgtgatccgcctgcctcggcctcccaaagtgctgggattacgggcgtgagccaccgcgcccggccaaaagtttttccaaacattgccaatgtcccctggaggcaaaatcactccgagttttttatccttgcgatagtttgctgagaatgatggtttccagcttcatccatgtccttacaaaggacatgaactcatcatttttcataggtgggaattgaacagtgagaacacttggacacaggaaggggaacatcacaccctggggcctgttgtggggtggggggagcggcgaggggggagggaaagcattaggagatatacctaatgtaaatgacgatttaatgggtgcagcacaccaacatggcacatgtatacatatgtaacaaacctgcacgttgtgcacatgtaccctaaaacttaaagtataataaaaaaaaaatcactccaagctgataaccacttcattggtggaacctagccttaaagggccagcttcctaagcatgaagaagcaaaatgtctttgggatgtaagcagataaccaatgggacaagcttatattaaggcagtgatccaaactttttttctgccgaacagattcaagttcacaaacagtcactcccggacatactcagattctgacgtaatatgactagagcttatataagctctactgctttattctgacccaagaaagagtattaaaatgcaagtgagtgaaaatgaaggtgttatggattgaatggtgtccttccaagaagatatgttgacgtccttcctaacgcccagtcgttcagaatttgaccttatttggaagcaaggtttctgcaaatgtagttaagatgaagttattaaaggaaaacttgtggaggaggggccaagatggctgcctagaagcagctgcagtcggcagctcccactgagaagaacgaaaatggcaagtgaatcctgcaccttcagctgaggtatctatgttctctcattgggactgactaggcagttgatgtgacccacgcagagcgaggaaaagcaggctggagcaatggcccacctgggagccacacggggaaaggggagctcccagccccagccaagggaggcagtgagtgattgtgctaccccacctgggaaaccatgctttttccacagatctgtgcaacctgtggatcaggagatcccctcatgagcccacacaaccagggtcttgggtcccacacacagagctatgcagatgctcagtggccactggcagcaggctggagactgcctaagatgaccaagttcctggggggaagggcagctgccatcactgtggctttagactgccatttttccccactggtgccggggagactgggtagtttggaccgggaggaattcccccacaggtgcagcacagcagctgtggcagatcatggccagactgcttctttaggtgggatccagatccattcctcctcaccaggccagaatgtcggcaattccagcaaggggtttaggacaaaactctgatctccctgggacagagcccctggggaaagggatggccacagtatctgtggttcagcagacttactctttccttcctgctggctctgaagagtctgggcagtctgggcaagcgggattcccccaagagcagtgcacccgttctgccaaggggcagccagagtgcttcattatgtgggtccctgatcccatgcctcctgactggtgagacccacccccctcaacaggggtcaccagacatcttatacaggagcattcccactggcatcaggttggtgcctctttgggatggagctcccaggggaaggaacaggcagccatctttgctgttctgcagcctccactggtgacacctctaggggccaaggtgaatagggtctagagtggacccccagaaaactgcagcagccctatggaagaaagtcctgactactaaaaaacaaagagaaagaaacaacaacatcaacaaaaaagatcccacaaaaccccatccaaaggtcagcagcctcaaagactgaaggtggataagcttacaaagatgagaaagaagcaaaacaaaattgctgaaaactcaaaaagccagagtgcctcttctccaaatgactgcaatacctctccagctgagatggatgaactgacagaagtaggcttcagaaggtaggtaataataaactttgctaagttaaaggagtatgttctaacccaaggcaaagaagctaagaagcatgataaaacatttcagaagctgttagccagaataaacagtttagagaggaacataaatgacctgatggagctgaaaaacacatgagaacttcacaatgcaaccacaagtatatcaatagccgaacagaccaagtggaggaaagaatctcagagcttgaaggctatcttgctgaagtaagacaggcagacaagattagaaaaagaagactgaaaaggaatgaacaaaacctccaagaactatgggatcatataaaaggaccaaacctacgactgattggggtacctgaaagggacagaaagaatggaaccaagttggaaaacatacatcaaaatatcatccaggagaacttccccaatctagcaagacaggccaacattcaaattcaggaaatccagagaactccagtaaaatactccatgagaagatcaaccccaagacacattatcgtcagattctccaaggtcgaaataaaggaaaaaatgttaaaggcagccagagagaaaagccaggtcacctacaagggaagcccatcagactaacagtggacctctcagcagaaaccctacatgccagaagagattgggggccaatattcaacattcttaaagaaaagaatttccaacccagaatttcgtatctttccaaactaggcttcctaagtgaaggtgaaataaaatctttttcagacaagcaaatactgagggaatttgtcaccagcaggcctgccttgccaaagctcctgaaggaaccactaaaaatgaaaaggaaaaaccattaccagccactaaaaaaacacactgaagtacacagaccaatgacactacgaagcaactccattaacaagtctgcaaaataaccagatagcatcatgatgacgggatcaaattcacatataacaatattaaccttaaatgtaaatgggctaaatgccctaattaaaagacacagaatggcaagctggataaagattcaagacccatcagtgtgctgtattcttttttttttttttttgagatggagtctcgctctttcacccaggccagactgcggtggcgccatctcggctcactgcaagccccgcctcctgggttcacgccattctcctgcctcagcctcccgagtagctgggactataggtgcccatcaccgtgcccagctaattttttttttttttgtatttttagtagagacggggtttcaccatgttagccaggatggtctcaatctcctgacctcgtgatccaccctcctaagcctccaaaagtgctgggattacaggcgtgagccaccatgcctggcccagtgtgctgtattcaaaagacccatctcacaggcaaagacatacataggctagaaatagatggatggaggagaatttaccaagcaaatggaaagcagaaaaaaagcaggggttgcaattctagttcctgacaaaacagactttaaaccaacaaagatcaaaaaagacaaggaagggcattacataatggaaaagggttcaattctataaaaagagatagctatcctaaatatatatgcacctaatacagaaacacccagattcataaaataagttcttagagacctacaaagagacttagactcccacacaataatagtgggagacattaacaccccactgccaatattagatcattgagacagaaaattaataaagatattcaggacttgaactcagctctggatcaagtggacctgatagatatcttcagtactccccacccaaaacaatagaatatacattattcttatccccacatgtcacttactctaaaatctatcacataaatgaatggaagtaaaacactcctcagcaaatgcaaaagaactgaaatcatagcaaacaatctctcagatcatagcgccatcaaattacaactcaagattaagaaagtcactcaaaaccacacaactacatgaaaattgaacaacctgctcctgaatgattcctgggtaaataatgaaaggcagaaatcaagaagttctttgaaactaatgagaacaaagagacaatgtaccagaatctctggaatgcagctaaagcagtgtttagagagaaatttatagcaccaaatgcccacatcaaaaagctagaaagatctcaaatcaacatcctaacatcacaactaaaaacactagagaaccaagagcaaacaaaccccaaagttagcagaagacaagaaataactgagatcagagcagaactgaaggagatagagacacacaaaaaaaacccttcaaaaaatcaatgaattcaggagctgtttttctgaaaaacttaataaaatagaccactagactaataaagaagaaaagagaagaatcaaatagacacagtaaaaattgataaaggggatatcatcacagaccccacaaaaatacaaacaactatcagagaacattattcatataaacacttctatgcaaataaactagaaaatcttagaagaaatggataaattcctagacacatacaacctcccaagactgaaccaggaagaagctgaatccttgaatagaccaataattaattctgaaattgaggcagtaataaatagcctaccaaccaaaaaaagcccagggccagatagatttatagctgaattctaccagaggtacaaagaggagatggtaccatttcttctgaaactatcccaaataacagaaaaagagggactcctccctaactcattttatgaggccagcataatcctgatagagatacaacctggcagagatacaaaaaaaaaaagaaaaagaaaactttgggccaatatccctgatgaacatcgatgcaaaaatccgcaataaaatactggcaaacaaaatccagcagcacatcaaaaagcctactcaccacaatcaagtcggcttcatccccagcatgcaaggctggttcaacttgtgcaaatcaataaatgtaattcatcacataaacagaactaaagacaaaaatcacatgattatctcaatagaggcagaaaagtcctttgataaaattcaacatcccttcacgttaaaaattctcaataaactaggcattgaaggaacatacctcaaaatagtaagagccatttatgataaacccacagccaatatcatactgaatgggcaaaagctggaagcattccccttgaaatctggcacaagacaaggatgccctctctcaccactcctattcaacatagtattcaaagttctggccagggcaattaggcaagagaaagaaataaaggttattcaaatagaaacagaggaagtcacactggctctgtttgcaaatgacataatcctatatccagaaaacaccatcaacttagcccaaaagctccttaagctgatacacaactgcagcaaagtcttaggatacaaagtcaatgtgcaaaaatcacaagcatttctatacacaaacagcagacaagcagagagccaaatcatgaatgaattcccattcacaattgctacaaagagaataaaatatgtaggattgcagctaaaaagggaagtgaaggacctcttcaaggagaactacaaactactgctcaaggaaatcagagaggacaaaaacagatggaaaaacattccatgttcatggataggaagaatcaatatcgtgaaaatggccatattgcccaaagtaatttacagattccatgctattcccattaaactaccattgacattcttcttagaattagagaaaactatttcaaaatccatatggaaccaaaaaagagcctatatagccaagacaatcctaagcagaaagaacaaaactggagacatcatgctacctgagttcaaactatactacaaggctacagtaaccaaaacatcatgatactggtacaaaatagacacatagaccaatggaacagaacagagaactcagaaataagaccacacacctacaaccatctgatctttgacaaacctgacaaaaacaagcaatggggacagaatttcctattaataaatggtgctaggagaaccggctagtcatatgaagaaaattgaaactggacccactccttataccttatacaaaaattagctcaagacgaattaaacgcttacatgtaaaactcaaaactataaaaattctagaagaaaatctaggaaataccattcaggacacaggcatgagcaaagatttcatgatgaaaacatcaaaagcaattgcaacaaaagcaaaaattgacaaatgcgatctaattaaactaaagagcttctgcacagcaaaagaaattttcatcagagcagacagacaatctaaagaatgggagaaaaatgttgcaatttatccaactgaccaaggtctaatatccagaatctacaaggaagttgaataaatttacaagcaaaaaacaaccccattaaaaagtgggcaaaggacatgaacagacacttctcaaaagaagacatttatgtggccaacaagcatgaaaaaaagctcaacaagagaaatacaaatcaaaaccacaatgagataccatttcacatgagttagaatggtgattattaaaaagttaagaaagcaatgctggtgaggcagtggagaaacaggaatgtttttacattgttggtgggaatgtaaattagttcaaccattgtggaagacagtgtggtgattcctcaaagatctagaaccagaaataacatttgacccagcaatcccattactgggtatatactcaaaggaatataaattattatattataaagatgcatgcatgcatatgttcattgcagcactattacaatagcaaagacatggaatcaaccaaaatgcctatcaatgatggactagataaagaaaatgtggtgcatatacaccatggaataccatgcagccataaaaaggtatgagatcaggtccttcgcatggatgtggatggagctggaagccattatcctcagcaaactaatgcaggaacagaacaccaaacaccacatattatcttataagtgggagctgaacaatgtgaacacatagatacagggagggaacaacatacactggggcctgttgaggggagagaggcaggggaaatgagagcatcaggaaaaatagtgaatgtgtgctgggcttaatacctaggtaatgggttgataggtgcagcaaatcaccatggtacacatttacctatgtaacaaacctgcacatctggcacagtaccccgcaatttaaaatgaaataaaattaaatggaagatgagctcattacggtgagccctaatccagtatgattgatgtctttacaaaaaaaagtgggggagaatttggacacagacttaggcacagagggaggactatatgaacattggagcaaccctgccacaagctaaggaacatctagggctaccagaagttggaagaggcaagacaggatccttgccctacaggtttcagaggaagctgcctggccctgctgacacctttattttggatttctggcctccagaactgtgagacaataagtttctgttgtatatagatttgatgtagaaaaaaaatatagacctgatttaatttttaaattggtataatttcaaaacattagtgttttactagctgcaataaattacttgctgtgcagttacaactgatttaagccaccagtgggtcacaacacaatgggaaaaactgccacaccgcagggtattctgtgttgtgcctcagagaaatttgaaatcgaatttataaaagttattcacttggaccacagtaatctggcatctataaaaatgtatacagtctatcaataatcttaacaggattggggagggggtcagaaaacagatggtcaaactactagtggctccccacttcctacagggcaatatccaaactccttagccaagcatgaaatgccctttgcaatctgatcaccgcctattttccagattcatctttgccaaatcccctcacacctgccttgttccatctggagctgatctggtgccccccacccaagtgttttcatgtcaaggtacacacagaagatgataatatttgagggtgcactgggaaaacagacaaagctgtgtctgatgacagctggcttgggagctccagtcgccccagaccccacctggcagcccaaaaggctaaaaagatcaataaattggtaaacctgtacatattcaaagcatctcaggataccaccacacactactcagttaggaagccctattctaaatccactataatccttctctaacctatgatggtttgaatgttgtgtctcctccaaaattcatgttgcaacttaacccccaatataacagtattaagaggtaggaccttttggtggtgatagaccatgacagctctgctgtcatggatgaattagtgccttgtaaaagggcttgagggggcaagttacccttcctgtcccttctaccatgtgaggacacggtgttcctgccctccagaggacgcagcaacatgttgccatcttggaggcagagagcagccctcaccagacaccaaatctgctggtgccttgatcttggacttcccagcttccagaactgtggaaaataaatattctttataaattacctactctctagtattttattatagcagcacaaacagagtaggacagtgcctttgttttcattcaggaagtcctacctctcaccaagttcaccactcctccaccttgcaaactgctatttatccttcaaaacccagcccaatgaccatttcatctatgacgtctttccacctcccctctgctatactcccactgtacccagtaacaagatccatgtcatggtccttgccatgtggggctgccattgcagctggctcacctagaatgtggtcttccagggtccaggaaccattaggagccaactgggcctatagtgatacagcacatatttattgatctcctgttagaggcaaggcagtgggccaggcatagggactcaagggtagacatggacaaggagggtccctgccctcctagagctcatagcccagtgagggagatggacattaaactgccttccatgcaattgattacttcattacaatggtgggacatgtttcaaaagagaagtacaagcatcaataaatgcacataagttgacctgatctactttaagagtcatggaaagcttccctgaagaggtggcatgtaacagatgagcttcaaaggataaataggaattaagtgaagagaaaatgggtgtgaagtaagcattccgtgttccaaaccaagcattctggttcttgacatcttcacatccacaggcctggccaaggcagatgctaaataaatatttactgatttaaattctttgaaaagtttgagtacctttaagcactttttctctgagtgggttcttccaaaataataattattattttggaaactcttttcaataattcaaatgtacaaatatttattgaaacattattatataatgcaagtctcctagagctcaaggcaaaaagatgagcaagaattttccaggcaaagaagatagaagaaggtattccaagcaaagtagaaaccacatgtgcgtgcacacacacacacacacacacacacacaattatgaaagcaagaaagcacacagtgtggtctggaaatagcatggaatttggttctgatgagtaagggaccttggtaaggaacaaagagatcagggtgtatataagttatctattgctgaataagaaattactcccaacaacacacatttattatttcacagtctgtggggtcatgaagccaggcatggcttagctgggcgttcattaccagcttcagggtctcttgcaaggctgcaaccaaggccttggccctgagactctcacaaggccttacccaagatacctgctagagccgcagtcatctcaagatttgattgaggtaggatctgcttccaagaccattcagtggttgtcagcactcataggctgttggcaggatgcagttccttgtgggctgttgggctgagggattcagttccttgccatgtgagcgtctctgacatggtaactggcttcaccaatggaaagagaaagagagaggcagagacagagacagagaggctgctggcaagacagaaattatagtcttttgtagcccaatcacagaagtgatatcccatctctttttctctcttttattcattgaaagcagttcactaggttcagcccatatgcaaggaatgataggagtcagaggtcactggggacccaatggaagaatcggaagaagaggaaacagcataggagccagtggcaagggcagggcaatcggtaagactatcatgaggccccagtgacaggagaccctgagaaagagcatccaagaaaggatggcgtcaccagcatcaatgctggagggaggcctaggagacaactgcagagaaggtcattgaaaatgtcactgatgtcactggagggaattcagtggagggatgtggaaaccagattatgcgtgcaggacagagggcatgcaaggtgaggggacagagagaaaactagtgtcttcaaagaaatggggcagtcaaggcaagagctggcatagagcagcctcttaagaagagattcttaggctggaagagagctggatgcgttcacagcaaggagggcagggggtggaggtagagactggaaaaagccaaaggcacaagagagaaaaggggcaatgtctatttttgtgtaagattcccaaagagctcaggcagactaataacaggaatttagacctggaggggacagagaagacatctggttttcctcctcttccgactcctcagttactgctaccagctctactctgtgcccatcctaggagcagttggttctcttccctcccgttcctgtccaaacccttcccttctaacacttcctctaagctggcttggccactcccatggtttcagcatgctatcacacctggccccagctcacccctctggcttcacatacatccataaccccactccaccccctacacacacacacacacacacacacacacacacacactgtatcctctagccattctgaaccttaataattcttcaaagctgtgaagctctttgtctctggtccctgggatgtcctgtgtgctgtgctctctgcttggaatactcttttcacacccctcttcacatgaccagatctcagcttagatgcaacctcctccaggaagccttcctgaacccccactgtgtaatcccacaggacagtaaactctgaattgcagttgcctttttacttgttggccttctactggacagaaaactctgtgagagcagaggccgtacctatggtagtcaccatagcttcagcatctagtacagcggttggctccacacaaatttattgagagtagcagatgctctggtgcatggccattatctccacgcaacctgcccttcaggactgaggtgaagggctgaggtatggaattctctccactgctgatggctctcagctgagtccatttctgggcattgctccagactgaaaggagctagcttcccaagggccacatcccttcctgagagcagccatgggtccaatgcctactggcacagggatgcaagaatataaagacctggagacctggcccccttgcctcaatttgggacaattatgaggagccatccaagcttccaagcctcctgtgggatcagcaggggcctcactgtgaataacatcacagttcaactgcccccctctacccaatcctgcttccctcattcccccacagatgttgacccagagagcactcctcaataaacctgcaaatctgcctgcaaatctttatctcagagttggtttcccagggaacctgacctgaggctagtggatacacacaaatgaatttgtccaaatcactcccccacagtaagaatgcagcaggaatgcccaccacaatgtttccaggcaagctcctatggtagcagatagtgggccttcaggagatattgattgaatgaatcaatctggtcattgagcccttgaattcttcctgtgactctcaacacacacttgatgaatctggtttgaattacagtgctgtatttctttggaagtacaaaaaacttgatttatacaatttttatagttcattcagttggttggttaggatgagtctatctgagcacagtatagttgaattctgctgctattgctagaaaagaaagcataatgccaaggccgctctcaaaggacctttctttagacctagtaaaccaagactgaaggcagaggttccagaatgggtgatatggaccagaatcctggtgctacttaccttgccagggagcacataaagagagtctgtggtggccaatgtccatggagaggtgtgcttttggaggacagattcatccaggagtgggtgaaccagcacagcatgttcagagatcaagggccctactgttggctcacgagtagaagaacacccagccagcacttccctaagggcaaaccattctcagccctgaatgtgaacagcacgtaccaaactcagaaattcatctcaaaactagtggtttcatccacttgattgatgttctctttgccctctaggtcaaccacgcttacgtctacatctgtgattagagctatgacccactgaagtcaatggaaaagaaaagagaggataatttttgtgtctattccacgtgtgacttgaaagtttaccaccactcttgccgtacctttcatctgaggatctcctaaatacgtttgtggcgtcattcattaattcctttcacttctctctaaagcactattattcttctcctgagacggagtactttcaggctcagaggggatgagcaattggctcaggtggaagcattcgatgccagaaacacaactcggaactcccaatccttagcctgccttgctgggctagcttgttctggactgcttcccaactacagattcacaaacctcccgtctgttctaattctgcctctaagaattcacacctgagggtgtgacaaccctttctttgcctgataatttatataacatgcaatttccatattttgctatcttaaaagtaagcatgttatacaaatttatggtatttattttcaagcatgttcttagatactgcaattcagactaaatctaaagttatttatcatagtaattcagaactgctgttatagcactaggtttgctgcagatgtaattagttaagatgagattatacagtagagtgggcccctaatccaatatgactgatgtccttataaaaaggggaaatgtgaacatagacacgcactcagggaggacgccatgttatgctgcagtagttatgctgccacaagccgaggaatccgcagaagctgggagggtggaacagaccaccccttgtgccttgagagggagcacggccttgtggacaccttgatttcagacccctggcctccaggactgtgcaaccatacactgctgttgttctaagccacccggtttgtggtactttgttctggcatctgggagactaatacaacagcagtactcaacatatctctaatgtttgcaatgttaaaaccgtaacagtggtcacctgtttataaccaaaagcgaaaggatggacatgagctgagtggtggggagaatgagttggggcctatggagtgtgttataacagcgtgagtggactaaggtggagagagggagagaaacaaggtaaaaataaaaatcagacaaggagttcaggatagggcttgacagggcagtagatgaagggttaggatgagaactattaccttccatggctcctccaactccacaagctagaggctccaggtggttcttcccttgtgtgagctgccacctgctgctaccaccaaataagggaacacagctaccccaggagagaggtgtgccccacgctcccccactccccagctgcttgcttgcctgcctgcctgcctctcagcctcaggaggtcccacctgccagccgccggtggagggagcaggtgcaggcagaggtgagtgtcacatccccccatctctcctgcagctcccagactgattgatgattaaacctgagcatgaaagaggaagaggactaggaagttcagaaaatgtcactcattcatcagaacatctgcgaataaagcagaggtctgaggagtaatatattccttgaaaagctgcaacatacaaggacagtgctgtgagaggaccagatgctgtgagacccacagcataagtgacacattccatgtttccttccaacacccaaaggcacaatagtgagactggcctgctgtgtgtgtcccactgtctgattcctccagcaatcctgcctttccctgaccctgctcatggtaatacacctcacgtggatgcttcagctctagagtcaaactttagaagcatgcaaagatgtgaggtctacgaacatcatgtaactggggaatcacctcaaacaatttcatgtcaagtaaaaaagaatcaatcataccaataggcaatgtctccgtaataaaagaactgaatagttcctcctagaaactgtgtctgccaatactttttattcctacttttttttcccattaagacccaagtctatgtctttactttctggtctaaattatagaatgtattagtttacaaccaaagtgagcacttcccttacttggctggtgcctcagcctctcaggaaggtcctaaggaatccactaggttggaggttctcaacccttgtggatctccaagctgagaaatacaaccccctccagtcagcagctgtgggcaacagctgaactgtgtcccccaccccccaaattcatatgttgaagccctaagccccgatatgactgtctttgtagataggggctttaaagaggtaattaaggttacatgaggacataagggtgggtccagtacactggtgtccttataagaagaggaggagacaccagggtgcaggtgcacagagaaaagaccacaggaggacacaggaggcggctgtctgcaagccaaagagagcagccacaggagaaaccaacttgtaacaccttgatcttggacttccagcttccagaacttcgagaaaatggatttccgttgtttaagccacccagtctgtggtattttattacagcatcgctagcaaatgaataccaatggtaattttcaaccttcattcattcactcagcaaaggagcagccactcagtgccaggcactcttctgggtactaagaatacagcaataaacaaaagagacagagccatggaggaggagaagcatgggagccttcctaaaatgcaatattagaatcttctgctggggacaagtagagtttgaaaaggtatgcatgcaggatctagtttagacttcaggagccaccttcccagtccttgcccctcacccctgccccaacgatcactgcaccagactgacgtgttgaggacaggaactgcattgtcatctttttaaacagagtctgggatgcaggcaatgtcaagaaggcatcctctcttccctgtgccagggacccgattccccagcacccctgctttcacctgaggttctcagcacagggcacctgcaccagcaacatcagcagcccccaggaacttgttagaaacacaaattctcaggccccacctctaccctcttggatcacaaattctagggacccagcccaagcctccaaatgattcttaggcagatgaaagtttgagaaccactgttatccaccctctggcattcaccctgacccacaacttggttctcgctgctctcctcctcctccttctcataacagcagcaatctgtttcttctgccttctgtatgcctggcccggtgtgagacattccacatgctggctcgaagaccatcagtactcacaaggttgagaaaatcatccccatttactgaggaggaaactgaggttcaaagaggcttagtcacttgtccacaagctctcagctaagtaatgggatctggactcaaaaaggccaaagtgcacactttttcttcaggcctttcctatttcactgtcctgttctctctccctattactgtcactcactctattttcttttctttttttgacatatcattgcaccacacaataatcagctcctacctggtctaatgggaatcagctcacctgagccttttgtgatctcatatccagggcttagcaagagccacattctgaaagtaacactggttgatttctgtgtactcagaaggcccatttacactttaacatgagccctccttccttgctgcatggtgcattactaaattccctatagatatttgggaaaatttgatattcttcccttctttataggagaaaaagtatctactataaagaaagaaactaaaaacagtctgctactagttatgggagcaggaatatgaatactataaaatcatattttctattgccattttagacttgcatttggggagcagaaaggtctgagtgaatgaatctgcagtctggtgaaggtgcaatgcctagcaaagaagcaaggcagggctttgtgtctgctctaagccaatctttaagaaacaatggtatgtattggaaggatgtggagaaacaggaagactctgacattgttgacagtaaggtaaaatggtgcaaccacttgggaaaacaatttggcagtttcttaaaacgttaaacataaaacttaccctgggacccaggaattccctagtaagtatctaagagaaacgaaaaaatatgtccacgtaaagacttgtaattgactgtttatggtagtattattcataatagccaaaaggtataaacagcccaaatgtctatctactggtgaatggataaacaaaacaagggatattcatccaatagaatacagtaggtagtataatgaaacatactgatacatgctacaatgcgatgaatgtcaaaggcattctactaagtggaaaaaaagagacacaaagactacctattatatgactctatatgaaatgcccaaataaggcagatctatagcgacagaaagtagactagtgattgcctgggtctggggatggggtgaagattgcctacaattgggcacaacagatcttttggggatgacggaaatattctaaaactgcaatgtgtgttggttgcacgactctgaaatcattatattacacaattaaaattggttaattttatggtgtcaaattatacttcaataaagttgttattaaaatggggaaagggtgtgaatggaaccgtctgagggccatgggctcgagctgtttgattcagtataaccaaggcttattaaccctaaaccacatgtcagcgacaagaagtagcaagctgttttcttctttgataaatcccttgacagacaattcagaggaacagtctccttggagcagaggttctgctgccaagcaaatactccatgaggaatgttaggaggatgggcctgctggtgtctgggccagcaggagagaaagcaaggcaagaccagtgcaaaccgtgcccagcagggctaaagtgggtatcgttgcacagctgggcaagcttgagagaggcctggctcagaagcacacatcaggattcgcttctgcaaggtgtgggtgagctctggcaagctgggcccagaggcaaggagagaagcaaagtcctccccttgtgagaacagtgagggtggaaagcaaacaacaagaggaagaaggtacgtgtctccaaagggagcaagctcttacagggagcttggcaacatttgcatcagcctggtaaaacatcgaaataacaacacctaaaatagccctataggaaccttgtcagaaaataaaggcaagattcctgaaggactctgccttcatccccacggagctgggaagcaaacggggaaatgcaaaccccatttatagggtcacatttggaggagccggctccgtcgggggcaggagggaggaagtggtggggaggctcagggtgtgtcagatccagcctccccacctctgctgagctggcggctggactcaaggcctgccacgtcttcctgctctgcagtgcactagctgtgtgaccttctgcaaactgggtaaccacactgcctccccaccccatctcctccaaggtaaagtggagattttacctgctgcaaaaagttgggtgaggactgatgagagaatgagggttgataagagaaggtaaggcattaaaggtaaaggaaattgcgttttgttatatatataaacagcttctcactgctttcgctggattcatcattctgggactttctgtcttctacatacttttaaaggtgaaggaagagaagggaaaatgtgaaagacaatattccagtctccactgaatgtgtgggcacttcagtctcgtggcaagttcaggccaaggggacagctgctgaaatgtgggggtccaggggctgcagaggggttctgctgcctagcatttaaaagaagagggaagtaaatatttctgaggtgagtcagtaaaagtaaagaaatgcttacttcttgtaaatgagaaggtggcagatgaacacatgagggaatgggcatatattcatcccacttgtaaaacatacttcaaaggaggtagttccaacatcaatttctttatcgtggtactttataagatttccttgtttgcttggttttaattaacagcaaccatacagcattgaaagcgaagccttatccatcatccacgtcaaaggggctggaaaggtccgaatccacctgaatgacaactaaagtttcgagaatgggaatgcaaaaggggattcaaaggtaacaaaatccttgtccttccattttcttcttccgcacaaacaaaagcagtttaatggcattgatggaactgcgtccctctcatcttccccttgcctgctgttgtactcaaaggttccagaatacatgagcgcagccctaccttattttgatgaacagctacagccacagcagaaatcaacagggtttggagaataaatctgataaatcgtgtccttcaaaaagaggaatttatgtaatgctttcagttttatcttgtatgacctacccatcatgaaactgggaaactgtaatttatttatccagtgaagacaaaattgattaacaggtcagtgtaaatgtcagcctgggggaattaacaaatgtagttccaccgggtcagttcttgcccagtactatttaacatttccattaattacttgccgacagaattggtgatagaataggaggtgtattattaaatctgccaatttttaaaaagtttaaatatgaataggtcttggccaattgaaagacagggagggactatttggtatcctcaaggctctgcctggtacagagtaggtgcctaataaatgttagttgaatgaaacaaatgccaacaatacaaagtctagtgtgagggagtccctagagcagcggtccccaatctttttggcaccagggacaacttttccatagaccggtagcaggggaacggtttcaggatgaaactgttccaccacagatgatcaggctttagtttgattctcaaaaggagtgtgcaacctagatcccttgcatgcgcagttcacaatagggttcacacccctacgagaatctaatgccctgctcatctgacaggaggcggagctcaggaggtaatgctcgcccacctcacaggctgtgcagcccagttcctaacaggccacagaccaatagcagacccctgccctagaggaagaaaaggagaatcattaacaacagtttttattaatatctactataaatttaaagccctatcaaaaattacttacagcaatgaaaccatgaccgatccaaatcaagaagatctagacatcagtaatgcacaaaaatcaaatttaacaagcgcaaacataaagtaaggaacatactcatagttcaaaacatgatcacactttttgttatccttttccttatgtgcaggcagacacacacatacacatacacatgcataaatatatattatttctggaatataaatgagaagaaaaggtatggaggaacaaccaccaaagattaactgtctgtcttagcagaaaatagcaacagctaataaaggtgcagctgggtggagaaaaaagaaaaacagtcatacctaagccaaacccctgaagccacaagtcacgcactcctaagtggccgactcaccagcaagcaggatgggatgggatgtcagagctcaaaagccatcaggataccagatccacctctttctcagctgaggggctcctggagttttgtttggtttgtttttaattaaaaagacagaacaaaaagaaaaaaaaatgtcctgatgataagtaacctactggaaggctccgtctgctacccaccgtccataggcaacagcaggatgtaacaaacatacagcctctcatgtacaaaagggagaattcaagtgatgctcagataaagaagtagaacaatgaagaaaaaaaatccatactcatattttttttgagagagagagagacagcatttcgctctgttgcctaggctggagtgcaatggcacaatcttggctcactgtagccttgaactcctggactctaagcgatcctccctcctcagcctcctgagtaactggggcaatgaaattatgcacttagctaattttaaaacaagtttgttttgtagatacagggtcttgctatattgcccaggctggtcttgaattcctggccttaagtgattctcccactcagtctcccaaagtgctgggattatggacatgagccactgcactgggcccatactatgtattttttggccaaataataaacctggatagaacttttcttgagaaaaaaatgagcaagcagacaatacagaagggctattcaataacaacattttgttatctggagaatatgacctgaatgggggaaaaaagagattgaaactgtcatatcaaagttgacatgatagccctaagggagaagtgaggaaaaaagcaaccaactcagaactcaaaggtgcacaacaaatatccagacgtggaatgcacatttcagaaagcaaagtctgaaggagcactgacttgagagaagggaaaagcaatcacccagaagccagagagaagggatcgaacgtttaaaacacaacccccatggaggacacatggcagagaagtttagtttattgtaagaaagcacactgaccactactagaaagatctgattttgctaatggacagataacagggggaagggctactgctggccacaggatggagagtttagaggtaactctgagacatcatttcattatatatcccacagaccactttcacatgccaggcacccagctgggcccacagaacaaaacaaatgaggctcctgccctctaggggcatataatcttataaagtagcagaaaataaacaaataaatacaatgattataaattttcacaggtgctatgtaagaaataaacaaggcactaagtcagaggactaaaaaaaaaaaaggacctgctttagacagaatggcagcgaaggcccttcccaggggatgactgattgattgactggttggttgattgattgatttttccaaggagacaactttcaagttgagatatgaagggtgggaaggagctagccatgggaagaatggaaaactagttccaggttacgggcacgtgaactatgctaagcatggtgagtttgagaagaggatggattgtagtgagcaagatgacagtaccacaaaatgaggcctaagaaggaggcaggagccaggacatgtagaattttccaggccatagtacagaacatgaagagtctactcttagttcaggctgctataacaaattgccagagactgggtggcttataaacaatagaaattatttctcagagttgtggaggctggaagtccaagatcaaggtgctggcagatccagcatctggtgagggcatacctcctggtttgcagatggccaccttcttgctgtgtcttcacatgccagagagagaggaagcaaactctcttcttataggtgtctcttcttataagggcactaaccccatcatgagggcggattaattaattcccaaaggtcttacttcctaataccatcccattgagtttagggtttcaacatacgaatttgcagggacacgaagatgagttctgctaaatatttcttgtaagtccatgaaaagctgagttcctcctgtttgtcagatctgggggcgaggaacagcaatagctagaaggaggaaatgcccagtactatcccagttagctacaaaggagagtggctcaaaggaggcccttgtcagatgcttgtccatgtctagttggctatggagtagatttgactcctaatactgaaatttctaaaagttttgcctggaaaactttcagtgcaaggctaaacattaagtctcttctgtgaatatgaaagtcagttttaaaaaaaaagatccacccatgttaaacctgtcacagatttagtcaatctatttcaaagttaagatctttatagactaggaggcagccatctggaaagtttgtggagccaagatctagatcccttatccaattacatgatgtggctcaagtcatgctatctgtaccttagtttcctcatctttaaaatcaagggaagagaatgtcctgctctctaaggccctttcagaatctaatatgtagaaaatgtctaaaagatgagagcctgcttatataactatctagctgaatgttcagaagtggaaggaaattttggtgccaaactaaaataaactgctcaggtttttcttgcacaagatgtaaaatattattttaccaaaacattatcatattcattttcataattacaaggcttccatgcataacactgaagttctataagtatttgttgaacaagtggtacagctttactgacattacacttttgtgttgaataggacttttttttttttttttttttgagacgcagtcttgctctttcgcccaggccagactgcagtggcgctatgtcggctcactgcaagctccgcttcccgagttcccaccactctcctgcctcagcctcccaagtagctggaaatacaggcgcccgccaccacgcccggctaattttttgtatttttagtagagacagggtttcaccgtgttagccaggatggtctcgatctcctgacctcgtgatccacccaccttggcctcccaaagtgctgggattacaggcgtgagccaccgcgccctgccgaataggacatttttaacacaaatgtatttattaattgctgcccatttcataaactattaagatactgtccttccagcagagtattaaatgaatactatttatcaaatatatttaaacacgatttttaaaaatatgagttagtattggagacagaagtttgtattctttaattaagaggatctctaagggtaatcaattattctagatactgctttgtattgctcatatccctgatcgacaaatatctgtatactgtactatactgaattgtgtctaaaggattctgagtatctgagataatacacattcatttatacattctgctaaatatttatttagtgcctacaatgtgccagacatcattgtaggtaccaggaatgagcaatgaatgaaacaatgtttctgccctcttgaagcttacaagatagtgataaatctataaacatagaagaattaatatcgctaaaatgaccttactacccaaagtaatccacaaattcaattcctaccacaagtcccatgacatttttcatagaaatagaaaaatcccagcaaaccaccatggcatatgtatacctgtgtaacaaacctgcacattctgcacatgtatctaagaacttcaagtaaaattttaaaaaataaaaataaataaataaaaaagaaatagaaaaatcaatcttaaaattcatatggaatcacaaaagactccaaatggacaaaggaatcttgagcaaacagaacaaagctggaagcatcacattatctgatctcaaaatctgctacaaagctagagtaatcaaaacagcctggtactagcacaaaaacagacatagagaccaatggaacagaatggagagcctagaaataaatgcatgcatttacagtcagctgatctttgacaaaaacgccaagaacccacattggggaagtggtgttgggaaaattagatagacaattgaaattagaccctgtattagtccattttcacactgctataaagatataaagattgggtaatttataaaagaaagaggcttaattgactcagttctgcatggctggggaagtctcaggaaacttacaattatggcggaaggggaagcaggcaccttcttcactaagcagcaggagaagtgcacaaggggaaagagcctcacacttatcaaacaaccagatctcatgagaattcactcactatcatgagaacagtatgggggaaccacccccatgatccaatcacctccctcactcaacacataggaattataggtcgagatgagatttgggtggggacacggagccaaaccatatcagacccttatctcatcccatatataaaaatcaagtcaaaatggattaaagacttaaacataataaactataaaactaccagaaaaagacaaaggagaaaagcttcttgacactggatttggtaaagatttcttggatatgaccccaaaagcacaggcaacaaaagcaaaaatagacatgtgagattgcatcacactataaagcttatgcacagcaaaggaaataatcagcagaatgaaaaaataacctgaacaggagaaaatatttgcaaaccaatcatctgatatgggttaatacccaaaatatataagaaactcaaaccactcaatattaagaaaataaataacatgggcaaaggatctgaaaaggcatttctcaaaagaagacatacatatggccacaggtttgtgaaaaatactcatcactaatcatcatggaaatgtaaattaaaatcgcaattagatattacttcacaacagttaggatagctgttatcaaaaagatgagaaataacaagtgttagtgaggatgtggtgaaaagggagtctttctacactactgatgggaatgtaagatagtacagccattatgaaaaccagtagggaagttcctcaaaaaattacaactagaactaccatatggtccaacaactccacttgcaggtatatattcaagggaaataaaatcagtatgttgaagagatatatgcaactcccatgttcactgcagcattatttataatagccaagatatggaatcaaccaaagtgtccatcaacaaatgaatggattaaaagatgtaatatatattggatgaatggaatattatttggcttttaaaaataaggaaatcctatcatttgtgaaaacacagatgaacctaaagaatattatgttaagctaaataagccaggcacagaagggcaaatactgcatgatctcacttgtatgtggaatctaaaagtcaaactcatagaagcagagaataaaaatggtggtccctagaggatagtgggggatgggttggagagatgctggtgaaaagacataaaatttcagttagatgggaagaatgagttcaagatatctactgtacaatatggtggttatagttaataacaacgtattatacacttaagcattgctaagagagtagatgttaaatgctctcaccacaaaacaaatgataattatatgtgttaatgggtatgttaattagcttgatttagttattgcacagtatgtgtacatatatatatacatcacaaaatatcatactgtacatcataaatatgtacaatttgtatttgtcaatttaaaaaattaaaatctacaaaaaataaacaaggaatcatagagcaatctatatggtaaaaaatgttatgaacaaaataatgtgggataggaagactgcactacacaagaataatattttatagcaagtggtcatggaaggcttcattgataaggagatatttgaacagagttctgaagagagttaagaagttaatcaggaggataactaaggaaagggaaaaaggcagccctagctgccatttctgtccaaatttaccttatctgtgtaggcaaaacaacaacaaaaaaagccatagtttattttaaaattgtattagaccagaagtgacctgaagtactcagcaaaagaaaaaaaaatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcatgatgatgttagctggtgattttgctccttagttgatgcagtttctcctagtctcgatggtctttacattttggcatgattttgcagcggctggtaccggttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgctgagagatctgctgttagtctgatgggcttccctttgagggtaaccctacctttctctctggctgcccttaacattttttccttcacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccacaaatcaacagaatatatatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggatgcattcaaagcagtgtgtagagggaaatttatagcactaaatgcccacaagagaaagcaggaaagatccaaaattgacaccctaacatcacaattaaaagaactagaaaagcaagaacaaacacattcaaaagctagcagaaggcaagaaataactaaaatcagagcagaactgaaggaaacagagacacaaaaaacccttcaaaaaattaatgaatccaggagctggttttttgaaaggatcaacaaaatagaccgctagcaagactaataaagaaaaaaagagagaagaatcaaatagatgcaataaaaaatgataaaggggatatcaccactgatcccacagaaatacaaactaccatcagagaatactacaaacacctctacgcaaataaactagaaaatctagaagaaatggataaattcctcgacacatacactctcccaagactaaaccagcaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggtcagcatcattctgataccaaagcctggcggagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattacgtattgatgggacatatttcaaaataataagagctatctatgacaaacccacagccaatatcatactgaatgggcaaaacctggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctctttgcagatgacatgattgtatatctagaaaaccccattgactcagcccaaaatctccttaagcgataagcaacttcagcaaagtctcaggatacaaaataaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatgaccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagtatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcaataccattcaggacataggcatgggcaaggacttcatgtctaaaacaccaaaagcaatggtaacaaaagacaaaattgacaaatgggatctaattaaactaaagagcttctgtacagcaaaagaaactaccatcagagtgaacaggcaacctacaaaatgggagaaaattttcgcaaccgactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggaagtggagaaataggaacacttatacactgttggtgggactgtaaactagttcaaccattgtggaattcagtgcggcgattcctcaggaatctagaaccagaaataccatttgacccagccatcccattactgggtatatacccaaaggactataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatttcctttgtagggacatggatgaaattggaaatcatcattctcaataaactattgcaagaacaaaaaaccaaacaccgcatattctcactcataggtgggaactgaacaatgagatcacatggacacaggaaggggaacatcacactctggggactgttgtggggtggggggaggggggagggatagcattgggagatatacataatgctagatgacgagttagtgggtgcagtgcaccagcatggcacatgtatacatatgtaactaacctgcacaatgtgcacatgtaccctaaaacttaaagtataataataaaagaaaaaaataaaaataaagaaaaaaaatcctctctggagagaagcatgttatcttaggcctcaaataattcccacaaattattttttaaggacagtgatagacttagcaaaaaaaaaaaaaaatacccgagcagcctaggaaacaatgtattataagcagaagcaacatcagcagaaacagataagccaatgctagcaatattggaattatgaaattgatgcgatttggcgctatgtccccacccaaatctcatgttgaattgtaattcccaatgttgggaaagggacctgatggtaggtaattggatcatgggaacaggtttcccccatgctgttctcatgatagtgaatgagttcttgcgagatgtgatggtttaaaattgtgtggcatttcccccatcactctctctatctctcttgctgccatgtgaagaaggtgcttgcttctctttcaccttccaccatgactgtaagtttcctgaggcctcccagccatgcttcctgttaagcctgctgaactgtgagtcacttaaacctcttttcttcataaattacccagtctcaagtagttatttatagcagtgtgaaaacagactaacacagaaatgcaaactataaaacaactatgcttatcatgttactatgttcaaatatataaagtataagcctatctgcacagaacaaggatctgaaaatgacatcaaagatttgaaaaataacccgagaggctccagaaactaaaagaaaaaaaaggatcaatgactgggtttaacaagagattacacattattagagagagaattagaaattacctaaaatatttcaaagacagacagtaacaaaaaatataaaagaaagtctaagatacagagaggaaaaagtccaacatacgttttattcagagtataagaagggtgagagaatgggcagaagaaatattttaaaagataatcaccgagaattttccagaacaaatgaaagatgttgatcacgagtacccagtgaaaggcccagtgaaacccaatcgcactaagtggaagaaacccactcctagacacatcacagtgaaacttcacagaattatgacaaaagtaacagaagtgagggggaaaagaaaaccagagaaaattaagattaccttcaaagagtgtagttgtcttcccagcagaaacagtggaggctatagacaataaaatgatatcttcaatgaattcaaagaaaacaattgccaatctagaattgtattatcagtgaaagcatctttcaaaaatgagagcaaataaagccattttcagacaaaaactgaatttgctaccagcagacactctctaaaagaaattctgaagaattttcttcatgaagaagaagaaaggtgatcccagatgaaagatctgagatacaataagaaaagcagaaaaagtaacaaagatgtggataaatctaaattaacactatttgcataaaacatcaaaaatgccttgtcagttaaaaaaatgataggaataaaatgcatgacaacaataatttatgatcaggagggaggtaagtggagttaatgtgtcctgggatcattgtatcattcaggaggaaaataaaggtattttgaagtaattttagactttgatgagtgagatatgcctattgtctctttttgggttcatctctttttccttcagctccatcacagcatcagtccaaatcagcttgtaacattaacctccagcagaggccaaaccacacttgcctctaggcagtgagatgttttgccttggttcacgtatcctcacctcctcctctgcctcaacaaatcaccccaaatttactggtttaaaatagccattttattaagctcctggaatctgagggtcagaaattttggcagagaacagcagaaatagtttctctctgtgccactatgtctgtggtctcagcttggaagattcaaagagctggggtccagaggcagtggctcacacctgtaatcccagcaatcaggaggctgaggtgagaggatcaattgaggccaggagttcaagaccagcctggccaacatatcaagacgttatttctattaaaaaaaaaatagctgagcgtggtggtgtatgctgtagtcctagctactggaaaggctataaggttagaggactgcttgagcacaagagtttgagcttgcagtgagctatgatcatgtcactgcactccagcctgggtgacagagcaagaacctatctcaaaaaaaaaaaaagagagagagagacagagctggcagtaactctaatggctaagggctggactcatagagtcccatagagataactgatatatctgacacctgggctggggtggctcaaaggtggggctcctttgagcagctgaccagagcacccatgcacagtttgggtatctcatagtatggtagctggattccaagaggtagcatcctgagaggaaggatgggaggatccagggaatgaacattccaggagaaccaggcttttcctgacttagccctgtgtattaatttcccattcttgctataatgaattatcacaaacttagtgccttaaaacaatacaaatttactatcgtacagtttgggaggtcagaagtctcacatggatttcactggaataaaatcaaagtgtgagcagagctgcattccttctgaagactcaggggaaaatttgttcccttgtcttttccagccacctgcattcctcggcccatggccccttctaccatctttgaaggcagcagcatagcacatcttcgaatctctctctggccctgaaactcttgtctgtgtcttatgaggacccttgtgactacattgagcccacccagataatccaggataatcttccagcctcaagatccttaactcaatcacatctgccaagtcccttttgccatataaggtaacacacattcacaggttctgcagattaggatgtgaacatctatggcagggggagggaacattattctatcaactacaccttgggaatcacatagcatagcatcatgtccacagtaaagactggtcaaaattgtcacagccagctcagattctagagtaggggtcatagacccaacctctcaatggaaggagtgccaataaatgtgtggccatgtggccttggtttgaaactaccacgcctttcctgttgtggctgctccacattggctaacgggggaggagcttcacccccatttttgactcagcaacacgaacatgaaaagagatggacagtccagcagacattgaaagggggcaaaagatacgccatgcagttgcacttcgtgtaaattttaaatagtatcacatacaaaattaataaaccttctctttatgcacagttgaagccaagaaaatcttactttatatttattcctaactgaaaactagactcgaattgtgcaagttttaaattatgtgagttttttaggaatgcatcctctgcataaaatgtgaatatgctgtacttgttctaattctctaaggaccaaaacaccatataacatgaagaaagaaaacagagaagatgtgaaaattacatccaactttgagcataaggattaaagaatcaccaaatgattaacttccctcaaaatacaagtttcccatgctgtttgaattgaaggaatttttttctgttgaaatcaagcattattagtaaacagcagttgtgagaactcgaaggggctaaattgtaggctttgttggaaacaggcctgaatagaacatattagcataaattgtatttttatggttaagctgcagtgttaaatatcaaactgtgctaaacgattgattccatacagctgctaaattgaactacctgttatatcagtttagtaaattgtcaaacttagagaactcagcaatttaatggatgtgtttgtaaaatatccttaggtaccctggcttaacatcaagaaacaaaccaccctcttagagtgttaaaagtctgtctgttaaaaaaaaagattaacaaggggataaatataagattaatttttaaaaggaaagccaatatactataaaatgaacataatatgttcagttcatagttcatgtcaaaaaagttcacattctatcttaattttctctacattaagtattaaataatttttgccttatcactatattatcattcaggacactggatactgaattttgcccagttaaactcacaatcactatgtctccttccacttttgactctggatatttggcatatttaatcaaatgaggggtgaaaattaagcaaaatgatgtcatgtcatgatgtcatactttttgctaaattttatatattctttaggaatactgagcatttcagataggtctctgccttctatcttataatggatgtttgtaaaccacacagcagatatttaatatcctgagaataaataccttgtgtatggcttagttctgtcaaatgtaaaattaagcataaatattagtattgaatgccaaagccaattgttgaaaatcagatcataaaaacccttatttgaggtctattaacaactgaccatttgaaataatcagggattaattaataaatggtttgcttatgtcttttatataacaagaagattgttagaaaataaaataagctatcattatcacttccttcatgtgattttgccactcttattttgatagcatctacataatagagaatcatttttgctggtttttaatacttttctctctctctttttttttttttttttttttttttgagacggagtcttgctctgtcatcagactggagcgcaatggtgcgatctcagctcactgcaacctccacctcccaggttcaagtgattctcctgcctcagcctcccaagaagctgggactacaggtgcatgccactacactgaactaatttttgtatttttagtagagaaggggtttcaccatgttggccaggatggtcttgatctcttgacctcatgatccacctgcctcagcctcccaaagtgctgagattacaggtgtgagccaccacgcccagccataatacttttttctaagtataaaagcaacgcatgccccgtacagaaagtgtagaaaatataaaccaactaaacaaaaaagttaaaatcctccataataatttattttaaacaccctgaatcagattctcattcttgatcattaaaggcaattagaattggagaaaagaagtgagtataaaaattaactcataaaagtgctagagggagatacaggtgattttaatgggcacctctctacagtcccacccccaaaaccctaattaggagaagaccaagttcgcagctcacatcaatgggcattcaagtcagtgccattagaatctcaaagccaggatgattccagaggacacatgggtcacttggacaattgagtataacacactacaaattgagataaatagagaaaaattaaagtgctatgggaacccagaaaggaagggaaaggatctgagcagcaagatcaaagatgattgcagaagaaaaacatttgaatggaactttgaatggtgaacaagccagcaagaacctaagaagtcaaagggaacagcatttcaaagagagggaacataaaggaaggcacagagtggtgaagtccaatatgaatggttccatcatcaggtcacagaagtaccttgctggcccattcttaaagcagcaaaagagtcaagccacgcagcaaattgatccattcttttttttttttcaaacttttattatgaggccatattagggaattctagaaaatctagtgttattaaatatgtccagactctactagtgaggaatcttttaatcacagttgacagaaacccaatttaaactagcaaaacaagtgggaattcattaattcataattgaaaacttagtgtgtagactggttcagctaaagctggacctaggtactcaaatgatctggttgtgtttctgtttccacttctctttctctgctctgcttgtatccacttctctttgcatgttagtgttactctttcctaccatagatactctttccatatcccaggaaaggtagcttctggtgggcctaggccaacatccttacaacttgctaacataaatgaagagaatagtcttccctcagtagatccaggagaagaacccccagggggcacctttgtagcccagattggacaaattgcccttccctaaaccagccactgtaaatggaggaatgtaatactacagctggcccactgcaggtcactgcccatgtgcaagggcaggaggaggcacaagtcaccttcatggacagccccaccaagatcacatgaagtagaggagcaggttcccaaaggagaaagaggaggatgggagagtatgctcagtacatgacagctataactagcacagttgatctgccaggtatctgaggactcccttccatctcagcagtggggatacatcaccataagccccagacagttacttgggaagcactgcagatggatgacagttctcctgcaatatacaatgatgagaaatatactaaagacactttcaaatcagcacccaaaaaccctcctgacaaagatttttctcccaatactcaaaatggaagactctattgaattttaaaatagagaagcagagcaaccaatcgctccccagctcctcccctagtaataagagtcacctgttttagctcttgtgtcttacattagcatatttgaaatctggtcatttaaaattagatcataaatggaacaagcatccatatggcactgaggatgtgccaggcactattctaagtgcgttacatatagtaatacttgcaacaaccccatgaagcatgacctactattatttccatttatggctgaagacgccagagcacagagaggtcacaccacatttaagatttgaatccaggtggtctgatccagagtctgtgctctttaccccaaggttagacacagaacctctactccagataggtcataatgtaaaaatggtgagcaagggaacaggaaaaaagggacacactgaaaaagaagagtctgcaacagaataaataagcagatataatattagtaacataacctagacactgaactgtcagctcagaagcataagtctgtccgcgtagccccaacattgtctatggagggtgtgagcagtctggtttaacaaatccaggttaaagactcatcacactctactggcatgaaaatatcctctccttttccacagatgctgtgcccataaaggcagcctggtgtctggagataacctcactacacagtgcctgatacagtgtctgctacattgtcatgctcaatagtgttcctttaattttccttaggagagccataagagctgaaagactagattcaaggatcaagtatttattgattacctactatgtaccagaccctgggctgggccccgaagacacagcaatgatgagacaggcacagctatgcacccacagtatcttccaccaagcctggctcatcacacacttaagctgaggttaatcagaatttttggcatcttttacaagcagccctggtatctagatggtatacacctgtacagacatactgcttggtaaaatattgaaatattttgtactacttgataaacagtcactgcctaagtctccggggtatctcaccactacccccaccctgccctgaccccactctcaggaaccccaaacattccccatgatccatcaactggggggtagcccgggcctggcaggggacacccaagcccccattccagcatatgtcctgcacttgttctgattggtgggcaccaatgcccctgcctgtaatcactaaaagtagccccaaatccccctttccacaagcttttaactcacacttttctgattgactgccagttctctttagaaacggtaggtctttatttttaaaaaataaaataataaaataaaataaaggagaatcatcagacacacaatgtgacaattagcaactgtctgacaatgactcgctgacgcagaggacatcataccaagatgggaccaaattacctcctcctcctctgccacccactgcagcttctatcagcagataccttcagaacagaggccccagtgacagggacccagatggcccagcaaccaagggaacgggcaggaccttctcaccttccctggcctctcacagacacagactcctgctggctgtgtcagtcgcgaaagagtgcaaacaacaccactcagggagtttcacccatctgcccacatgacacctcggttgctgggaaatccctgtacctgtccaggtgccaggaaagatcaggactggctctgacagagatcttcaaaaaccagactcaaaggtagtagggttccccatgaacactttgttctcaaccttggctgccccttagaatcactcaggggtgcttttaagatatagatgccaggccccagccaattccatcagcagatccagtggggcctgccatggcttaggggactccagatatgggaactgcctccaagggccagtcagatggacccctggggttccactctcctgtacaagtcagtagcccaaaagggaaacatccagacatcattctggctccaggttccccctcccaccctgcccacatgctcatacagcagatggagctttgagaggtgtcccctttccactgggggaaaggtcctgagaataaagggttctggcattttacccgcacatggtagctggacagtaaggacaagaaatacatttattcaaatcctaatatgagactgtgagtttattagcatcattcagtattatcttttagagatttctgggttttttttgttctaactgctaactaatatttttaaatatctagaaattaatatttaaagctgacttctcttttttctttttttttaatttttgagatgaagtcttgctctgttgcccaggctggagtacagtggcacaatctcggctcactgtaacctccacctcccaggttcaagcgattcttcttgtctcagcctcctgagtagctgggaatgcaggtgtgcaccaccacgctcagctaatttttgtatttttagtagagatgaggtttcatcatgttggccaggctggtctcgaactcctgacctcaggtgatccaccctcctctgcctcccaaagtgctgggattacaggcgtgagccaacgtgccccacctaaaaagctgacttctcaaaaacaatatcatacaaaagaataaaacataatataaatgagcccctgttgtttctgagctgttttccaaagcaccctgtcctttactcagcaaagaggtccttgtccgtgcacatcgaagtcgactgacagagccagaagggagaacagtggcgacagaagacaaaccaccttgggagcaagtcccccaggcactccttcctggcacagatcctgaaatcatgcccctcccatgaggctgcccagattggcagcaaaccaggccattgagttcaagaacctccagaggtctcctttctaaagaaggatcacatttcctgtgctgctgacaaggattataaggtgcagggaggtaaaggggccaagtcaataggcaaatgtctttttagggcaaaaaaaaaaaaaaggcactctcgtcacctcaagagtacagtaaagagaaaaaacctcggacatgcctctgggggagacataagcttgagatttttagttaaattaagctgctgttaaatgtgtcgtttttctgtctcacaaattttgccaccaaaaaaaggaacaaatcaatgcaaatgtctcaggttaggtactaaatccgggcagagtgacaaggcatctcatgttgtaggtcacccctccacactgcaactgccaagtaaggaaaggaggacacaacctcactgccacctctcccagcaagtccgcctttgcaaagtggacaccaaccaggtggtggagcaggccccaggcatgacccaggaggaaagaggagaggaaaacaaatcaaggaagcaaatcagagagctcaggaagaaatcagaagcacacatgttcaaaacaggtagagcccacatccatccactgtaggcattctaagccttaatatgtggcaaagacagcaggggctcatgacttctgattttctcagtcaagggcaaaatgtatcctccctattttaataaaaaagcaagatttaattatgtttgcacatccagtggttctagaaataaggaagaaaggggagctttttttcattacttttgtatatcaccgtctttccaaaaacctaacaactaggtgacgtgggcagctgcaacctctctgagttactattgcatcatggggccagaatggttgcttggaaggcaaagggtcagaactgccgaccgcttgagctccatactgtatgatcacatgaactcttcaggaatgtaagttacttatataaagatatgttcccaagcaagttgtcaatacattatacctaaaaatacaccatggaactattaggaaaatcctatcacctattgagcagtggttctcaaagtatggtaaccaaagcagcagcagcagcatcacctgtgaacccattagagctgcaaatcctcaagctccaccctggacctactgacttagaaactctgggggtgaagcctggcagtctgtgtttcaagtcaccattgtgatcttgatgactgctacagcaactcatttagtaagcaaaatagctcctaacagatgtgtttcaaatattagagtttgctgtaaatatgtctgtcgcctagttctaaatcctttgcttcgaacggtcaatatctgtttcagaggggacaggaaatccccacgctggcctccttgctgtcctggacactccaccttagggactttgccctggccattcccgctgatgggagcactgccccctccaccctaccccatacagggcttggcttaaatgtcatcatctcagcaaggctaccctgtatccctgattccccttaccttgctcactgttcccaaagtattttgcccttctaaagatctatataattcacttactaatgtacagggctttctgtatgtctctcaagtggaaagcaagttgctgtcatggcagtctgtaatgcccagcacatagtaggtgtacacacacagacacacgcacgcacacatacatatatatgtatacatgcacatatacatatatatgacacacacatgtgtatatatatacacacatatgtgtatatatatatgtctatgtgtatatatatctacacagatatatataatgaataaatgagtcaggcaaattccaggataaacctttgggtgcacagccttcatttattttgtaaaggctcaaacgatggggggctacctttataaactggagagaagtttccatcgcccatggaggaccccagtgttggttcccatgctgcatctttctgaagatatctgaatggttgataaccttgttttgcaaccaacattcaggaaagagtaagttgctggaattgcactatgaatcactagtgaagatgctgcttgtagaaatctttgctatcagttgaatgcactactcatctgacaatactttctttcaaataaagccttcaaccatgtttaaaaattgcacaactattagaggtaactaaaatttaatacttttgcttctagcttaaagtgagaaatgtagaattgtgccaaaagctgataatctcttcttggctggttcagtgagagtggtttagaagtaaggtctccagtctttcataactagtttcttttttatgattttcctgggaatttccagttccagatatttttctataaaacagttctacacagatagctttaaggtcacgacaagttaaaaatgaatgctgaccattagaaaagatcgttggatcattgctagatgttttcatgcaatcttccccatttcctccagatgataaaaccatatgaagcaaaacttggaaaccaagatatgacagaagaccaagctaaaaactacaggtgtgtctttcagtgtgcatgtgttgcatgtgttggtgtgaggggtggagggtggggggaggctgaaagagacaaggaaagagacagggacgagaggaaccaatgaaataaggtgtgggaaagtaccctgctaactgcaaagcaccagagcagcggttctgaaactctctggtctcaggacctccttacattcttaaaaattactgcagaccccaaagagcctttgtttatggggtaatatctatattatttgccatatcagaaagtaaaacaaaaattactaaaatatttattagttcattgtcaataacctcattacatgttaacataagtaacatattttatgaaaaataactatactttccaaagccaaaaaaaaaaaaaaaaaactgtgaaaagagtggtgctgtttcacactttagtgagtctctttaatgtctggcttaatagaagacaactggatcctaaaatctgcccctgcattaagtttgttgcaatgtcataggtcctgtgacctctgtaaagcttcactgtacacccgtgagaatgaaaatggaaaaggcaaattgcatcttagtattattataaaagtatttttgacctcatggatccctgaatgggtttctcagagacccccagggacccctagatcacaatttgagaatgaccgtactagccaaatgttatcgacttatttcctatttagagaaagataaactgagactgagagagaggaagttctatgatttaccaaaggtcacagcagggagtgggaaggaaggcagcataacttaggctaacttctgatgagtactctcagcattggactatatgtgtttccacgtgtacagaagcttctgcctaatctgagtttttctgagtaataagcacaattatgaaatacaatagagctgagtcagtcaagtattcaacttacatggacttgggtctatgccctctgcttacccccatctccaccacagcagagagagagcctgatcaattgcatgtaccatttcattgcaaaagcacatgccctcgagtgaccgtgaggtagggatgtgaataccccagtccttcatgaggctcactgcagttctcttcaagtgtgagcattttgacatcttgagtgggattctagagattaagacatttttgttcggttggttcagtttggtttggtagcatgtggcttgtgaatgcaagaaacaacaattgaatgggggaacaccagctttaccaagcttattgaaggcagcacagtctctagtgctgcaggtagagtatttgatgggcaatttaaggattttcaagggtaactggctttttgccatctctgaaacttcaccctcacttaggggcaagtcttctgacaaagctgagttccagtgtgatagcaacatgtgagtgatggggaggcttgtgatgacagcagaggcgtctgggtgatgggagaagacactgacacaggtgcaagtgcacactgttcaccagaaatacatggcacttccactggggcttctcagctttgtcggtgccaatgcttactactcagtattctactccataatatgccaatatttgtactaaaatggttatcgcaaaagtaatacattcatttgcttaaaaaaatgagtacggaagagtagagatgtcttactctgactccacccccatgacagtccatgctctagaggtaacatatctgtttctccctttagttcttctgatggattccttcataactcgaatgcacttacatctttatttcttgctgtatcccttttaaaacctcccacgaagactcacctatattccttccacttcatctcctagactccaaatgtgattgataaatttacatcatattctgttattgtattttccatgctttgtttttaaattgactctaaaacataaaaactagtaaacagcactgaaaatatgatggaatgtacagaaccaagaagtctgactgaacccaaaagaacaaaatgtgatcctgtcacatgaaatctgtgccacttgaagaataatgtttcaagtgtgaagatcaagtggactctctgttccttctctccaccaactgctgagaaccaagacacatttttgtttcctttgtatgtggattatgactttgtatttttcccagagttcccaagaagaaaaaaagaaaaggaaaggcatatgcagcatcatacgataaagccattattagttctcagctacacagtttctgtaatggaatcactttctctttgaagacactgtggcttcttctgattgttggcagctgctttctaaatcggctccacaattgttatactgggatttcttttcattgccctactgggttatcatagtttgttggatccaacattttaaccatttcttgatcatttgttgtttggctggagatatcctttaatagttgttctttttttggaaaggctatatgggaagtaaacttcctgaattcttacatgtctgaaaatgttgattttactcacacacttaattgttcacatggctggtacagcagacactactggctgtcacaacattcatctactcccaccccaatacttttcataataacatcttcctttgtacaggtattctccttgtccgtgtgtccacaggcagtggtctacctattacccttacagtgattggtttaggaatagacacgttaaaatttggtaaataagtcttccaggagttctgaataaaaggcattcccattttcctctgcagactgttatttctgactgtggttcctagaactaccgtggatatcttgtcaccatagaggagctagcctgagcacaaagccaacaagctaaggagacgctgcaaaataacagaagaatcaggaatcctgttattatttgtcattattaagctgataaatttaccaacgctggtgatgcccgacctctgaatttcagaaaacgtgagtatagaattattagtttactttcccttaaaactttgaaagcattatgccattgtctactggtatctattgtatcgattactgaagtaatatgtgaatctacttcctatttctttgtgaataatgtcgtttcccctgttgctgagagcttttattcttctctttggtacacacaggtagggagcaggcaggtacatctggaactccaccaccttcaaaggaaactaaggcatttaaatgtatttccttcctagtgggagatgactttcctttttaccctctggctctacccacaggatttcctttttgtctgctgggtctacatcagatattattctgcattgcttccttgccccaatttcatacttttggatgtcccttagcaaatcattcataagtttggaaaaccattcttagaattcaaattgctctatacacatcttagaaaggaaagagctacttagccagtgtgtaacttcattcccagagtattgaaattcatcataatgtgtcttgatctggatctgttctcatttatcctgcttggcactcagtgggttccttttgattgaagaatttgattcttcctttagctcagagaaaaattattccattatttcttcatttcttttgtatatactatgcagatattggaccttctcaaactattatattgtctttttacatatttcttaaatttgccaccttttctagtttctgaaagattttctcaattttgtctcatttacttatttggaatatatcatgtccttttaaaaacaaacaaacaaacaaaacagggtcttacctgttgcccaggctggagtgccatggtgccatcatagctcactgcctcagcctcctgagtagctgggattacaggcacataccaccatgcctggctaattttttttcttttggtacagacaggatctcactatgttgcccaggctggtctcaaactcctggcctcaagcagtcctcctacattggtctcccaaagtgctgagattacaggtgtgagccactgtgcccagccataataacatgtttttcatagcagtgagtcattgttttatttatgtaaaaatctctgaattgcttttaatatctccatatcctctcaagtgacttcttgtttgtttatcttggtctttgtctcttatgttgttgatctccctcagatgtctggtggtccttaggagatcctttatatttgttgctgaaggactgtagattagtataggtagttcatgtgtgtttcctttgtagttaggcaggtctatttgctctgaatgtgagggctgactctagcctttgtgtgcagagattcttctctttggtacatgcaggtagggagcaagcaagtacatctggaactccaccaccttcaaaggaaagtagggcacttaaaagtatttccctcctagctggagatgactttcctttctaccctctggctctaccctcaggatttcctttttatctgctgggtctacatcagatattactttgcagtgctttcttgccccaacttcatacctttggctgtcccttagaaaatcattcataagttcagaaaaccattcttagaattcaaattgctctatacacatcttagaaaggaaagagctacttaaccaaaatgtcccaaggacatctttccagttaaccaccaagaggagggatgtccctgctctttaattcatcccaccccacctccaaggctcagcccagaccactgtttcaaagctcactcttgtcctccatatgtgctaattcctagcttggatcctgtctgaacaaggtctccctcctctgacacaattcttcatttagttctaggacacggtttcccactgaaataacaaactgcaagcccatctagcttgtcttgatgaaatatcttttctacccacagcactgcctgctgttttcagagttgtcacaaattttttttttctagatgcctttagccaccatttcagaagattccaagaaggcaggggaggcaaacgaatgtacttagtctgtcatcttgaaaaagaatcctgtgtacatttctattaacacaagtcaactttctttcaattcttttgacaatgtagagtttcagagtatctggaaaaccaatataatgtggagggcaagggattagaagtgaaaattgatacactgagtgaaatattttaaaatctagactcacgtgtataaagtcaaatatattttctctttataaaaagaattagtttctgtattgacctcctattcccttcaaagttagaagttaaatctaggttatttccaggtaaactcagttacttctgggtaaaattaatcatttcaagcttaacttgatcaattcaagatatcacaccaccatcacccttcttgttagggttctagctaaggtttctcaggcatttggggacatggtgcctgccctggcctccatcaactgccttctttccacctggtcattgcccattggcctctatccctatcaaatcctccaccgattctgtggtcctcatgttggcctcaaagcctcaaggcagaggggtcgcccacatccttctaatctcaactacgagctcctttcggttcactgactcccttattcacaatttcttcctccatctgcctctttgctatttccaaataaattatctatagaccaggagttttggacactgtcctgtgctactctctagtctctaatgaagacatgctaccctgcccttttgcactttcgctggtgctgtaccatgtggacacaaggaacttctctacagggcctcatcctgggaaacaacaagaatgggaagtgacatagggatgtccctgctcctctcaccccacctccaaggctcagtccactgcaaaaaaagacaggaaactaggtatctttccatgaacccactggaatataaaccctggaacatttcctctggttcctccctgtccctgacttaggccatgtttagctagtttacagaacagggtacttttattcttcatctacactgccatgttttattgattctaagatgtagtacatttctttagacatagatgtctcttaaaattgggaggtaccttataattggtgacctctcacatgttatgaatggagtgtttgcgtaccccccaaattcatatgttgaagccctaacctccaatgtgatgttattaggaggagtggcctttaagaagtaagtaggtttagatgcgtcatgatggtgtggtccccatgatggggctggagcccttataagaggaagagcattttgtgggggcctaggtgggcggatcatttgaggtcaagagttcaagaccagcctcaccaacgtggtgaaacctcatttctactgaaatacaaaaattagccaggtgtggtggcaggcacctgtaatctcagctacttggaaggctgagacaagagaattgcttgaacccaggaggtggaggttgcagtgagccaagattgtgccgctgcactccagcctgggagacagggcgagactccctctcaataaaaataaaaataaaaataaagagaagaggaagagactagagttctccctctctttgccatactgtaaaaggcagctgtctacaagccaggaagagggccctcaccagaacccaaccatgctggcatctgatcttggacttccagcttccaaactatgagaaagaaatatctgttgtttaacccacccagtctatgctactttgttatagcagcctgaacagaccaagacattagatgtgatgaaacacatttccaatctgttgttcatggcaaaactttatgccttgtgtattagtttgatagggctgccataaactgagtggcttaaacaacaaaaatttattgtctacagttctggaggctaaagtccaagatcaaggtgttgaccacatttgctcctcccgagggctgaaggaaggatgtgttctaggcctctctccttggcttgtaggtggctgtcttctccctatgtctcttcatactatcttctctgtatgcatggctctgtgtccaaatttctactttttataagcatatcagtcatattggattagagcccacactaatgacctcattttagtttgattaccactgtaatagaccttctctccttaatacagtcacattctgagatactagaagttaagatttcaacatctgatttttggggagacacaattcaacccataacacctcagtttcttcaaagatttgcttttgatgttcaagcccaaactcttccatatgaaaagtcttgctttgtctctgctatgaatttgaaaatacagatatttaaaatctcaacaggagccctacctgtttatttatctttacattcctattataacagtccaaatgcttccagcaatgaattaataacagaataaggggagggccatggggaaattttaagggctggggaaggaagacatctctattaatatttcaaaattttgtacaacttcattaaatcagcccaagctgccaaatgtgctgggtcaaacccatagcagtcttccacttacaaggaatactttaggtgctgctcagaagtctccattttagtccttcccaacagcagagaagcagaaagacaccccaggaattttgaagacataacccaaagcagcttaccagaaacaagaaatttttacatctcctgtttaatccttaaatgccacatgaattttacattgccctccataatattcctctacccatgtatggcaacagcttttacgaggaagaaaaagtcaaaactatttccccccaaagtttcaagcagcatccgggaagatgcacccagtctgtcctatgatttcatgtgcccctggcataatgccccatgttggagaagcacggctttcagtggaggaaacaggaagtttcacagataaaggggttttgttttgttttcagcagagaaagatcttcattttggcactgccaggaagccagtccttttccacccaaaggacagcatttcctgaagagcagatacatgtcccttcccagctggtggagagtctgccaggtggaaaggaaatggcatgccacaaaatgaacaatacagctgcatttaagcaaggatgttcacatcacagagaaagaagggaccaaaggcaagcagggtgagagttcggggaaaggagaaagtcacgcggctccagcacacagcaaggaaggagggggtgcaaagcacaagcaggaggtggggaaaaggcagagaaaggtgagaaaatggatgagctgattcggacttgtggcaaagatcagcaaatctgaaatgatggcgggacaacagagcacaaataaagctgcgccaacaatatccacatcctgagcttcacagagtacctagaatggccacaaagaaataacctcctctattgtaggtccagtgatgccgatctgtcctctcatttccatcagcttattgtgttgtgacatctgctcaggtgaactttctaggcaccaatgaagctgaagttactgagtgatatccaaaattcactctaaatgctatgatcaataacaaatttaggtctgaaaattacttaaccaacccttgaatgaatgcaagtcaatgacaagaattttccctcaaatttaatacgttaaagaagggttccttgttggtttttatttgcatctcttagtttattcagcatcaactctgagtgcattccaggctgggctcctgtacagtcatgtccagaaaggtctcattctgtggctttcatctttccttactccactcacataaagatgagatggcaaacacatctgtgactgtcaggcctgttttggcctccagaggtccgtgctgctggtggtcagcagccctgtggagaggcaaagccagggagaaagtgagacagcttccgaggatcatgcttaaggaaatccccggggctcatggccaacatcaaaatccaaccagcaccaccaccaaagcaaagaaataaaatcagaattcttctatttgttatgaggacaattctcagttttcaagctcaggtatgtaaagaatgcaacttacctgttctctaatcatcttaatttataatgcaaccctctgttagagactaattccatgcaattcaaggtctctcctccaaccccatctccccagaattaagtctacattccagggccttactcagtgagtgccaaagcctctgagccttgcctaaatacaggggcatgggtttcctctgctctctggcatgccagacctgtgaggggtttgcatggtcactgcccttcagaattcagcgtagacacagagcaagacctgcctcctaaggaaccacggacatctgcctttcctccttccctccagctctcctcctctcttctcaccaaggacaatatcaccccattaggaaggggctttaaaggtactaaagaagccttttcttactcatgggcatctttctaaatgttttgtctatgcattgagtcctttggtgccacacaagaaccagactgtagcaaatcaaaagctaagcatcgatttctgaaatccactatgtcacttgtcccctgaggcaatgagtagggaacaccctagctgcctaggcaggggatgtgccatcactaagagaaaccagagggataaaaatctcagtgaataactggaaacagtatcctgccaattctccatcatccttcagctgcctacatggcaatggctacgtctgctttcctttcatgctttgtgccttttgaacctcttgcatcaaaagtctttaggaaaaacatcaaataattagacactgtaattgctggttgcacagggacaggaagaaagggtaaaaggggcctttggctagttacgtggggctgaaacagcatgaatggttcaaggaacagcaagtaatggaatgtggttaagatggaggaggcaagcatcccatttatgcttttaaaaagactatatttgtatatacacatacatatgtgagcaaacgtacagaaaaaggtcgagtttccacgttttattctctatgtgctcctcattgtttaaattatttccaataagaaagtatctgtgttctgtatacaaacgaaatgcagggtgcatatggaaggtcagtgccagataaaggtggacagacaggcagtaaggacaggaaagaaatgctttcattaggagtttgatctttatcatgaaactggtaatatacagacaaaatttaataatcctatttagcatcttctggttattaaatcaacatacactcattgtagggaatttggaatacaaaggtatacaaaaataaatttaaatgcctcagtaatcccccgagagagccagtgttgacattttggtatagttcctactgattttaatacatgcacataaatatttttgactatatgtgatcattttatgtaaatagtttggtgtatattttcccagaattttccaatgaaatatatatttctttaaatgagatcacactacagaaatgttcatcaacttactcttttcatttagcaatcagtatctcctggccatatgacttcatccactgatacagatcaacctcattctttctaccagacatagtatactttattaaacagggtgtaccttatataaccagtactctattcatagacatttaaagtatttccagtttcgatattataaaaatgctttaattactatcctgatatatttatgtaggcaaatatttcctaagataaaattcctagaaatgtactgttaggtcaaatagtatgcacattttaaagtcctccaaaaatgctgtagaaacaaattattctaataatcaaacatgagagtaccctttcaccaaaccttagcaacactgagtattttgtatcttttaatgtctgatggtctgactggcaacacataatacattattattttataaatattttcctcatgttgatatttatttattaccattttaattttcttttcaaagaaattttttccaattcatgtttctgagattataaaaaaaaagttcatccatgtttaattgtggacctttcattttatatttaaatatgtaatctagctgtaacttactttggtttaagaattgaagtaaggatccaggtttttttaaataaaaaatttaatgaagtataagatacatacagaaaagagcacaaggcatcattgtacagcttgatgaattttcacaaaataaccccatcccataccatacacccagaccaagaaaccaaatatgactcacaccctaaaagtccccttaattcccgcttctagtcattaccacccccaggtaaccactatcctgatttctattaccagagattagtgctgcctgtttgagtgtttggcttctttttctcagcattatgtttgtgacatacgcccatgtttttgcatgtgattatagattacatattctcatttctgtatatattccatatattgatttatttatctattctactgtctttggatatctgggttgcttccagtttgaggctattatgaatattatgaatgctatgtaccttcttatatatgtcttctggcaaatatatatactacatttgtttgtcatatacctaggagtggggaattgcgggtacagagtgtatgttcagctttagtagatactgcccagtagatactgcccaacggtcttccataatagctgtatcagtttacattcccaccaataatatatgagagtctagttgttccatgttcttgtcaacatttggtattgtccgactttttaaatttagccattctgaagcatatgtagacatacctttttgtagatttaatttgcatttctctgacaatgaatgcaattgatataacttttaacatatttgtaagccatttgaacattctctgtgtaaagtgttttttcaagctttttgtccacttttcttttgggttacttgcctttctcatattgatttgtagttatttatagtatcttctcctactctgggcttgctctttcattcccttaatagtatcttttgatgatcagaatttcttgagtttagtttaatctagtttatcaatattttcctttatagttagtccttctgtgtaatgtttaagaaatgtttggctattctaaggatatacagatattctcttatgttttcttttaagagctttattgtcttacctaatatatatagacctacaatgcagctagaattgatatttgtgaatggcttgaggaagattctttttttcccgtatggatactaaattgagtcagcactatttattgaaaagacatcctttctctactgtattttagtgtcaactttgtcataaatcaagtgatcatataaagatctctttctaaattctctaatctgttccattgggcttaaggaaacaggaatatgtcaccccaaaatatgcctctgacataaaaattactttttagcaaaaggcaattaagaagcagtaaacagagaaaaagctcaccctatcctaccttctgcctacaggcaggatataagttctccttgactagagaaaactctagactctttatcagcccatagacagcatcagaggaacctgaaaataaacctcactccattagtttcctcccatatatttaccttcccatcatttcccacccttggaaacctaaaatcttttcatttgtcctttcatttgtctacaaatgtattgctgtttgttgaagatgctatataagcctgagttctaagccattgctttgagatacttttcattaaagtttgtccctcatgatgtgtgctacacatgttaattagcttgtctgtttttatcttgttaatcttgtcttttgttacaggaatctgtctcaactaagaactcatagaggttgaggaaaaattatatttcctccccaatagggccatttgtctattttagcacagatgccacattgacttaattacaatagctttataataattctaaatatttggtgccataagttatctcagcctccttcatattcttaattattgtgatggcttaactcggcccttttcttttccatgcagattttatattcagtttgttgatatccatttaaaaagcctgctagaattttgaatggcttgtataatatacaaattaatttaaggaaagttgacatcttcacaatattgagtcatccattctatgaacatggtatatctttccatctacttaagttttcttcaatttctctcagtatgtcttcttgttttcaatgtagaaatcttacatctctgtcacatttattcctatgaattcggtgttttctgaggctattgtaaatggtattgttttttaaatttcattttctatttttattgctagtatatgtaagtataattggtttttatatattgacctggtatccagtacccctgcttaaatttacttattaattctaatagtttatctatagattcttttgggttttctatatatacagtcatgttgcctattgataatgacagttttatttcttactttccaaaccatatactttctatttctttctcttgccttgctacaatggctaggatctctaatgcaatgctaaattaaagtgatgctagcagatatctcaaggagaagactttcaacatttcaccatcaagaatgatgtttaagatatttttaggcactcattatcagattaacaaatttcctttgcttaggctttttaaaaatcataaatcaacactgaattttatcaaatccttttctacatctatgtagattgtatgtatatttttactcctttattctgttactacaaggtattatcttgatttattttcaaatgttaaactactcttgaattcctaaagtttatcccacttggttataatgtattatcttttttatgtatcactaaattcattttgattatattttgcttagtatttctgtatctatgtccaggagagtttggtctttaattttcttttcttgtaatgtctgtgtcagcttttgatataatgttttttcttgagaatgagctgggaaatgttacttttttttctattctctgaaagagtatgtaagattgatgttattatttattttaagtgtttggaagactttaccggaaaagccatctgccccagaaaatttatttgtttgtctgctgtttgatgcgaaggtctttaataatgaattaaactctttactagatatagctctattcaggttttctatttttacttgtgttagctttggtatatcaggttttttggaatttgtttatttcatctaaattgtcaagtatgttggcaaaaactgttcattatatcctcttattaagcatacatcttctcctaaaatgtctaactagttttctcaaaaccagtcattggataataaatctcttacaaaatgatatgctgtgctacctctatcatataaaaatttcatttaataagtcattcaaaaatatgtattggctcaaactatacaccaggcattattccaatgttaggaatatactattaaagaggacaacattcctgcttcatggagttttcatttaatgagaagaacagacaataaacaaaatagtaataagtgttctaaagaaccaagaaaggttagggtctggggaggtggaaaggaaaggccactttgaggagaacctgaataaggtgagggaatgagacatcaaaagatccaaagcaagaagtgtaaaggccctaaggtagacatgtatttggcatgttgtaggaagaatgaagaagccagtgtgactgtagcagagtgagtgagagagaagcagagatgattgagaaatctaggcagaagtcagattttgcagggtcctggagaccatggtaatgatttgggatattaaaaatgtcatgggaaaacactggctttgaacaagcaagtaacatgatctgacttgtgtttgaaaagactgttctaacgaatgtgtgtagaatagaccataagggggaaaaaaggaagttgagaagccacttagaagctattacaataatccaagcaagagatggtgctggcttggactatgttgggaacctacatatctacttacctcctataaggagataagaagtgctcagatccaggctgtgttttgaaggtagaatcaacaagacttgctgatggcctaaatgtgagagttataggaaagaaaagactcaagggtaacttctaggtttttggcctgggaaactgagtggacaatgctgccattttatgagcctgagattcttaggaaaggagcagatttagggtaagggggggttgggagtcaggagtttggtataggacatgttacacttcagatccgtttatacactcaagtggagaatcttggtggacaagtgaatatatgggtctgaatctcagaagaataacaaaaactggaaatataaacttaggagtcatgtgcaaacagatacatcataccacaagactgaattcattcatctaagaatagataagaagtctagggcctgagacctgggatactacagaagtggggaagagattcagagcaaagactgaggaatgtccagtgaggggaaattctcacgtgtatatcagtctgtttctgaattctttactctgctctcctgatctttctgtctgtctattcttctgtcagttttcattcttcatttcaaatgacaaaaccaattcaaactggcatatgtactaaagaaaaaccaggtaaccaggtttagtacaaatggggtcacctggatgcagtttctctccatctgtccgctatgctctcttccatggtggcttcatctttgaaccatcatcttaacctttagttccaggtaatagcaacagggctggggccccacaaccaggagaagagcgaatgctgctgggtagcaaaatccacagatgtctggcacaattcctctgccaaccccaaactggcttaattactttacttacggatacatttatcataactagttaggcttttatgttcacatcactactattctttctcagaaaatttccagctactcattcatatttattcttaaagaatctatgcttctaatctgtctccttccactctgatgagattgccctttccccaaagcaccttaaatttttatttcctacaaagcatccctcccgtgggatgcttgcttccatgctctcttcctgcccataaacttaccctccttcaatacatagatcaaatctttcctcctgcatgatatatttcccaattaccacatctggaagtgttatctctgtcctatgtatggctatagcataaatagcattatttaaatggtccagatttgtcaagtattttttcatatttgtcacaatctcccaagtaggctgtaaactcctttgggaagagactcttgttttatatttctatatattcttctcagcaacctgcacaatcctgaacacatagtttctacactaaatgcatatttttaaacaattgtctggttaagtcaccacttttatatatctcttcttttttctctaaggaatgaacagcaacagaagaaagcaatagaataatgtttgtggtttatgatgtggagtcttctctgtaggtaagtatccatcatttgggaatggttgtaagtacttaaagtatcttgggtgctgcagctttgattttaggcactacagaacatggtgagatataatgatgaataaaatggacacagtccctgtcctcacaaagctcacaaatttcttttccagtgttgtaacttcttattccattattttcatagtagtttttcttttaaaatttttctattttagtgtaataaattttctcagctttgatttatttttatttatttattttgacatagagtctcactctgtcgtccaggctggagtgcaacctccacctcccgggttcaagtgattctcatgcctcagcctcccaagtagctggaattacaggcatgtggcaccacacctggctaatttttttatttttagtagagacagggtttcaccatgctgaccaggctggtctcaaactgctgacttcaagtgatctgcctgcctcttcttcccaaagtgctgggattacaggcataagccaccacacccggccatcaacctttttttaagttaatgtttttggaattttatttaagcccttccctacgcagagatcatgaagatattctcttatattaccattcaaaatcttccatttttttgctttcatatttaacttttaaaagcccattgatatggtttggatctgtgtccctgcccaaatctcacatctaatcataatccccagtgttggaggtggagcctggtgggaggtgattggatcatggaggtggatccttcatgaatgaattatcaccatccacttggtgctgttctcctgatagtgagtgagttctcatgagatctggttgtttaaaagtgtgtagcacctcccgccattctctctctcttgctcctacttgggctctgtgacatgcctgctcctccttcaccttccgccatgattgtaagtttcctgagaccactgcagaaactgagccgatgccagcatcatgtttccagaaccatgaaccaatgaaacctctttcctttgtaaattacccagtctaaggacatccattgcaattgatttttatgcattgtgtaaagtgatagtcgaattacatatttttcatgtcatatccatgaatcccagtaccatttattggaaagtttaccctttatctgtagtgtctccttcgtaataaatccagagtctgtaaatgtaaagtagtgtttttgggctttctacttcgttctgttggactctttgtttatccttgaatcaataccatgccattgttattacaatagctttataataagacatgatatccatacagcaagtcctctgacttagttctcctttaaaatgtcttaggtattctaatttgaaataactatgatcatggatatttctcttcctctttgtggttctgtcattttcttctctatatattatttagttgttaggtacatatacatttcaaacatattttccttgtgaacataattttttatccctaataatgtttttaatcacaatctctactttatttgatacattgcttattatttgacagtatatagttttccattcctttattttcactctttctgtggtcttatgtttccaatgagtcttcctcaactagctgggatattaaataccctgcttctattccttttgtgcttattttagaaatggcagcatacattgttaatttatcagcctgaagatagtcattatctttactctccttccaggtaatataaggaccttagaatgctcttgattctttttaccccctttcttaacttatatgctattgttgtctttcatttctaaatattttagcctgtaagatattaaaattttgtttatgcttcattgttcatctatatttacattcacccacatggtgatctctttataaaatccttaattccttatagcatctcagctttttccatctgcaattgctttccttctgcataaagtacatcaattaagattgccttcagtgaggcaaagtcactaaagtggtggcaaactccacattgttctttatatgaaaatgttttcattttgccattattcttgaaaggtactttgtgcatataatcctaagttttcagctatttcagttacagatttattctactgtcttctagattccattgatgttgagaagtatgtaaaatgctctttccaaagtcatatgtctttttgttgttgttgttcctgctagaattttctctttgccttcagtgctctgcttatgaatttttggcttaataaatttgatcaattctggaaaaagctcaagcatcgtctccttgaatagttgtttctgccccattctctttcctctcctttccaattaaatgcgtgttagatcttctcactccagcttccatgtcttttagcctctctgtcacattttttgtctttttgtctccctgtgcagcatctgaataatttcttatgcctcatcattcagttattcactaatttctttttgattttgtcatatgtgctgtctaatgggaaaccactacattttaaaatttcagttttatatttttatttctagttctgtttaaccttcttaaaatctgccaagccacttttaattgttacccattccatgaaggtatttataagggtacttttatttctatgaacacaataagcataggtttttatttgtctctgtactcataatacataaagaatttgtgagtctggttttcttttattctattcattgcttctgttgtttctcgcatcacattttgtttccctgtacgctttgttatttctgactgtactgctcattgacccttgaaaattaggaagaaggtgccctcctccggagattcatctttgattctgccaggtatctgggagtggggttaggaacctggaactggttctaccttaaacttggaactaccttaaacgaagttcatagcttgaggttctcagaaattgaggtgacataaaaccatcctcaaatctgtaaaaaggggccaggcatggtagctcacacctgtaatcacaggactttgggaggctgagcagaacagatcgcttgaacccagcagttcaagaccagcctgggcaacatggcaaaaccctgtctctacaaaaaatataaaaaattagccgggcgtggtggtgtgtgcctatagtcccagctacccagaggatgaggtgagaggatcacttgaacccaggaggttgaagctgcagtgagccgtgatcgtggcattgtctgcagcctgggcgacagagcaagaccctgtctcaaaagagaaaaaaaaaaaaatctgcgaaaaggcttgtcggtcacgataacttacttttcctttttttctcttaccctgctcagtaccagggcaacctccctgctgtcccagaagggtagagagaactagttttatttctggttcacctttcccctgaataaatccagctttatatggagatggtctcctatgagactctccaccttgagcaaggcacgtactttgacaaaaacctccttgtcctgcaaggccgccaaaactaaagtctatatttattaggatcgacaaatgttctcagggcaaaaagaacttaggtgttctagtgttttagtctctcctcatctctttagtgcttttaagaaaatctaaaattttttcaatttaaaaaatatatccaacattttaatattttcagtggaattttggtccaaataacctatcctaccattatcagaaaccaaagcctacaatttcctctctccattatcactgagctgagttttcctggacaagctacagtatttgcatgagattcctcttggcaggggaggaaggcatgcctaggatactctttcagatgagctgtttttacaacccaaagactctcttcttccctgctaccacagagacagagtacttcctacaaatatggcagcctgcctatatgattctttacataaccactcttcttttgctctctgaagcgaactacatctaggagggtttcttccaccagctgtacactcagttcccaaaactattgcaagcaacagatacagctttttcatgtcagggtggacttttcatcttaaagagcatgacttttccagtactttccaagatctactatctctgggctctctcaccatttctatgctgcttcccttcatttcctcaatggcttctgcctgatctcatctacttgggacagtctttacatgtattttgaagtttatggactaaatttctctcctacttttgctgtgaatagagttttcaaggttctgttgttgttgttgttgaccttgcttttgaatgtttctaggaagacaagttgaaatgccaccaaatgaagctatgtttttacacaaagtttcaaataatcttgactcctctctctctcacacacataaccaacatctaatacattggcaaattctgtcaatgctaccttcaaaatatattcaaaacttgtccacttcttaccatctccaattctcttttagtccaagccacaactgtattttatcaggactattgcatagcctcataattagttttcctgcttcaccttagctgccctacaatctgttctccatatagaatttatttctaagacagaagctagatcatgtcacctgtgctcaaaatcttctaatagcttctcacgtcactcagaataaaatccaaagtctttaatataactgtgaggccctgcattccctccacctctcctctcccattatttgttgcattccagccacaatgtcctccttgctgttcttcacacaggtcaagcatacaattacctcagggcttttgcacttgctgaaccctctgtaggtgtattagttcattttcatgctgccgataaagacatacccgaaactgggaacaaaaagaggtttaactggacttacagttccgcatggctggggaggcctcaaaatcatggcgggaggtaaaaggcacttcttacatggcggtggcaagagaaaaatgaggaagaagcaaaagcagaaacccctgataaacccatcagatctcatgagactcactatcacgagaatagcacaggaaagactggcccccatgattcgattacctccccctgggcccctcccacaacatgtgggaattctgggagatacaattcaagttgagatttgggtggggacacagccaaaccatatcagtagggaatgctccacctctagatttcttcatggcttactttttcacttaatttacatctctgctcagatatcactttattaagaggccttccttgaacaatctctctaacataatgttctctcctatatccactcctgtctcctgaccaagttttatttttcttcttggtatttattattatctaatatattttattttttgttgttgttgttgtttagcgttatcttttcttccatcaaaatctaagctttagaagaataggaactttgtcttgttttgttcactgatatatcacaaacatctagaatagtgcctggcattatagtaagtgctcagtaaatatcacagaatgtgtgctgtggacacagaggaacccaattgcaggacatacagtagaaggagagaccaggaagcacttttctttctgctgcccatgatcttccacctccttgacacacagcttctttactcactactccattccacctttccaaggtcaccacttccagcttgagtctataaatcctccctgcctgaggctcctcagcttactgactcggtgtccaaatcccaaatctgattggtctttcttagtccaaaaacctatctagagtccaattagccattgctgggggtcaaagggaggggaatgtgagtgtgtctgtttatatgccaagtatagttaccctccccaggcttctacaaagaggaaataaatgctggggatctttaattaaaaacaaaacaagccttctctaatacatccctgacactgaagagagaatatatataacttctactaggtgcctctaactcaaatgccttcagaatcctgacaggtaagataaatgggtgaagaggccagggtggggaatatggcaaactcaggagcctatgctgcatccaaagagggcagccactgtaactaactactgccaaggggaacatggggccaatgtcaccagatattctgatggttcaagagaaggcagaaatctatattttagtgtgaaatctcccacttgttaaatgacaactaatctaattttttacaagaaaaaacactatgcagactgaagaatatacatccattgagcaaatctggctaaggaataccagggtacaacttctgttttgtaaagtcagctcaaaaacaggacatcagtaatttatcacactcaaaagcaatgtttctcaggggggttcagtgtgaagatttcattagttggagtaaccggtactctcagtcccctttcacagcacctgcccccatcttctctaccaatcctggtacaaacttccaccaacttttaaccatgagagacagaaggcttattgaaaagcatttgggctttgaaatcaagtgggtctggacaaaaaaacaaaacctcagtattacctcctaccattattcttaacctctccaaacctcagtctactcatctgcaaaatggggatgctaattcctacctagaagggttcttgggaataatgattattattaacagactaggagaggccccttcctagagaaaggcatgatacttgaaaatccgcaactgtgatacagaatgttcataataagctaatgccatctacacctctttgtggaataagtagagggtaaaaatgcatttaataaataacacaaggatggaaaatacagctctctgaagacccaggtcttcacaccaatgttgttgcttgtgaacctagtccagaatgtctaactttgtagaaactagcactaattagaattcatagacatcaattatgtgattattcaagaactctctcaactcttaaatccatttttgtatgcatattacaacacaacactgagtcaagtaaaggcatgccaattctccaatgaccaaaaaaaaattaatcctgtagttccgggagacacaattgggaaaagaaagccctgtttccaaagtgtcagctacaacgctgtttccaccagtggctggaatgcaagagtcttccatacactgatgaatgcagaaagcaattgctgcaaaaggtcatttcataaccactggaaatactgcctttctcccacccgaccctgccctgtgctttctggggaaaagtcaccctgtgaagaagccatcaggtcagaggcagaggctacaaggaacccttggctttataccacacagcacaccctagagcaagtttgtccaacctagagcccaggagagccttgaatgcagcccaacagaattcgtaaactttcttaaaacattatgagattattttgcgatttttctttttagctcatcagctatcattaatgttagcatattttatgtgtggcccaagacaattcttcttctaatgtggcccagagaagccaaaagattggataaccctgccctagagggtcatgcaacaggaaagggggcatcccaaaaggaaacatgaaaactatgctccctccaggaactgaaagaactctccacaactgataccaaaaatacatttctcctagcaaagaactctaagtagacttcttctctaccaaggaggtttaaaaagaaagaagtgtgtctctaatcactgtactttcccaccaagaagagctgagctcccccattccagatttgcctgggcctattcttatttctcaggccctcgtggctcttataatcacacatgtcgattatcggttttcctccggggaggcccaagcatcagaaaatcacttacatccttcactgccaagcctctcctattaggcaggcaatctgtaattatttatgctattttctagattttaaaaaaggaggggtgtctaagatataggtaaatatcagccagcagttgacaatcattgaagacaggcattgcgtaaacaggggttcagtattctattttctccatttttgtacatgtttaaaattttacataatgaaaaagttttaaaagggagggtcgaaggaggacacagatataacctgaaaacaaaaccaagtgttcttcaccatttactcatgtctagatgcagaaaaacctgggaagtgctcagactctctcatcaacagcctagagggttcatgcgccctcaaagtggagactgtatcttctaagcactactcaatatccttaacaaaatagcctttgaaaaattccctagaacttttcaaaagtattctggaagaacccagtttcccttcttgaccttcccttctagacctgcctctaccaattacccctacagcctcttcctcctacaacgtcctctacttcctgttccagactgctctgctgaacaacccagttattgaaatacctcctgggtggcaggcaaacacctgtgttccagcaggttgtctagctgtttcttccttctggatgtcagatgggatcagtttgtaggaatattttgtattttcttcttcttccctttaaactcaatttgctcctagtaaggttttttttttaattgcctacagtggagttttccaacttcaacactgttaagatttggggctgaataattctttgttgtgggggctgtcccatgcattacaggatgttcagccacacccatggtttctacccatttgatgccagtggcacaaacaccaccgcaacttttgacaaccaaactatctctaggtattgtcaagtgtttcctgagggacagaatcacctctggtaaagaactactagtctaaaaaatattgaaaatacaagaacaatattgtcctggccccaccccccaaaaaatgagattatacagtttttttcccacatacacaatatcttccaacttataaatttgtaaatataaatactttgtaaatgttgtatcctaagccagaagtatataaagtaacaagagtaaaattaatttaaaaccctcacaactatattttctctgtcttcatggtttcctgtgtgaatcttatttgtttcttccaaattatcctgttttccagtcaatgtggtaatcaaaatattgtgctccaagccctctttgaacgccacataatctgtgtttgaattggaaagaaaaacttccagtgactttctcagtactccccatgacatgcactggctctccagcacctatttaacaggtgtcactggacaacagaatcccctaaaaggacatctccctacaaaatcagaaaaaagcgcagccaatgcgcccccggcccaactccaaacagtcacaccccaaccccatctctgtgtaaccacaggaaggcagcatcctctcacacacaaaatgctccagccctacagctcccagttccaattctgtatttaagactcggagtcagaaagactcactggtgcaggcgccatctcactgccacctccttcacctctgagtgaaggaagaatacccgattcccaacctgaccaagaagtgcaacgggacgttaaatgagccagtgtcacaagctgcaacacccgttgggaaatactgcaatttttcttcattaggcagagggtttcccaccatatttaaatggtacactctcttcttaagaaatctgtttttggtctgcacaggtcttgcattagccacggtctacgatacagctttgggggctatgcgttcaaaactgtctctcctctccaccccactggatttcccagctccaatcaggggctctcccaagcctccatcctcttattgcccccctcccccaccattcccctgggaatgtcatcttgttcctcctctctcttgcttacggacaggcagttgctgggtgcagggattttgccttccagggtccattccttcctggacccatttcatgccactgctggtctcagcctggatcccctcatcccagattctggccacggcctcctaactggtctcccggatttggcctttctcctctaatatagctttcactctgacaattgatagtctttcaagagcacaagctagaacagccagaagccttccgtggtttcccattccctagcaccagatacaatcctgtcttctttggtgcacagtttgtgaagcacaccaaatgtttgaccctggaggtgtccaagcaggagcagaacgagcactgagtgggacaggtgcccgcatgcagagggatttatccactggatacatggtggagggagatgggaggagggagttaaactaaatgacttttaaagtttcctttcaagcctgacttcccatgattctgggaactctttggtctgccatgcaggtcctaccaccatctgacccctgaaaagtgatgcctcctgcaaagtgatgccagacagtcccctataatgctcctcacatggtcctgcacatggttaccccacctctataggatgacttcttttaattgtctttttttttaattacaaaagtaacactccttggtgcaacaaaataaaacaacactgaagtattaacatgaagtcctcaaccactgcactcccatgggtagccactggtttcagcagaatgtatgccctcctagtcctttcctatgacacacactccattcacttgacacctggtcttatgctgtgccttaggaagaaggatatttaattcttatctgcattgacttatctctccagttccctaaggtagtaaggctaattagttcatctgcttcaaatgctgttattccaccaatgaggaattgaaagggaaggagataaggtttcttgctcaaaatcacagattagctggtggcagagttaagaccagaccaagaactcctaactcaatgttggttattacactgtaaagtgctcttctcctccccaccgtgcagaatatcatattgtacagacagcaggtagaaataattgcctcttgaaagcataggggcaggatagtccagtggttaagaacttggactttgaactcaggctgcctaggttagaatctggctgtcatttacttaactatgtgacctgagtcaagcaactgggcctcaatttcatcatcccttccttataggactgttgtaaaattagtagcttaatatctgtaaacccctcaaaacagtatatatgttaataaaacatgctatcctacctctaatgtaacacccaaaatacaataaatatcttccttattaaaacataggctggcaaatcaaaaccaaatcttgttagctctgaattttgtctaaaaataaattagcatgggtgaaaactcacacaatattagtccaaaacagatttaagtgacacaagaactgtaatcattactacaggaaggaatgacctcataaagacctcatacatcagaagcattgtaacatttactgcaccaaataataaatttttaaaaaaatcttaacagcctctatcagtaattatctaagtaaagtgggctgcaaatctgttagagaactgtttttgccatgataatatttctagtaaattgctgcttctataccaaaactactggtgttgcagaaccggcaggctaatagaaagattattatagaaacactattaaaatgaatcaggtattattaaagattcaacactacaacggcgcctgattacaagagatttcaagctgtattgcttaacgagcagataaaagtgctaattaagtccactcttagaggttatccctaggcaggactgtacacttatgtagcaagaggtcttcagactaaatgaggaaccagtaatgccaacccggctggatacagccctactgggaagatagggagagaatgagaagagccaagattttctgcgcacgaaggtaacctggtaaagcagacaagtatccaaacttatttaaacctcagtgtttttcttaactgaggaacactcagttaatcagcaacacttctgattcctcctttcttgaatgaagaaaaccaaataacccaccataaactgaagaccctcaataaacggcacaatcagcgggaggcagagaaagccgtgccattattaccaaagcctcctcgagcaaccagaagacatggaatcgctctctcaccttggccaaaagcatctctccatgcaaccagagcctagagctctcagaggtttttaaagagttgccagactgaaggcatttcgttccaggatctatttagctttcccaccttgttaattaactaattagggatgggaaagcaactcaccaatacaaagtgtcaggaaaatgctaagtaaatttgtccaactggtctaaatgtcaatgctaacttaagaaagggggcaagcgcgagagactgagccgtccccagactgctgcaatccagagctcgctaacgtagagacggagagacccgggcgccctgcagcagcagcctcccggcccagagccgggatgccggcaggacttctggaagggaaacctggaccagggccaccccgggcacagggaacgcggctggcaaggcgcatcctcgccgctcagtctccgtctccccgcatctctcagacgtcaacaaacccctgaccacaaagtgaaactttcccggcccccgctgtcgcgccaggtctctgccctctgcctgggagcgcgttgcggggacaggtgtggggcccgggctgaggaggggcccccgccccaggaccggaggttgtgtaatcggcccgggaaggggggctcgggacagctccctgcgccggagctgcggaggccagacgggggaccccagctgagggggccggcgcccggaggcgttggggggatggggagggctctcgtcccgccccccgggaccgcccccgggcgcagtcgggagctgcggcgctgacacggcccggagagggcgcccgcgcgtcagaccgagcccgaggaggggggcgcgatggctcggcagccgcggccagccttacctgcgcgccgggccggggcggcgggaggcggcttgggatgccggggtggcgggcggcgggcggcagcgctggcagccacccgggccacggcatgcgaggagccgtggcgcggcggcggg

SEQ ID NO: 1747 - DNA, 6448 bp, Homo sapiens
agatgccccacagcactgctcttccagaggcaagaccaaccaagatgaggtgggtccacagctttccctcctgcctttcctctggttctttatttcagtcttttttgcatacatcggtagagatgcagaaatagaacaaagaaacgggcaaatgggctaaattatagtgaaccaaagggcttagtgtgttaaatcttctccttttctgcatccatagaagacagtgctgctgtctttcccaggagataagatttactctcaggagtgtctttttccttcaggttacatttttgactttatagggtatgtcatcagctcccgtggtaggcttcctggcatcctgagtatatttattagcagatattttcctctttaaaaatgtacaataaggaagactaatagtaacacatttgaatgacacaattaattgactagtacctgggatacacactaatacctgggatacatctaattaaggcacttagatcttataaaaataaacactttttgaaatgttgaaataataagactagaaactttttttttttttgagatggagtctcgctttgtcaccaggctgcagtgcagtggcatgatctcggctcactgcaacctccacctcccaggttcaagtgattctcctgcctcagcctcccaggtagctgggactacaggcgtgcgccactatgcccacctaatttttgtatttttagtagagacgggctttcaccatgttggccaggatgacctcgatctcttgacctcgtgatctgcctgccttggcctcccaaagtgctgggattacaggcatgagccaccgtgtctggcctagaaactattttaatagaagcaagtagtgcccgaatggttggcatttgttagtgagatggtgaactggcagacggcacctgtgggtcaatgcccatggccaccgtcctgcttttggacaccagttctcttccaggtaaccttctggcattttggggtttcagataccatttcctaaaggtgaattattataaaatactagaaatacccacgtgtttaaaattatatatttaaggaaccttttattacggaaaatatcaagaagtagaggaatagcacagtaagcccaaagttcccatctctgagttatctacattttattaccactatctttgcggtgtctgagggaggtttctctttcctggagggctcctgtattattgccaatgtactttcctgaatgcagccagaaactgagcccacccctccacctatgtgcctttctatccctctctgaagcttctgcagaattcccagcaggacagggcttgctggaagcttggtatgctcagaagctgctaaagtgtgtatgggcaggtgtgggggcaatttcttggtcctagcacttccatatatcgactttcttttctggctgctaagtgggaggagtgtgtgtgtatgcatgtgtgtgtgtgtgtgtgtacatgcatgtgtgtgtggatgcatgcatgtgctgtgaagcagggagactagctttccactcctccttgtcttctctctgcagtgccctgggagctgtcattgccctcctgctctggggacagctttttgcagtggactcaggcaatgatgtcacggatatcgcaggtcagtctttggttgggtaggagtgtgcatcccactctgaccctctcgggtctgcactctctctgagaacacccaattcccccttcttatctcgacctctgggctttcaggaccataaagaacattggggttcctgccagaaatgaggggagcttgcctttccattggcttctattcggggtggaaggagattgatgtgcagagcagctcccgctcatctgacttttcacggttcactgggaacaatttccaaatagcaaactctctggcttctctctctttgcagatgacggctgcccgaagccccccgagattgcacatggctatgtggagcactcggttcgctaccagtgtaagaactactacaaactgcgcacagaaggagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcacatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggtgtccaggcacttggcttccagcacagcactctttcccttcctccttctcatattctctctcctttctcccttcctgtctgcctcctttcttcttcttctttttaattcttctccttaaatgccttctcactctgctctgggtgcagacttgacttttcctttggctcatttcttgccttttgtttcaggagtatacaccttaaatgataagaagcagtggataaataaggctgttggagataaacttcctgaatgtgaagcaggtgggtgctgagcactgagcacttaagagagcaggcaggcgtccagcggggaacgtcctagaggcacagccttccagtgcggcttcctctgagcacacaagagccaggaggagggatgtgggagaaccgcagctggccagggagagacttaagcagttaggtgatgactccctaagggtcaccaagggtcttgttcattggggcctgaagggcactggctgaatccactgtcggcactgcccacagatcaggagagcctgtgcatacagagagcctgctagaaagccctgggtctaaggagaagcaagctccagggagaacaagtcaaggaatgacataaaatcttaatccatggaagcctagcaggaggctggacatgggctggaactcctgcttctcgttattaggaggagctgttgctctctcctttcattctcagaaccagaggcaaagacccagcctcttctgctcttactggtgtggaaatgccaacctgcctcgtattaactgcaccatctacaaaatctgagctccagccagtgctgctctagattcatctttctttagagagaatgaattattgtagcccctagccctttcaatgaatttcagggaattgtggaaattcctttattgggataattgtttaaaaataatacagttcgcgagcttctattcggggtggaaggagattgatgtgcagagcagctcccgctcatctgacttttcacggttcactgggaacaatttccaaatagcaaactctctggcttctctctctttgcagatgacggctgcccgaagccccccgagattgcacatggctatgtggagcactcggttcgctaccagtgtaagaactactacaaactgcgcacagaaggagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcacatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgagaagcagtggataaataaggctgttggagataaacttcctgaatgtgaagcaggtgggtgctgagcacttaagagagcaggcaggcgtccagcggggaacgtcctagaggcacagccttccagtgcggcttcctctgagcacacaagagccaggaggagggatgtgggagaaccgcagctggccagggagagacttaagcagttaggtgatgactccctaagggtcaccaagggtcttgttcattagggcctgaagggcactggctgaatccattgtctacatcgcccacagattaggagagcctgtgcatacagagagcctgctagagagccctgggtctaaggagaagcaagctccagggagaacaagtcaaggaatgacataaaatcttaatccatggaagcctagcaggaggctggacatgggctggaactcctgcttctcgttattaggaggagctgttgctctctcctttcattctcagaacaagaggcaaaggcccagcctcttctgctcttactggtgtggaaatgccaacctgcctcgtattaactgcaccatctacaaaatctgagctccagccagtgctgctctagattcatctttctttagagagaatgaattattgtagcccctagccctttcaatgaatttcagggaattgtggaaattcctttattgggataattgtttaaatataatacagttcaccagccagggctcaaaaatctcagtatttcccacttcctttgttagaaaagtgggaaatagagctttttgtaatgtaaacaatttaaaaaacagaattattttaaaactgcaactattggaaatgagatcagcaggtggtaagggcaaagcatttaaatctttctactttacgcagcagtgacagccgcccatgctttcacccctttctcagatggaaaggctcttgcacatttccactcacgagtgtcttgctctccttgacagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccat

SEQ ID NO: 1748 - DNA, 6448 bp, Homo sapiens; identical to SEQ ID NO: 1747

SEQ ID NO: 1749 - DNA, 124714 bp, Homo sapiens
aggcgggccgcggcggcggcgggcagcggacgggcggactgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcaggtagggaaggggcgggctgcggtctgctggctgctgaagtgtgccccgggcgtgtgcacccggcgtgtgcaccggcgagcgctgcgatccggctctttgcgtgtgtgttgtgcgcgcgtgtgtgtgtccgggagtgcccgcgtttctctgcgcggtggagttgtgggtgactgcggacggtggtgtgtctttcgaatggcgtgtactcgtgggcatccatgtgtgccttaggtgtgcacattttggactgcgtttgtggaattgtgtgtcggggcgcagttgctggtggggagcggtgcctggcgggtgtcgtgtgtgagcagctgtgcgcagagcggggtggcggggtgggtgtgggtggtccagccccacgcccagagccccctgtccctgctggtcggcgcagtgcgtagcttaggagcctcgaggacagctgggacccgacgggcaagggcgggcctcgcgggcaggctgggcagccctcagggaacaggtccgtgcggcccacgtgggtcgcctgtgagcttctgccaagggtgggggcccacgcggaggcgatccgctcgttcctcccagggccatggggcgacgaggagagccctggcctccccgcgacccgcactgcgacctgggccagacgcgccaccttccccggtcgcggtttgcttctctttaaaatgaggacagctcctcccttgggggctgtggtgacaggtgaaatgagaacgcactgaagacagctcttggtccaaagccccgcacacagtaggtactgtgttaattggattagcgtctcctgtttaaaatcctttttttttcccctttatcgtgggtggggccttacattttccccgggcgtgttttgtgcctctccctggccctaacttaaccgcgaagcactgagattcgagaaagtttagctgccagctgcgctgcctcctgcagcacctcccgggcggcgccgcctccgcgagtgcccgagagcgccgcgctgggcgccggccctgccccagcccccaggctcccgcgcaagcgtgggggtccctctcctggccgggaggcagcgactgcggagttgagaaccctttggttcaacaagttcctagtccgggaggatgcagctcagctcgtggagtccgagagtcacggcgtaaaattggcgcttcccgcacatgcagatctcgggctcccggggtgtcccggccgccaaaggccacccctttcctcctggctgaccccaattccaccagaggaggatgtttgccagggacgccgagtccagctgctggcctcggcattagacaacccccagccccagcccctgccatccctgctcccttgcagccagcctcatgccgggggtgccacatgggacacctcctcctagtcccacaccttaatttaaaacatttacttttgaaacctactagtcgtaaaattgaaccgcagtgaacgagcacccagctcttaccacgactcactctctggagagttctggcgcctcggcgctggctcggacgcagcaaggccagctctaggggtcgggtggctctcggccagagcgaaggatattctttcccttcatcgccttggtgtctttctctgggggaaaaaaatcgcctttaaccaagggagccaagatctcaccagtgcaggaggctctcaaaatggagcgccggcatggggttgggctgcggaggggacagcatgggcggccttttggtatggatgcgcttcccaactgtcaggggctacgtgatggtgttcccagagaggcgggctgctttgcgggcttttaggagccagggatagaaacctggtccggttcctttggtttccctcggccgagactgaagccctgcaatcctagccatggcaggccagggggatgcgatgaactcattttctcatttttcatcctgacttagtgacaggggcacacttagaatgcaccctgttttctgtttcatcaaatgattttatgtcctacaagaaaaaagggcttttggtgtgaatcctactctttcctcataatcaggttccataataatattaaaaaaaaaatcagtctggctttctcagctcagaagacagacccaaacccaggtttgtgttttgttttgtttttgtttttttctagttaaagccagccctttgtctcaagcaagccagtgttttggccttagatctatttctgtttcacttttgaaagtgcctgtaattactgagctcttgaggttttattggataatgtggcaaagggaaggcccgggggccctgcctctcccttgcggtgggatgtggtgccacggtggcacattctagccttgcctgctccctctgcgtcccactttcatgctgtttttaaggtggaacagaaatgtcaatgtgtgataacaatttgggagactttgtctttggaatccaataaatggaaggtcctttgatctgtggagaaaccagaacaagtcaaaaccccagaagaacagagatttgcccaaactccagccaatgacccatttatttccaacaagccctcctagagatagattctaagtgaaatacaagaacgtggacacactccgtcccctttctggccacagggctgtgcagaattagaagtgcagtctatggaaggacaaggactggacttcgcttggtgcaaacgccccagccaggcgccccatactcacctagcaccatttcaccctggagctgtttcctcctgttgaagcgctggtgctcacaccccctaccttcagggctctgcaagcacagttccaaggtctgcagcgcgggtacagtgcatgccctgctgagtgtgcgtcagagcagttgtctccctgtgacacttattctaagaccctttttgctactcataagtggtagagtaccacactcactcatgaaccagtgataatccagggtactaacgggggccccggagtttatttggcaccgaagattaagctacttggcagctgaatttttatctagattggggttaggtttgtattaaaattttgcattccagcaagccctaaaccgtgcttgttcattgtgggataatgcgttcaactgatgagttgccaggccaggattgatgggggattatgtgtattctgctagtttgtcagcacctgatgtcactgtgctggggggtgggggaggcatgtttggagttaggatgagcagacacttgtagattttaatcacactctactttggggctccctgctctcctatggtagcagggggtttctgtgtcgttcttatgtcctcatgtaaagctgcacatctgtgaatgtcaggtagctcttgtgcttttccccttagattgagtttctaatctgggaatgacagagggtggctgtatatggagacagcagcatgggcttaggggctcttttggtgccagttaccctacggaaaaaaggtttcttcaaatcactttctacaaagactaaaaaatggttggaatctagtggtgcagattgtaatatgacttcaggtaatcaatacggtttgacaggtggaacatttcttagatgctgatgagcagggcgcaagtctcaagatttttaaatcatctgaaaagcacagtaaatcctttaaagagccctaccttggccatgttgtttcaagtaaaattgaatttcagaggcaaagcttcacatcggaggcatgacgaactaaagaaatccttcccagagacctccactctcttcctgttgccaccctcctctgccagcagcagggcaggaaagatgacttcttggggctgtgtgcctttaccttaagaagcaagtgcaccctgaatgcttctaatcccgcagctgggttgtctgggtatttggatctttttggtgcttgaggtactacccaagttggcaggaagccaggagcctgggggtggaggtgtcttagccccacctgtggcatgagacaagaggtcttctccagcaagggatgggtctctgacccttggctaagaaaactcaggattgttaaatacgtactgcatggataaggttgctgtgaccctgaaaaaaggaagaaggcttttgggtggtgcgtggttctcctcttggaagtcttcccagatttcgcctcagtactctcttgccctagcttaaatctttccttgctctgtgtccccttaggcaagtgaggtctcctctcaggtaggcatgatattaagtgcatgtctagaggacagttccttctacctgcccaggtgcactggctgaactcacctatgcccacatctgtgcattggcaggtgatatagatatacacctgagctgtccccctgagctgcagacctaacactaggtgtgggctccgagctgttccacatcaaaacagagccgaggacacatctccctcactgaagctgtgtctcctacctattatggtcaacacgtctcatctactcatttgttaaagctagaaatctctggagagttttggagctctttctctgtcttcacttgaaatctctggagagttttggagctctttgtctgtcttcactttgccatctaattgggtcagccctctctgagggctcacacccactcttccggcacagcggagccttatctgcccttggcccagagaatgcttccagttccttcactccagccacaccggcagcacttcccagtttaaaacgcagatttcatcatcccactgtcttctgcctccccaaccccaccaaaccttggtttgttctcttaacgcagtaagtgcttctgatacctactgtgtgccttggaccaagctggagtctgagaaggttgggcccaggcatcctccctacctgtgcagagtttaaggtcttgggctgggggttgtatgtggggtacctatcaaataagaccagggagcgtgaagtgctatggaggggagctcctaccccagtatagggggctccctggagaagcaccctctaagctgatacctgggagagttgggggtgcaggggaggggttggagttggggctggattgttcgatgcctttcttctgtctcacccagacttccttatctgctaaactcctactcatttttgttttaattaataccaagatagaatttatctctcataaagcatgcccattctaagtgtacagtttaatgattttcagtaaattaatagagttcatagccattaccacaatccagttttggaacatatccatcaccccagaaagatccctcttttgtacaaactccctgtccccgtcctcaagccgccagtcccccacagatttgctttctgtctctagatttgccttttctttctatgtttcttagtgtgttttcataggttcggcccaagagctgtttcatttgggccttcctagagtcttctagttagaatcaatttatcccccagcaccgacgaagtgagctgggtgcttggccatcccgctgctagatggcgagctctcttacctgcctctcctgcctgcacctggctcagcactggcacctacagaatacccaaggtgtgttggctggaccagctgaagttgtgttcctcacatttcttttgtataactcctgagtatctagcagagtgtggggatttaaaatacagcgcatgtattgatgtgtcaggtgatgtgagccctgctacatacataccttaacttgtttcatcaagaacttgtgaggcaaatggcaaatcaaaaacaaaaacaaacaaaacaaaacaaaacaaatctattttctaagccaggcacagtggctcttgtctgtagttccagctactagggggtgctgaggtgggaggattgcttgaaatcagggatttgagcctgggcaatattgtgagaccctgcttcttaacaaactttttttttttgagatagggtcttgctctgttgcccaggctggagtgcagtgatgtgatcccagctcactgcagccttgaactcctgggcccaagcaatccccctgccatagtctcctgagtagctaggactacaggtacacaccaccatgcctgctgatttttaaattttttgtggagacgaggtcttgctatgttgcccagactggtcttgagctcccgggctcaaataatcctccagccttggcctctcaaagtgctggaattataagtgtgaactactgtgcctcagcccaagccatttttctaaatgaaaaaactgaggaggcccagagcaaataagtagcccaagggcatcagcagaaagtagaaggatcaagaattaaacgaggtcactttctcttccgcccttgttttggtagtaatgatatgcccttttatggccttgcctgggctggtgttcagattttcctgtacgagtcttgtcatcccttcctaagccatggaagctccttctagggcatgagtgctgtgtgacacatgttcacacagtgttgccccagtacctacctagtccacaactgaacaggtagagatggttcaagcaatgtgtgtgtgtagagaggtctcctggtaaatagaaggggctgggggagggcgttgaatgcagtggtgctgtggccttgggtggcttggtgcatttctgatgcatttctcaccttggatcattttcactctttgaggaagagagcagaggatgagatgccatttgacagatgcacaaaccaagacacagaaattgtatacccattgtacgccaggtagatcacaaatgaccgttctctcccatggttgtagagaactctcatggtggacagaaaccatgaaagaaatcatggtggaaagaaccaagacattcttgaatcggagtattagaacctcatttgcaaaataccttggaaagatcagggacactggggtttgaattgtagtctttgctctgttgtttattggctggtgatggtctctgaatctgtttgctcaggtgcagaaaggggttttaggctgagctcagatattgacaggaactacaattcaaacccaggtctgcagatgtggcagactgggtttgaactgtagtctttgctctgtttactggctggtgatgttctctgagtctgtttggtcatgtgcagaaaggggttctaggcgcagctcagacgtagatggggacgcagatgtgagtacctaggtgagtctggctggtcacgtgtggaataagtggtggtggctgccattactctttaagcattcttggatctagtgcctcctctgccactgagtacagaattccttttcaaattcgggcttatgaggcatgttttgatccaggctgtcgtagcaagggatttgatgctggagtctgtgactgctgtgcgtgtggaggcttccggaaggcagccagtgctggttactgcttggagtttggggagctgccattttggattgtcctagcctcatgccttctgagaagcatctgtcagggtccctgatgcacctacagagaccctgagcttggtggtgggggttgcacagagagagctgcaggttgttcctcaggcataacgaggcccggagctggtggtcccctccctctgtgagtgtgtgcagagcatggatcgggtctgggagtgttcgtgctggcaggccggaggaggactgctgggcacacttgcagaattgcggttctgtacagcagtgtgtatcgactgcagcgctctttttctctagcagcaaaatgctcagctctctgccttctttctgtgcatttaacagacgtttccagaaagcagaattgatgacagccccaactcctccctttcactcccatcttttctatttgctgccctgtaatcaatttttggagagaagtgagaacctctcgaaatcgatcacctatgttgaaaaaaaatcatttttaacatcatgcagttttccgtatttactgtgtgtggctggagacactcctggcagaatgagtgtgggatgtaggaggtccagaaaagcccccagcttcaggggctgagatagggccatgggtggcagaactggttgtccccccgccccccaatccctcagcagtggttgaggtgtgctttattagaaactcttcagtcatgcagtttggagcccgtgctggtgatgcagcctggatgcctggcaggggcttagcctccaggggtgggacatgagatgtggctgccgtggcttctctgtgtctttcttcccagcgagtaaaggtagacgcagggctctggcaggtgctaaggccctgcttgccttcatgctggaatgctggcaggtacaatttattcttatttcttaggaggtgctttcccctcttctttctgaagacatccagggataaagaattgctgcttttatgagcacatgttcttggtgatatgctgttaccttatctaaaaacaatacggcctggctgattattctcagagctcattgtaaggtgaaaggttatgcatttgagaattattttcacagtgtggatgggagtggggggagaagatgtagagcacaggtaaggaattccaggttttggggccagggatcgccaagcagtgtaaagggctcactgtggcctgtagctccttccccctgtggtttgtgctgggccagttgctggctccccaaaaccattatcaccattatcattatcactatcatatccatcacctcaccatcattatcactgacatcatcacttttctccatcaccatcatcatcatcatcactatcatccccatccccatcatcatcattaccatcatcattgctgtcgctatcatcatcatcattccattcatcaccattcatcatcactgtcatcatcaccatcatcatcactgtcatcaccatcaccaccaccatcatcaccatcgccatcatcactgttatcgtcaccattcatcatcactgtcatcatcatcgtcatcactatcatccccaccatcaccaccatcattatcaccattctccatcaccatcatcactatcatcctcaccatcatcaccattctccatcaccatcatcatcatcactatcatccccaccatcatcaccatcaccatcatcatcactgtcatcatcaacatccatcatcactgtcatcaccatcatcatcactatcattaccatcaccatcaccaccattatcactgtcatcatcacctttctccatcaccatcatcatcatcatcatatcatcatcatcatcatcatatcatcctcatccccatcatcatcaccatcaccaccgtcattgctgtcatcatcaccattcaccatcaatgtcgtcatcaccatcatcatcactatcatcattatcaccatcatcaccatcaccatcatcattactgtcatcatcaccattcaccgtcactatcatcactgtcattatcaccatcatcatcaccaccaccatcaccatcatcactgtcatccccatcctcatcatcatcaccatcactgtcatcatcatcaccatcaccaccattgccatcaccatcaccatcattatcactgtcatcatcacctttctccatcaccatcatcatcatcatcatcactatcatccccatccccatcatcatcaccatcaccaccatcattgctgtcatcaccattcaccatcactgtcatcatcaccatcatcgtcattatcatcattgtcaccatcgtcaccatcaccgtcatcatcaccattcatcatcactgtcatcactgtcattatcaccatcatcatcaccaccaccaccatcaccatcactatcatcgtcatcatcatcactgtcaccaccatcaccatcactgtcaccaacatcatggtgcttctcaacctttgggctgctttgggtcgtgcttgacatggcacattcctggtgagttagctgttctttgggggttttctactgttggtgtggtgattagggtagtcaggacaggatgagtataggcatagagaacccaagtggatgatggtggagtgtgattcttctgaaagggtcttcatgagaaccactgatctagaagattctgggagaatctcacgtattctttcaggcccaggagtaagccagtgttacctgctctgtggagctctcctttgtccctccagggaggacaaattctggctggagcctgaccttactgcttgtccatctctcccagggtggtaggccactttaggtaggaccctgtggatttctccttggtgacccccgcattctgggcacagagcctggaacacaatgtctgcccagatgtgtgactgaaccaccccccaattccttaactgtaggatggcggctgccttcattagaatcttaacaccttgcctgagggctggctttgcaggtctgagtggctaggtcagggcactgctagtgttttctatgtttgtagtcaattggtgagagtttgttttacgcatttgttaaaactgtgggacagtggtctggaagccaacaaggctttagggttggcagagtgactcccatcccatcattgatgtctggctttgacttggcatgggagacattgcctctccagatctcagttctctcgtttgacaaatggggcttagggttgaacagcctctaagtcctctgtcagctctgcaattcaggaaagatgtttaaaaatgcatacttgcattgtaggtacatccaacatagagcaaagagagaattttcctagctaaattgactgcaaaaaaatgaaacctcttgggccgggcgtggtggctcatgcctgtaatcccagcactttgggaggctgaggcgggcaaattacgaagtcaggagttcaagaccagcctggccaacatggtgaaaccccgtctctactaaaagtataaaaattagctgggcttggtggcgggcgcctgtaatcccagctactcgggaggctgaggcaggagaattgcttcaacccaggaggcagaggttgcaatgagctgagagatctgagccactacactccagcctgggtgacagagcaagactccgtctcagggaaaaaaaaaaaaaaagaatcctcttataatatgcaggcatcttagcaactgccatcttagcaactgccatcttaagaggcagcattatgattcagaagaaactgataacattgaggaatacatttgtggagcacagattaggagagattggtgcaggggtggggggtggcaggaagatattaaggttggaatttagggaggtgagctctgtgggttggtttcatgcatccagctcaccattcaacctttcctgttaacttcctatattaaggaggctgagattaagaagacagggactcgtggcgtaagggcgagacagacatagaggtgagtgactgcagtgggatattcactgtgggagcattgaaggttggcagtcagctagattcttaggctgtagatcgggggccttatttagaagctgtttactgttcccttaagaggatcctctagcaggaaaaaccactgctagggttgttgctttcctcattataatgatgtctttatgttcgtcttaggaggtgatagtactgattatttaagaaactggtcagccaaacttcttaactaattgtgaattagagaaaagtcagaagtagggagtattatagagataagtaattgtattattttcagacaaaagtatatgtagtaatgtaaactactgaccagattttgtttcaaattgttttttttaaatgaattgctaagaattatttgaaattagcacattagcggtaataagatagtagatattagatagattagattaggatagtaggtagtagatgtaggtataaagagactgaaaatcagctgtttaaacatttttcccaaatgtggggctaggaagcaagataaagaattatgcaggccaggcgcggtggctcacgcctgtaatcccagcactttgggaggccgaggcgggcggatcatgaagtcaggagatcgagaccatcctggccaacacggtgaaaccccgtctctactaaaaatacaaaaaaaattagccgggcgtggtggcgggtgcctgtagtcccagctacacgggaggctgaggcaggagaatagggtgaacccaggaggtggagcttgcagtgagccgagatcgcgccactgcactccagcctgggcaacagagcgagactccgtctcaaaaaaaaaaaaaagaattatgcagacagtttcatttcatttatgtttggacggggaagaaagtcagaaaatagatgggaaggaaacatatctaaatgttaacggtggttgtattccatgggatcatgggtctttcttgatttttcatgttttgccacattctaaattttcaccagtgggcatttattatttttgcaattagacaggaaagagcctccaggaggaactccaaatacccatcctttatttaccctcttaatttgcttaccaaactttcttgttatggttagactggctggcatccataatttccatacttgtgattatttaaattaatggaaatttatcataatcccttattaaaatttcttcgctgcactgaaattcaacactgagcaaatctgttacctaggacataaagaaaaacattcagtccacgtgcggtggctcatgcctgtaatcccagcactttgggaggctgaggcaggcggatcacttgaggtcaggaggtcgagaccagcctggccaacatggtgaaaccccatctctactaaaaatacaaatattagctgggcatggtggctcacgcctgtagtgccagctactcgggaggctgacacatgagaatttcttgaacccaggaggtggaggttgcactgacccgagatcaggccactgcactccagcctgggcaacagagtgagacttgctctcaaaaaaaaacaacatccagagtcttccaggaaatttaccgtttcagtgtggcatagtgtagagtttgtttattatctagaatatggtttttcttttttgtgttcttgaacttgggcgttcacttcgtttgttgacctggaaggagccatctcggcgcctgctgtttgaaccttgggtattttaatgaagtggtttgatgtcctgataccaccagcccctgctgttgcttttcacggccctggcttttccaggaataatctccttactgtttgtcattctaatatgtttcagctccctttttgaaaataactttttctgctccccttccctgcccattcttcatgacccccagagaatgggcctgctggtctctagcccctgtgaattggaagactcctggcgatgatccttctttttctctctgtgactcaggcggttgatgttgggttgaccgtatttctttgctggctggtaagcagggccacctcagcccttgtgagggccatgcctgactttcaatggcttccctccaaaggcttcttaggccgttcctccccatcgtttttcagaggtttaatctgtttgagtccaggatattgagtcagcagtggaaagttatgaagatgaggccagccatcagaaaaattggctaatatgaaagattaattccagggtgaacaaaggagagggatgctggggccgggctgcctccccaggcaaatcacatcactgtaaaatccgagaaaccagaagttgcctttgctactcactcagtggctgcttgctgtttcttggattagatattgaaagaatcccatctttatagtctactgttcatatttatggtctggagaagaaaatgtaattttcagcaaaattctatcacgtctggtaaataatttcaggatctttacctatgataccacattaaaaaaaattcgtatggcttcagcattcagaaattgttcttttcaaactctgggccctcgggttattacaagatttaacaccgaggcaggaagcctgctcgcctatcactggagacaggtaggttgctatggagaccaggtgtgtgtccctgcggtttcctgggtatcccagttgtcctggaaaagaaatcagctcactttatgtgatatttctgcaatagtgtgtgtgaattaagtttttctaaacacagatcagatgtttttgttgacttacagtgtgatttctgacataattttgtcctcggttttgttttgcttaattatgaatcctacataaccctaccttttcctatcagaagcacttccatgcatcaagaccccctatccaaaacagccacaacaacttcaccaacaaaatctcttaaagctagagatgcctgctttggtgtgaatgatgattaccccttaaaataattcaacaattttttttttttttttttgagacagggtctcagtctgcctctcaggctggagtgcagtggcgtgatctcggttcactgcatcctgtgcctcctgggttcgagcaattctcctgcctcaacctcctgagtatctgggagtaccgggatgcaccaccatgcctggctaatttttgtatttttagcagagacggggtttcaccaggttggctaggctagtctcaaactcctgacctcaggtgatccacccaccttggcttcccaaagtgctgggattacaggtgtaaaccaccatgctcggcctcaacaattattatatatggtttgccagatcctggcctgggcactggggatgcaagatagagcaagaccattggaggccctgccctggcggagcttgtattagggttgtgatcctagaccacatgaagcccacaagggggccctgggctcacccgttcctggctcacattcactgtcagccacagctaaacctcggggcctggaacctctcttgttgtccccatgggacgagtgggcacatgccttgttggatggacaataacatcatctgtttttgtttgatgtgttattattcagaggcatttttcagaatggagaacagtgccttatcagtctgcttctgataattttatacatgaaaaaaatcctatttgtgcatattcttgggtctctccccatttctaaaggcagtcaacttggtggttggctgtaaaaagctctttacacttcctaggacttgtcaaatattgacaagtctttctcctttcatccagttcagcaccagcatcctcaaactcactgaaacagagcatcccacagtggcagccactgtaggccccaggtgggtatcctactcctccacccccgccccagactcccccaaccccagctcgcacctgcagaagttacgtctttgcagttatttcaggagaaaaaggcggccactctttctctcccttctttgggtttgtgttcagcaagggtctactgcagtcccggtgccggacagcctgttttgcccatgcttgttaactgatggggtcctcaagtggccttgtgacaggcctgataaggccgcacgtgggtgtggttagagttgatgaccgctccggacattggcgatgtgaggaaagtgacagactccagcctccatgtgcagccggtgattggccgggtgggctcggttttctagtggcaaaggatgctgtgatctgaataagaaaacaaacctcaggccccaagtgccacgggcttagagacttgagaggaggtgcttgcaactccatctgggaggctaagggcagccaagagctgctgtcttgaggctgacccactcccttgcagtgtaatgggtagtgaacaggccatcctttttaaaggaaaataagtgcctccctatggactctgttcctatcctgctaccctccctgaagcttgaatagcacccacccgtgccttctccatgccagcccttgggtctgccgggaccactgccatgcttttgatggacacggccttgtagcgtctatatcctcatctgtgaaatgggaattccacagcctccctttcgcaggctgcttgtaatagttgccattaaacctcttctgaactctaaagtgctgtatcaatgtaaggaccatcatcaacatcattgtcgtcctcatcgtgagtctttccaaattcacctcctgctgccccagcacgggagtgtctgagactgcaggtttccttgatgggttcctggggcttcccttgtggaaatttgagttctgagccttctgcacttttccatcccccagtctggagtcaacctgtatttttcattttccctctgcaagatgtcagcccataggagaggcctggaggcttgcaggggaaatgggacgatgtttgaaggaagcccccgtgcctgtgggagcatgcagcctcctccgtctttttgtctgccaggcaggggagtaatttgccgttatgtactgggcagtctgggagctggactctcagatgaaaaatgcttgttcaagcacagacagccaggcatggctcaaatcagagcatcgatttagcaagcagctctgctcaaacagccagctgtgtgatcaccttttcaggggatgataggctgacgggcaggtggggtggggtggggtggggtggggtgggcagactaatacagggaccctgtgtttgggagcctctgtttaagcagagaccgggcctggagagagtatccctgggtagggaaaggtgctctcacattagtgggttccacctggccccttggtggagctcccattcattcattcactcattcactcattcattcacatcgtgtctactatgtgccagtctctgtgctaagagagtgatccaagcagaaggtctgaaatcctcagggattcgtttcccagccgacttatgccttactaagtggagcaggttctgggctgcaggggactgacttgctgctgcaggtctgggtcttgaactaagggagaaagacaatgcccatcttcttcttggcgcagtcatttgaggagaggagcatttgcttcttgccaacctgcctgcctgggaggccctcttgctcctgcagccccccgagtcccctttgcagctcccagtcttgcttggggttgcctcctccaagaagcctcctgggctagctcaggcatcctgtggaggcactgctgggccactgatgcctgagctcctgtggcctggctgtctgcagggcttcagtcctggcctttcacttcccagacatgagtcttatctttccacttggttagggcctccccacggacatggacggatatggtttggatttgtgtccccacccaaatctcgtgttgaattgtaatctccagtgttggaggaggagcctggtggggggtgattggatcatgggagcagagttcctcttgctgttctcatgatagtgagtgagttctcacgagatctggttgtttgaaagtgtgaagcacctccccctgctctcccttctgctccagccatgtaggacgtgcctgctgtcccttctgacgtgattgtaggtttcccgaggcctccccagccatgcttcctgtgcagtatgtggaaccgtgagccaattaaacctcttttctttataaattacccagtctcaggtagttctttatagcagtgcgagaactgacagggaccgtgtgtttgggagcctctgtttaagcagagaccgggcctggagagagaatccctggggagggaaagctgctctcacatcagtgggctccacctggcaccttggtggggctcccattcattcattcattcactcactcattcattcacatagtacctagtatatgtgccagtctctgtgctaagagaatgatctaggcagaagacctgcccgctcagggcttctgtttctagctgggagcaacaacagtaaactaaataagcagattatattgtataatatagtaatacttagaaggtgatgagactgtggaaaacaatacattagtgaagagggtgagggtattggatggaagagcgtgagtgtattaggccgttccacattgttataaagaaatacctgagacacggtcattaataaagaaaagagatttaattgtctcacggttcttcaggctgtacaggaagcatggtgctggcatctgctcaacttctaaggtggccttgagaagctacaatcatggcggaaggtgacgggggagcaggcacgtcacatggagaaagcagaagcaagagagagaaaaatgcaaggtgccacacacttttaaacaaccagatcttgtgagaactcactatctcgaggacagaaccaaggggatggtgagaaaccattcatgagaaatccacccacatgatccagtcgtctcccaccaggcctcatccccaactctggggattacaattcaacatgagatttggttgagacatccaagccgtatcagtgagagatgcagtttttttttttcaggggaaagtgttgttgttgttgttgttttaataagatataatttacataccatataccatgaaagtcgccatttaaaaatgtacaattcagttgcttttagtatactggcaaagttgagcaccagtagctactaatttcagaacattttcatcaccccagaaaaaaatctcatagccattagcagtcactcctcaatctcctcgtgccctaggccctggaaaccaataatttactttaggtgtctctggatttgccacttctggacattttatatcaaggaaatcatgcaatatgaggccttttgcatctggcttcctttaccaagcacagtgttttcatgcaccgccaatgctgcgtgtgtatctgtactgcatgcctgtagatggcggaataatattccaatgtatggatagaccacattttgtttatccattcatctgttgatgaacatttgggctgttttcacttttggctattctgaacaatgctgcgaggaacaagttttttttgtacaagcgtgcaagttttttgtggatgtatgttttcatttctcttaggcaaatagagagacacaattttactttttatttattttattttttatttttttagagacaaggtcttgctctgttgcccaggctgaagtgcagtggcgccatcatagctcactgtagcctgcaactctatggattacatgttcctcctgcctcagcctcttgagttgctgggactacaggcataccccatcattcctggataatttttaaatgtttagtagagatgagttctcactagattgcccaaattcgtcttgaactcctgggcttaagtgatcctcccaagttagccttataaagtgctgggattagaggcatgaaccactgcacccagccacagttttaaatagggtggtcagagaaggtctcatgagaaggtgacatctgagcaaagacttgaagaaaataagggcagaagccacacgaaaaccccagcaggacagcaggtgcaagggaacagcaagtgcaaggatgcttccaccaaggggctggaaaatgaaaggcttgacttcaccagctgcctcccaaccagggggcccagtgagtttaggcctcactggccctttctggctgaggggcagcctgctgcgaggggtttccctttctgaataaagagtcaaagtcccaagacagatgatttttgacccatgcatcttcttcctgcctggaaagcagatgtgattcctggagatggggcagctgttctgtggccatgaggttgaaatccatgtgctaaagacagtagagcagaagaagactgggaccttgatggcattcttgagctaccgcctgaaccttggatctcctgcacctgaactttgctctgtgacacaaagaagaccctttcttatctaagccactcttatctaagccaccgcttgtcacgttttatgttgtttgcagccaaatgcattcctcattgatggaatgtccaacattgtccccaagtcccccagatagatccctgggggctcttgacagacagacagcaggcaagcctgggacacacgctgcccccttctgctttcctgtccctccatcgtgttaagctggtctctcaggtgggcatcaggattcagctatcccaggctgaccctgaggtccaccatgactgtgctgcagccaccaccactggccgcttcatggcatgtttccagcacaactctctgacctggctcccccggttccccagacgcgttccccacggagtcccagcgtgtatgcatggggtcacggtgctccacgctctcaaccgttggttgcaggttcccgtccagcctctcaagctggctgctcccctttctcagttgtcccctgtgcctcttgtaccctaacttcagtgttagagcacctttcagggggaatggcgtaaaaaagccttcctttccagtagacagagtgccctggccagcagaggccaaacacattcccattcagctttgtttcatgctggatctggccccaggcctgcacctggccctggcagtgggcgcacgttaggtgggattgctgaagacaatgggtgactgaggcagttacaggtgtcagccccagatgaggctccccaacctgtaccctttaccctggagctggccccatctctcacagcccagtggtgtactaccttaggtaagcaccagttgcgcctcactctaatgaaaataataaaagctcaaatgaccagcactgtcctactgctttatacgcatgacctcaggtaatgagaattagcccacatccattcattccacaaatatttatggagtgcctactgtatgccagggattcttccaggcactggggagacatttaaaaaacaataacaacaacaacaaaaatctgcgtcttgtcggaacttccatatacacttccactggctacttcatggaaacatctggaacatctgatttttctagtcttcccattactaaatgtggcacaagaacgtagtctaaaggatgtacttcaccatgcaaaagctcttgtcatttcagaaaaggaaggagaattaagtaaaatgtacttcaagaaagtcagttaagaatttttccagttaatgaaaatttaaaatgattggctttcatcttgctgttttccagggtcccactattaagaactcactcatcctgttgttattaagggtgaaacccagacatttccttatgtaaaagccaattaaaataaattaaatgcaaatactgtttcattgtcatgtcagttttgagaaccggatcaatcagaggttgtggaaatgccaaagttgttaaggctgtggttaccatgacaacagctctattgtgtaagtggtctgttatttgggaattcttccttaggtcaggctaacagtgatgtcatttctcagggaaggggacggagttctctggagtcaggtctggggccaggagacctggtgagcaaaaactggggttcagccagaactaccagttttgtgaccatgggagacagtcccttccccttttgcctcagtttcctcgctttggggatagccattgcacagctgtgagtatattgtggccattcagcacttctcaaaagttgctgctctgctaaaaaattttggggattcctgatttgccggctggttttcagcctatgttttggggaaatgcaaatgataggaaaccacccctggtcctgccttaccggttctagcagacctttggtgaaactgggagttcttgggtcctcttggctagtggctagtgaatacctgctgggggagggggtgtttgctttgctttgtgttgggggtggggttgttattggtttttacattttgtttgcaatattgggtttgctggtttttgtgttttttttttttttttttttttttgagacagagtctcgctctgtcacccaggctggagtgcagtggcatgatcttggctcactgcaatctccacctcccaggttcaagtgattctcctgcctcagcctcccgagtagctgggattgcaggcctgcaccaccacgcccagcaattttttttttttttttgtatttttagtagagacagggtttctccatgttggccaggctggtgttgaactcctgacctcaagtgatccacccaccttggcctcccaaactgttgggattacaggcgtgagccactgtgcccagccgggttgctgttttagttggtttttgattttagagagagggtctcgctctgtggcccaggctggagcacactggtgccgtcggagcacactggtgccgtcatagctcactgcagccttggccccctgggctcaggcgatcctcccgacatcgtaattacatttttgcagggttttcagttcacaggtgtgctctcccacatccccatttaagtttacttatttttcagccccagcctctgaggctatcattattttacagacgagaacaccgggactcagagggtgatttgtccctagtctcagggctccaaggcggcagtgccagcgttggtgggggtccccagtgccaggccagggtggcactgttctccctgtgcctctctgcttgtccccactgcctgcttctgcagaggcctgctcagagcaggtttccagcaaccttcctcgccagcatcctgctaagcaggccctggagggcggtttccctgcttccccacaccgggccagagctgccttgatatttatttcagggcatccctgcagagggaactgctaatgcagtcatggctttaagacgtcacaagccacagctgcaggtgcttcatcttaaacatctgccttcctggctgggagaagcccgggagcacctgctgcaggtgtctttgcacctcggtcctgctggtcccaggcccagctgcggccaattagcacctctgttgggcaccatggccatttccttgctgcatgggagccgctggcctttttccactgtgttgggggaaagttgttgggaaatgaggaagcagttggggatttaaaaactctatgcaggaaataggctgttgggttaacatttaagccactgaacagtcatggagtgtttgcttggaagtgaggcccacgaggctgcagagggccatgagattcaaggatggtgttcgtcaggcctgtccgtcatcctctctgggttcgacaccatctcagggtactcatgcctgttaggtgcttggtgaacaaaggcatcccagacagaatcaacccagaaggaagaggggtgggtggtaaacgttcgttaacttagccatgttctcttagggtttcttctcaaaataagggcagatgggagatctccctgcctcaaggggtccctggccaaggggctacaggcagatattgcccagtcagccccagtgaggtgacagaaggcgggaggtggcttcagtgtgtttgaaggaggctggcatcacaggttctaaagcagatggcaggagccctgtggctgggcctgcttcagaaccttggctggctgctccttggaggtgaggtgggggcaggcagtgttggctggagacttgtggggggaattggccgcctggggtgcgtgctggcctgcctgccttccgcttccgtgccatgagccccttgttctcagctgtgaaggtaggtgaggctgccctgcaccagccagcagactgggttaaggtgggaatcaaaggagaggaggtgttcagctggctggagacctgctgagccccttgcatgaggagggatttctgtccagcgcccctggtcctcaagctcctcctcagcagcgttcatgagcacagggtgtgggtgtgactggtccctttgggcagaatctgagagtgcccccttctccctccctgtgcatttgaaagttggctggtgctcgctgacagatgccgaggctcccgtttggcagctggccatggcagccgcttgtcctccactctccctagatttggctgagctgggcccctgctgtgccccacatgccccggctctttgtctcggttgtccctttggctcagctctgggtgtcggctcctcggaagcccttcgtcacccaaccagagtgaactccttctcccaggtggccagagcatgttgaagtgaccctgactttcttctgtgggtcctacattttagcggggagtacaagtgcctcttcactgcagcatctcctaaggaagtgagcctgtggggaggtctctgatgctactgggaatccagcttcaccttcccccaactcctgggatttgcagccacagctaagagtgggagaactttgccttgtttgcattgctccagatcgtgttaaacagaatttcaaaacatgcattttgtaggtagtagttctgtcatccagaatgtgtaaagtaactctctaggtagctgttatggatggcctgcaggaaggatcataccagtgacttcttttgagccccctgccgagtggctagcgtcaggtgggggattagactctggttctttgcttcctggccctgtgagccccaggcaagtcagttaacttcttggagcctcagtttcctgacatgcaaatcatactgacctggtaaggctattgtcaggattatatgagctattatatcctaaagtatattatatcatactttatagagcgtagtatatattcaactaactgcatttgtgttagttcctttattttgttaacatggggatcaatggctttttttttctgatttggtatttattttaagactaggttgggaaccaattttccatagtcatctgtgggtataagtactcttaccttcagccaggacttaattttggccaagagccttggcttattccagcagagagtggagttatttagagccaaactgtaggggactgaattctctgtgtagcactttctgcagacagtggtaacattaatgacttactgcatatacattcataagtgggtgatttatggttagccccggatccataactttcatttcctgactgatatatcagaagcttcatgtataaaggcgcattagatttagtaagtgtaaaagacttaagttgaggtcatttctgtccacaagctgttcatggtgtagctgttcatgtagctcagctgtgggaatggcctggccctatgtgatgcggaaagacagccaagggggacagtggcacatgcctgtggcacttggttctgtgtgtggtctcctttgtatccccaggaactctctgcaataggaaggtgatggccaggatctcattttacagaggaggacactgaggcccagagaggttaagtgacttgtctgagggttaacagctcctgggtggcaggatttacattggcgctcagatgcatctgaaccccaacctggagtggtgccagcacagagcaggtgttcagtaatgtttgctgacctatgtgatggttaatatcatgcgtcagcctgactgagccaagggatgcccaggtagctggtaaagcataatttcaagttgtgtctgggagggagtttctggaagagactggcacactgagtaaggatctgccctcaccagtgtgggtggatatcatccaatcattgagaacccagctagaacaaaaatgtagagaaagagtgaatgtgctctctctgcttgagctgggacacccaccttctgctgctcttggacatggagctcccggttctcaggcctctgggcttgagctggagtgactccaccggctctcctgagtctccagcttgcagacagtaggtcttgcgactcttcagcctccataataacatgaaccaattcctcataatacatttctgtctgtttatttctatatatttattggctctgtttctctgaagaaccctgactaatacttccccatctgaactttctctgccccttttgttcgacatgtggggggttgctggggaagctaattagaatacaggttcctgctgacaccccacccccactcccttccttcatcaagatcactagtggtgagcctttaaatgcctgtaagctgtccgaggggttcttcctaaattaaattaaatttttaattttaattacttaatttttttgagatgggatcttgccgtgttgcccaggctagtctccaactcctgggttcaagtgtcctcctgcctcggcctcccaaagtgctaggattacagatgtgagccgccactgttggtctctaggggttcttatgcacctagaatttagagactcattgctccaagcttcattgaatctttcctgaacagtcttgtgataggcgggataactcccacccctcagatgctcacatccgaatccctgggacctgcggatatgttgccttatacggtaaagggctttgctatgtgatgaagattgaggaccttgaggtggggacagtatcctggattaccagggtgtagtcactgtattcatgtaagtccataaaagtaaggaacctgtcccagctgcagtgagcccgagggaggtgtgactctggaagaagacgcagagatgaaacactgctggctctgctgacaggaatggctttgagccagagtgtggtggcctacagaggctggaaaaggcaagggaacagatccacccttaggtcccccagaggaaccagccctactgacacagtctccgtgggacctgtgtccacagacagaactgtatgaaaacacgattgtggtgtgtaagccactaggttgatttgttacagcagtgacaccgggctttgtctctgcttttgacttttcctccagtgtgatcccttcccctgcttctgacccgtggatcccagccctgcccaggcccagatcctgggctccaggtgggcctgggttggggctcccagctgcaggaatgcaaagttcatggttctacaaagtgctttgaggtgacgttggtcacatcagctcggcctcagatttgctgctttttttctaaagaagagacagctccaggccctgcctgactgacctagttggggatgcaggccgaggccatatcgagcagggtaagtttccaagaatctggctttaggattagtcgggccacacggaaggagttcctggtctcgtgacacctgcacaaatggtcttcaaccctcaaaacacttcctgttatttaaatcttggtcctttgattttttttttttttccttttagagactatgcacaatttatgtggcaagctagagatgctttctttttcagagcggcctttatgctgtgttcggggctgtctgtcggcgccacagggaatgggggctggtgagtcgtgctcagaaggtcccagtctagatgcttctgacatggacaaaaggagaattcctgactttttggtggatgtttgcaattcccagaatgcttattcttatttagtcctcataggagagtggcgaagggcagcagctttggagcaagggccaccctgcccctccccaccaagccctgagtcgtctaaccttcccggtgtattagtcagctctggctgctggaaacggggtcatagtctgggtgccttaaacaacaggaattcttttttttttacagtattggaggctgatgtctgagacagggtggcggcagggttggtgtcacccgaggcctctctcctcggctccgtgtagccctttctccctctgttctcacacggccatccctccgagtgtgtctgagtcccagtctccttgtgaggacaccagccctagatcaggagccacgcagtgacctcattttaccttcatgacctcttcaaagtccctgtgtccaaatacagtcacatctggaggtagtaaggattggggcttccacataggggttttgtgggggacacactcagtccacgttaactcacttcctgcccacggcaggggctctctgtcagtgtgtctccgactgcggaccccgatcatctttgtgagaatgcaggttcccaggcccacaccgtgctggttgagtcagagcttctgggtgcagcctgggggtgcagcaagcccacccctgcattcggagagccttagcgggaagcctgttgcttgtgcctcctttgcagccccggcctctccagttctctgtgtcttgccatcttggcttcttcctcatcccgcctctcgctccatctcgtggcctcccatctgctctcccggctgcaggagcggtttctctaagccttgcaagtgaccgcaccctcttactgcatgcgggccttgccaagagcctgcagagggcggggcgggctctggggacagcctggactctcctgcctgcccccaggtgcccccggcccagccacagggtgctggctgcctgttactcagcacgtccgcctctcctgcctcctgagcccacaggcgcccttcctgtcacccgagcgccctctccttcctcacctcgccacctacgcatcgtcacccctcctcctgcgtttcctcctgtctccccggggagctcggagttctgcaggcacggggctggctcctttcttcatgtcccttgtcccacaggacaccgtttctgaacccaggagacactcaggaaaccttgctggtggaacggatgcagcagcgaggttttccggggcaggaacaccctcccaggagcttttccacggccaagcgctggctggtggtggagctgcgctgaagtcagtgtgtgctttgggcccagctgcactgtgcccggggtccagggatgggtgtgaggctgtctgccccccactgcacgcccggctgtcagaggcatctgtctcttcccccgcatgcatctttctccccgtctggcatggtgtttctagtcttttgtggatggggacataaacaagccgccatcaactgcttggtgacattggccaatcctgtggtggccccagctgggcttgctgcctgtgtgtggtgagggtgcccttcttgtcacccgttgtcatttacgagacagccctgtgtcacctgttgattcagagggagctctcctcatcacctgttgtcatttatgagccccgtgtcacctgttgttgcttcacagggagcactccttgtcacctattgtcatttatgagccccgtgtcacctgttgttgcttcacagggagcactccttgtcacccattgtcatttatgagccctgtgtcacttgttgcttcagagggagcgctccttgtcacccgttgtcaggtgtactcactttgcttctcccttcctgcttttggggacgatcacaggacagtggcttcagaggggaagtacctcgacctggctgaggtcatgcccagagcctgactgctctctccacccacccatgatcccgtcagcttcttccccctccttctccatctgatctgagcatttaccatttccttccatttaagcttcatttgagttgcatcatgatgttctccttttttcaaagttccatctgcccacaggtttccattttctctagaaccctcctccttcctctctagcccctggcccgcccctctgcggttctcaggaagcccctcggtgccccctgccccttatctagaacagcttctgcctagggtgggcaaggcagggtgggaggtggggggtagccgtgcagggaaggggtgaagcgggcccctgtactccctagctgggctgcaggcttggaggaaaataagagtcagacgcttgttaaaacagtgaggacagctttattcgaggaaaatgcagtcggggttgaccttatcagcaggggagagatcagcccaactcctaatacagcaaggaagggacagagctgggaagtggagtgggctgggtgagtggaaagtagctgcgagaagacatcacaggtagggggattcttgccaaaggcagggggggactttgatgtcaaaggtggggatgaggactgattggatctcaagggtggtcagatgtgaagggcgtgagaggctcactaaactgactaagcaggattcttgctgagactgggccaggcaggctgaagacaggaggcagaaagagggctcagaggagcctgagtgaagtttgatcttggggtgaggggtgcaggggggaggggcagggtgggtctttgttggggctctgtgggagatttcagggctcactggatgtgtggggcacagtgggccctgcctgagccccatgacgcctggacgctgccaccaggggcctgacctgctgacgatctctgcactgggtctttaatcagcctcttgggcattgtaaatgctagacaaagattcttctctttttaaagtttactaatttccctacgataaaactaatgcattttcacaggagagactcgggaaattaccaaggagcgtgaatcaggtggtcacagtgaattgtggatgtttgtgtctgtcttggggaactggtgtaacgtttctccatctgacccctgctgtctgttggaggtcaaggagccagcctggcctcacaacttcctcctttcagcaaagtcaggaggccattccctccagggatgggtgggctgcagcctcttggcacctctcgggatcctgctggcagatgtatcaccgtagcccaagccagcctaagccagcctcctgtggcccagcaccttctcttcccacgtgggcagctgtgttcccaggcaaaccttcctggaattgctctgtgctctcagagctggtgtgctttggtgttcagctgtggccattttggctttgagtttgatttgatttttgaagaaagtttttatttctttacccaaatattctatgtctctttggtaagactggaaaacacagaaaaacagagaaaaaaattcccccataactaccctgcccacctccatataacttttattagcattctgagctatacccctccagactcatttctgcctctccagaagtgtgcataaagtctagaaacataggtgaagagacctaatgccatcaagaacatcaacctgtaaaggaataaaataatgtcatctgtgtccagattttacagatgctttgtagatatgtgtaacagaaatgtgggtatgttttagcaaaaataagaccatatttttgttttattttgattgattgtactataaattccagtagagcattacagagccagcccaagcccatctctcctcttctctactcttttctttccccagtgaccaatagccactctgcggagggaagtagggatcatatttgtgcgcgttttacgctcttgctacacatgtgcgtaaccttaaacaaaacattagtttttatgtgttagaaatactcataaatggtggcccaggcatggtggctcacgcctgtaatcccagctcttcgggaggctgaggcaggaggaggcttgaggcctggaattcaagaccagcctgggcaacatagcaagaccctgttttgttttgttttgttttttaaacaaacaaaaaaaccaacaacagttaggtgggtgcagcatcatgtacctgtagtcccagctcttcaggaggctgaggtgggaggctctcctgagcccaggagtttggggtgatagtgagctgtggtcacaccactgtactccagcctggatgatggagtggagtgagaccttgtctttaaaaaaaaagaaaagaaaacagaaagaaatactcataaatggtatatatatatatcactttgtaatttgttcttgactactttgtcaacaatttttaagctgtatccatgttgatacatagatgtggttcatggtcttcttttttctcctttttgttaactgctgtatacaattccattgacttttttttgaggcagggtctcgctctgttacccaggctggagtgcagtggcacgatctcggctcattgcaacttccacctcccaggctcaagcaatcttcccacctcagcctcccaagtagctaggactacaggtacatgcctggctaatttttgtattttttatagagtcagggttttgccaagttgcccagcctggtcttgaactcctgagcgcaagtgagccacctgccttggcctcccaaattgctgggattacaggcgtgagccactgtgccagcccccattgtctaaataagccatcgtttctctagtcatatacagttaggtcacttccattttttcattagtataaagagtgccatatgaatattgatcctccttgagtgctgtggaaggaagcctctaagatgccgccactggtccccacatcctggtcttcacacccttgtgtaatcccttccctcgggtgttggctggacttaactgacttgattctaacaaatagaacacagcaggaggaatgggacatcacttctgacatcaggttataaaaagactgcagctgccagcttgggtgttctctgttgccctcttggattgccagccctggagggagccagatgccatgtctcaaggcagtcctgtggagaggcaggcctaggtgacaagggaccaaggcctgccaacagccatgtgagtgagcttggaagcagatctccatccgctccccactcccagctgagccttcggatgagactgctgccctgaaaacagcaaaggggaacctcatgagagaccttgagccagattcccagcccagagaaattgtgagataatgtttgttgttttcggctgctgacttttggagggtcatttgttacacggtaacagataaccaatacgagcacaccctgagaattccttagaggtctagaatatttagcagtggaattgccaggtgctatggtattctcacgctcaacagtactgtttattactaaattcatctccaaggcatttgtggcagtttcactcccctctacaagggtcagtgagctccttttcctcatacctctccggcacttgtgttgtcagactttaacatctgaacactctgatgggtgtaaaatagtatctcatgattatttgaatttgtacttccctaagttctagtgaagttggacatattttcgatacattattgtcctttctgctttcctctgctgtaaattaattgcatgttcgtatcctctgctgtaaattaattgcatgttcatatcctctgctgtaaattaattgcatgttcgtatcctctggtgtaaattaattgcatgttcatatcctctgctgtaaattaattgcatgtgcgtatcctctgctgtaaattaattgcatgtgcgtatcttctgctgtaaattaattgcatgttcgtatcctctgctgtaaattaattgcatgttcgtatcctctgctgtaaattaattgcatgtgcgtatcctctgctgtaaattaattgcatgtgcgtatcctctgctgtaaattaattgcatgttcatatcctttgtccagtctccttttgggtggattatctttttcttagtgatttgtagattttctttttttcactctagagactaatcctttgtcagttcatgctattttatactctgcttttttcagttagcagcgtattgagaatgttcttctatgccaatgtatacatcattttattgacattccattgtggagatgggtcatttatttatttaggtggacgtgtaggttgtttgcacttttgcattagtaggaacatgactgtgtgtcggtcagctgggctatgctctggtactaatgaccctccaaatcttagtggtttgcagcaatgaagaattctttgtccctcaagtgacatgaccatcacctgttggttgtggctctgctctatgacgttgtccctcagggagccaggctttcagagcagccccatctgagacattgctggtctcatggcagagggaaaaaagatggtggaacaacataattctatttctgtttttcctctttagagacaggatattgctgtggcacccaggctgcagtgctctggtgctatcatagctcactgcagccccggaatcatgggcacaagtggtcctcctgcctcagcttcccaagtagctgagactataggtatgcaccaccacacctgggtaatttttactttttatatttttcgtagagatgggggccttgttatgttgcccaggctggtcttgaactcctggcctcaagtgttcttcccaccgcagcctcccaaagtgctgggattacaggtgtgagccactggacccggcaggaacaatatacctcttaaagcttctgctcagacgtgggaatggctatgtggtgcgtgtcagttcccctcacattgcattggctgaagcaaaccctggggcccaaccagtgttggcggggttagaagtagacccctcccatagggaggccagggagggaggattttgagccaagaccactcaccacgtgctgtgatgagcagttgcctccccctcctttcgtgtcttcgtgcctcctcacgtattcttacaagtagaattgctacattaggaatatgcatatttgtaaagtatttactatttattatgtcagctaggttttaactgtcactgcatttgctgtgaattataggtaattattcatcctgatgaccatttaaaaaagaagaacaatattattaggtagaaatagtccctggctccccggttgcccaccgtgactataacagcatatctagcttggtagttttcaaattatttccacgttttatttacttctcacagcctccctgtggggttgcaggtgcttctccactcctccactgacaaggtgcctgaggctcagagaggctgagaaatgtgctctgggctgcacagctggggatgaggcgtagaccctggccctgctctgttctgggctctttctcctccactctggcctttggaggctgtggctaagatcttcccccagccccttccttcccaccttcccttcctgctcttgtgccccgtttttcacagtcctcagtggctggtttctcagtcccccaggaggtgcaggctggttcttaggaatggtctctgtcaatgttcccggcagtacctccgagcctgccctctgaggatgggtcggccatggctgcgccggcttagtctgtatttaggtatcactgactatcactggacttggggaggggatttactatttttagagaaagtcaggggagctccataaatcctgttagtcaacagaactgcagagaggtggctgtttatgaaggagagtgacttttttagaagtggcgcatttagaagaccacatattctatcattctgtgtacatgagcggtgcagaataggcaattctaaagagacagaaaatagattcgtgattgcagggagtggggaggagggatgggaagcgactcctaaggggcacggggtttcttctgggggtaatgaaaagcgttctggaattagatagtggtggtggctgtaggacctggtgaataataaactgaaaatcactgaatcgtaccccttaaaaacacacaaagcaaattgacaaattattgggaggcaacataagagaatggggtgtgaactttggatcagtgcggcctggatatcagctgtgtggtgttcaaatagattgcataacctcgttgagtctcagtcttcccatctgtgaagtagggatcattcctacttcgtagggttggcatgagactccgtgagatgaagttggtgggtcacttggctggggcaggtgtcacggagcgggacctgtgattgttcagccacctactctgtgcccagtgctgtgttggtgaccaggtatgtatgaagtcagtaagccacagtcctgagttatggtgcagaccccacatgcacccagagtcagcttggcaagaccccttgacaccacgtgcgtggagggtgcaggtcggagagctcacctccatggattccgtagagctttgaggcgtatccacaaagtgtccaggagaggtggcgtcgcctccacttgatagaggaaaaagcagagatggaggcagccagaagcatggtgcagtggtggggtttggtcattaatttgataatcacatggaatacaagctaatgtttattgagtacttactgcctgcctgctactgtaactaagtgctttactcctgttatctcatttaattctcaaagcagccctgtggcactgaggtggctggagatggagggatgtgtggctgccatgtgtttgccaggaagcagcaggatgggagtgagggcacagacagacacacatgccaggacttgtttgcacgaagctgaggaatgggtgcccatcattcattatactcatctctctgttttatgtatatttgaaaaaaaaattttttttgagatagggtctcgctgtgtcacccagactggagggcagtggcatgatctcggctcactgcaacctccacctcccgggttcaagtgattctcctgcctcagcctctggagtagctgggattacaggtgggcgccaccatgcccacctaatttttttttttttttgagacctgtcacccaggctggagtgcagtggtgcgatctcggctcactgcaacctccgcctcccgggtttaagcaattctctgcctcagcctccccagtagctgggattacaggcacatgccaccatgcccggctaatttttgtatttttagtagagacgggatttcatgcctgattaatttttttgtatttttagtagagacagagtttcactatgttggccaggctggtcttcaactcctgacctcaagtcatctgcctgccttggcctcccaaagtgttgggattacaggcgtgagccaccgcgcccagccatatttgaactcttttacagtaaaaagtttaaaaaacaacaatcctatgaggtaggtcctcttatttgtgctttacagatggggaaattgaggctcagagcatgtaagattacacagcaagattcggagatagctcgccatgttcatgcccggcaggacgtagcaacagggctggcgaaacggaggccccaggcttgtgggcctcctggggttcctgtgcgttgaggcctgagcccctgcgtgcgcccagcggagccagcactctccctgtggtcctactgggcatcacaggtgtgtatgtgaggggtatggggaggggattcttggttagtctgggcttcatgacattgggatgagttctttcacttggttttgttgatctggtaaaatctgtggtcctgtgatatcaccttgcttctcatagtatgagccttcaacatttggcctcagtggtggggtgtgcctgcaccgccttcccccatccctgcctcggctcctccccacaacaaagcggaaggaagacatagacccaagggtgcacttcagcccctcaaccagctgtgtggctttggagaagcggcttaacatctctgatcccagttacctttcttgaacgggaaagatatcaatgcttccttcactgattactggagcttcttggtgtgcagtgtctaggctgctttctaaccatgtaaggtgtagccacagtattgtaggacctgttgctaagaactgtgccactatcttgataaacatgttttccagggactggtggtggaatgttctagttattaatgtgcctttaacgttggatgactcagaatatccctcagatagtaggaataggtagctttgagaggtcatctgtaggagggcgcaggaacatcccaggagggggtgtcatacctgttggcaccatggggatgcaggctcagaggggactgaactttccagggccacgcagtctgtaagcggcagagctgggacgcaaccccaagcttgctgctctcaaagctttgctttcaaactctcacttcagacatcagggcttcctttcagactgagtcttatccctaagcactgttggagaagaaagtctccaggctgcagggccccgcagttcccccatatccctgcccttccagccagcccacgcctggggcctgtcctcccctgttcctgaatccctgtcctgttactgccctccgggtaagacagcactcttataatcatgcttcatgccgagttcatgaaattaactctcaaactcctcttctctgggttaaattatttcacttttttcccttcctcatagaatatcattataaattctagatactatattggatatgtaataaaatcagaataaattacatgtgatggccactgaactaacctcccttcatgtgtctggaggcaggttttctgtggagttatgctttaaattggctgtccttcgcgatttttcttaaagcctaggttgactactcaagggtctagatttatgatagaaactgtgggctggggtgcagtgctggggtgctggggtgcctgtaatcctagcactttgggaggctgaggtgggcggatcatttgagcccaggagtacaaaaccatcctgggcaacacggtgaaaccccatctctacaaaaaaatacaaaaattagccagacacggtggtgcatgcctgtactcgggagactgaagcgggaggatcacctgagcccaggaagtcgaggctgcagtgagtcatgattgcgccactgcactccagcctgggcaacagagcaagaccttatcttaaaagcaacaacaacaacaacaaattgtggcacaaatgtatgcatggaggtactgagggccttctttatagtaggctcaggaatgaccaatgggtgggggctttgggggaagagacgggggtctttaagcagaaactctcccctcaacacaagaaagctgctgaaggacttcagaaacctaaacacgagccgtgggcctttctaaagtggggagggattccctcctgcctaggttatgttgcaaggctgcccgagagagggtggaagggggcaggagagtgggcattggctgggtccaacgcttcccaagagatgtgactgtcttaaaagcaataccttcctgattaccacgggaaaaattcaaatgttttgaaaagatctacaagtttggggttgaagaagtcctttatttcaaagtttctctgggctgggcgtgctggctcacacgtgtaatcccagcactttaggaggctaaagtgggaggatcacttgaggattgctttgaggccagcctgggcaacatagtgagactctgtctctagataaagttttttttttttttttaaattagccagatgtggtggtggtgtgctcctgtagtcccagctacttgggaggctaagttggaaggatgacttgagcccaggaggttgaggctacagtgagctctgattgtgccgctgtgctccagcctggtgacagagtggaccttgtctgtaaaaataataataataataataaagctttgctccccgtttcatttagatggagcgtttgtgggatttaagacagatttttccttgctgagtggttatcattaacctgttgaataagcaacaggccgaggtggggaccctgcctcgcccgcctccaggggcacactgcattctttgtggaagtgtccctggaatgccacagccctgcttctgtgcgaggccagtcagtctgggtcctgggatatagccacatgtgcagtccgtgcctccagcgcgcagcctgaaagggaggcgtgcagaaacaacgtagctccaaggaggactgatcagcccagcctgggggagggtgggaggggactcccagggagcggggcttgtgctggactttgcaggatgccagacttttggcaggggaggaaattgaggtgaaagcattccaggcctagggaacagcatgtgcagaggtgctggctggaggaaccccgtgtgtttgcactgtgctctgagctccctctcatgactctcattctttctcgttgagttttgttttgtcacccagccggactcctgggcaaagagaggcacaatctgttcccggttgggccagctgccctccagtagctacgcaggatgctctggccggcctctgaggattctcttcttctgtccatctcatggctgaagaccaaggctatggcctgtgggtggcagttggtacctctccccgctgccttcccccggcccctttttggacaggatgttgctccctggggcctggctttggagatggccagtgctggtttgaagcttctgtcttctgtgtgggatatcagtgccctgccagctgttgcaagttttaaactcaatgtgcctctggatgtgtgtgtagagtaggggtccttccccagctccaggccctgtgtgtttccaagtgggcccgcagctctgatgtgcagtgggtatgcactggcaagccgtgcactgtcacaatattaaaataacttccatggtagttggtaaatagccccatcacccctctcctgggaccctggacctctagcacaccatggaggcctgccccgtccccataaaacacaccacattcaaattacttatctcctcttcccctgccactctgctgagaaggctgatctcaatcctcggagtaatgactctcttctaggagcaagatgatgctaattctcactagcatgtgaaggactgatagcaccatatctccctccaggactcccgggtgggaggtgggtgtttgcataggcaggcaggtgagccagcctagtttgtccacagacttccatgcaagtgattcctgctgttccctgggtcttcctttcttttgcttctgaacttggaggtttcttgaagtctggaggatttttagggtgggcatggctttaggtgggacctccactatatgggtttgcaagctgccactgctttgactgcagacactggattgaccgtggccaatgccaagtccaagagatcaggctgaaaccaggctaaattttaagagcagaaacaaaactcatccttgcgaagggacttttagatcagtggcagatggcatagaaagtctttctgctgttctcttgtgctgggcgtggctcagggctgaggggagagaggagagatgagggcagaaagagaagagggggcaggcctcagggatgaacacatggcccatggctgtgcgcttcccaagcaagcagttctggagtgaggcttgggcctccatgcctcctgggaggctgcacctcttgggatatagagaacgctggcttcagacccggcaggagtaccggcggctgtgtggtgcatcctgcacagagctgttgctttctaactgggttactgagctgtcgaaggagcagggatgaagactcccttattaaaaactaaacaaaacacaacacgaaaaagccagaacaaaacaagcagacggttgaggactgcagtgaactcattaaccctacagctttgatctcgaagtctcggccgctcctggctcagaggaccctggggacgtggtctttgatgcttgctttccccataggcatcacttcgaccagcgtctgtgtggggtgtgcagcagccctgagccaaggattaattacgtaacaagcccagatcccatccctgcctgagcaggccatgtgccagcaaggggggccccgaagtgccgctaggtgcctcacgattagcataaggcccgtttatccaggaagccagaaccagtgcacatctgttaagcgcatgcaccaagcggcgattccatagttgtatagtgattgtctttatggaactccagaatagcttcttagatatcactcttcaggccctgaaatggagccctgtgcaaagaaatgaagaaaagctatcggggcatctgcagccactattataccatctggcagctcagaaatattttataatcaaatgagtaagacgggcgtcccacactccacagtactctgctcccccttcccttcctcccaggacttgctctgtctctgtctctttctctgtgtctgtctgtctgtctctatgtgtctgtttctctctccctctttctgtgtgtgtctctctctgtgcctgactttctgtctctttctgcttctctctctgtgtctgtctctgtctctctctttctgtgtgtgtctctctctgtgcctttcagtctctttctgcctctctctatgtgtccgtttctctttctctctgtgtgtctctctctctgtgcctttcagtctctttctgcctctctctatgtgtccatctctctctctttttctgtgtgtctctctctctgtgcctttcagtctctttctgcctctctctatgtgtctgtttctctctctctctctttctgtctctctctgtgcctgtcttgcagtctctttctgcctctctctgtgtgtctgtctctgtctctgtatgtgtctgtctctgtttctgtctgtcttgctctctctgtttcaatctctctatctctgtgcctgcctgtctgtctgtctctttctttctgtctctctgtgtgtgtctctctctccgtctttgggacagactagaggaacctttttcccaggagtgataatactgtactctgcgtttttgccacttgctagctgggtgaccttgggcggctttcaagttcccttatcctgggtttcttcatttgtaaaatggaagcactacttcacagtgctgttgtgtgggtcaagatgagatgaatgtgacctactgtggtactatttattatttgtcctagaaaaacttttttttttttttgagacagggtcttgctgtcacccaggctggagtggtggcacaatcttggcctactgcaaccttgacttcccaggcccaagcgattctcccacctcagcctcccaagaagctgggactacaggtgtgagccaccacacccagctaatttttgtattttttgtagagacagggtcttgctatgctgcctgggctggtctcgaactcttgggcttaagcgatcctctcacttcagcctcccaaagtgctaggattataggcataagccactgcacccatccagaaaaacttttaaaaattttgtgttttaactttttctgaatataaaagtgatacatgcatgttcactgtaaaatagaaaatataaagaaactagaaaactatttatgacgcccctcccccaccacaaaaggggcaaggactgcgaacttttgccgtattttggaagatttcctaagtcacacaagcacacagatggtctgttgatccaaaccaggaagaacaattgtgggaataagtggaagtgtgagtgtgtgggtgtgtctgagtgtgtgccctgggggtgtgtgtgtctgtgtatgtgtgagagagccaggctgtgtgtgtgtgtgtatgcatgcaaacacttatgtgcaatgccttggggtcctcagaccccccttggtccatcaggggctggtggcctcccagtaggacactagcacagctgcactcatgtccttctttgagggggggtgacggggagaaagttggggagcagcagtgactgctgatgttgtgggggccatggggagcctcctggtattctgtctcgaggctctggggatatggtgggagaagccctcatgccagaattgggaggggatggaatgggactgaccccatcacagcccacgtgcctcattcagggcttggctgtggagtcttgggggaggtgctccctcatcctcaaatgttaactttgtctgcctggccccagtcccctctgtggcttttttcctctttcaattgggaggcagttctgtcttaaagagatgtttaaccctctaggtctccgtgcaggcatttttgttgtgagccagtcaggctataaatggtccattaaaagcactgtccagttgacataaccggtctaccaggctgagacccacagacccgggactggcatttatttatggatatgatgtgcaaggagagtgttttccagtagcaggcgttggcatcatcaaacagaatgaagtgtactgtgttttcaccatgatagtacaaaaacgagactgtgagagcttctcacttctctccccttcctccccttccttctccatgtctttgtgctcctccactgctccctccccagcacagacaggccctggctccctccccccaccctcttccttctctctccttctaactggggtcaggaccaccctggaggatgttagattttaaacatttgttcctcttgtcatccccaccaccccacccacccacccagattagtttctaagggatttatatttgtttgcagagtggtgcgaactgttttcatcctcagaggagcagagtgctcatagatgagtttgacattactgggattcactttcagaagtctctagagagccccgcaccgcccccgccccccgcaggtgctggagttcagcctgacacacaggccggcctcagtgagagggagtgtctgcctccctggcatccgtgacccatacggtgggcgcctgttctttagaacaacttgctccttccgtcgttggcttggtcacccagcccccggcccacccttttctgagcctgtcatccacaccaggcagagccctgtctcagagtctcatggggagcagggccttcagggaaggcccatgtgctgggactgacttggctcacaggaatttcctgatggtataaaatgtgccccccagcgcctgataatggtcacttcgcctaagttccagccccagatgtggaccacggtggggcaaaggtgggcgtggggaggaggaaagaggtttaaaatggccacacccactacttctcctttggaagtgcctcctgccaccctggggtcccaggagctgatctgtgggtgtctgtcctcagcacccaccctgcttttccttcaggccccgctctggctgtctgggcctttctggtgctgttcctcacaggtttaaacactccagcagcagcctttcccatggcactgtgtctgcggggcggggttgggcattttctgaggcttcctgtgtttcacggggatccagtatgaagcctggcacggagtatgggccaaatcggtttaatgtttagctccccaaacccttcacttctgtgtcctcattaattcagacaaggttgggtttagcaaactgtgtctcaaacataagaaaatgcagcgtgggaatgggggaggggaggagtgctgtagaaggaccatttcagaagccctggtttacaggagaaagattggtatcttcataagtcactcttaagcttgcatttgttcatgctttaacacagtgattagatacctactgtaagcctagcatggtggggatataaaagcaagatcaagttcaagggggcagggatttagggtcagtgagacggacctcttaatcacttattttgtacacatcagagcagtgacattgtgtttctttaaaaatactaggggccagcccgggcacagtggctcatgcctgtaatcccagcactttgggaggccaaggtgggcagttcacctaagatcaggagttcaagaccagcctgccaacatggtgaaacctcatctctactaaaaatacaaaaattagctgggcatggtggtacacacctgtaatcccagctactcgggaggctgaggcaggagaatcacttgaactcaagaggcggaggttgcagtgagccgagatcgctccactgcactccagcctgcacgacagagcaagactccatctcaaaaaacaaaaaacaacaacagaaaaaactctgggccagctgtggtggttcacacctgtaatcccagtgctttgggagaccaaggtggggggatcgcttgagcccaggagtatttgcccagcctgggtagcatagcaagatcctgtctctacaaaaaaaaaaaaatatatatatatataaattagccaggcagggtgatgtgcatctacagtcccagctacttgggaggctgaggtgggaagatcacttgagcccaggagtctgaggctgcaatgggctctgatcccaccactgcactccagcctgagcgacagagtgagactctgtctcaagaaacaaaacaaaactctggattctggccttctcctgggaaatccagatttgtctggtatgatgttcgttgaacccatttagtccagcagcctggctttccaaaagtatgtctgcctctcacggtgcccagtagctttaaccaaagagctcaggaaagggcctgtctgaattcaatcacattcagcatctatttcagcgttttactagctttcaattaaagtagccacgcatttgagcctgatggtcttattgttttatgttgttccttttgcacatttcctgcttgtttatctttgtggcacaggggcatgttcttggctgcagttaacaatgctggccacggcagtgcagcgtttccaaatttcttccctttattaacaggcggtaatggaatctgaatcttcaaaaataaattttacatacttgttctctaccataaaagtcatccatacttattagaacgtctcaaacatactaagaggtaagaaggagacaaaaaataatattttgtcacccctgcccaggtagccactcttctatttgagtgcttgtaagaagcctgcttttccagtattatctgacctggcagggagttgggtaattgaaaaagattattaaagaggggatcataaaaatgatatagacgccgggcacggtggctcacacctgtaatcgcagcactttgggaggctgaggcgggtggatcatgaggtcaggagagaccatcctggctaacacggtgaaaccctgtctctactaaatatacaaaaaattagctgggcgtggtggcgggcacctgtagtcccagctactcaggaggctgaggcaggagaatggcgtgaacctgggaggcggagcttgcagtgatccgagatcatgccactgcactccagcctgggtgacagagcaagactctgtctcaaaaaaaaaaaaaaaaaaaaaaaaaaaaaaaaaaaaagatatagacatattgagcatttcgttttgacataaaacgtttcattttcatataaaaatgcatttattccccatctcttgatacagggccaagacctctcttggattatgggtccactggcttctgtcctgatatgtcttttttgcactatccacactgttaatgcattttctgagattctcagtttctgtttctgtcaagtaatgtaggaactagcaccaaatccttgccgatttcatataccactgatattatacagttattttgttcatgcctaattgaacagccatcttcccccaaacattcaactctgtttcataaaaccaactccttttaattcctcttctgagggtttgcataaaatttaattaactttggtaattacataagtactactggtataagcaggtttggaaacaaacgtaactgagtcttggtgggctcagagtgcacctgcccgaaggttcccacatgctctatgcacccagaaggggacagagcatgccccatagtccaggggcaattaggggaagcagctaatgaagtctgctttcttctggccttttaaaaatctatgtccttttttttttttttttttgaggcagggtcttgctctgttgcccaggctggagtgcagtggcatgatcatggcttactgcttcttgggctcaagcaatccccccacctcagcctcctgagtaggtgggactattaggtgcatgccaccatgcctggctaatttttgtattttttgtagagacaggatctcaccatattgccttggctggtctcgaactcctgggctcaagcgatccatctgcctcagcctcccaagtgctagtaagccaccacacccagccaaaatttaaaacacctgtgcctcaaagaataccgtcaagaaagtgaagagacagctcacagaataggagaaaatatttgcgaattgtatagattctagacttgcatctagaatatataaagaactcttacaactcaataatacaagacaacccagttaaaaaatgggcaagggacttgaatagacgtttctccaaagatatacaagtggccaagaagcacatgacaagatgctcaacatcattagtcacgagggaaatgcacatgaaaacaacagcgatatatccagtaagactgctagaatcaaaaagtcctataaactccagcggagatgaggaaatggagaaggtggaaccctcatacgctgttggtaggatgaaaatggtgcagcctcttcagaaaacagcctggcagttcctcaaaagcttaaatctagagttaccatatgacctagcagttgtactcctaggcatataagaatgaaagagaaatgaaaacttacacataaatgtttacagcagcattattcacagcagccagaaagtgaaaatgaccaaaatgtccatcaactgatgaatggataaacaaaatgtagtctatccatacaatggaatatcactgagcagtaaaaggaatgaagttgagattcatgctacaacatggaccaaccttgaaaagatatgctaagtgaatgaagccagtcacaaaagaccacatataatacgattccatctatgtgaaatgtccagaataggcaaatctgtagagacagaaagcagattagttgttgcctggggctgggactgggaggctgaggggaaatggggagtggcagtgaatgggtacatggtttcttttggggaagataaaaatgttctggtcaggtgccatggctcatgccaataatcattgcactttgggaggctgagtcaggaggactgcttgagctcaggagttccagatcagcctgggcaacatggcgagacctctgtctctactaaaaagaaaaaaattagccaggtgtggtggtgtgtgcctgtggtcccagctacttgggaggctgaggtgggaagattgtttgagcccaggaggttgaggttgcagtgagccatgatcgtgccactgcactccagcctgggtgacagagcaacaccctgtctcaaatataaaacaaacaaacaaataaagggcaaaattctccctgtctgaaaaagggggcagtgattctttacaaaattgatcatggtgataagcgatggttgcacagttgtgtcaccattgagttccttccttccttccttctttctttctttctttttttttttttgacggagtctcactcttgcccaggctggagtgcagtggcgcgatctcagctcactgcaacctccacctcctgggttcaagagattctcatgcctcaacctcccaagtagctgggattacaggtgcgtaccaccacacctggctaatttttgtatttttagtagagaaggagttttgccttattggccaggctggtcgcaaactcctgacctcaagtgatccatctgcctcagtctcccaaagtgctgggattacacagccaaccattgaatttaaatatgtgaattgtatggtgtgtgaaccgcaagtgttctgcctatccatatacctcccactcaccttccctctccccatctcactgttctggtgagggaggttcttgctttcctttcgcctgtttgggacctcacttcctttttcccttccccatccctttgtagccccttctcaagagagagaagacaccttgattcccacctacgctctgctaaaacttttccgttctagtcttaaatctctctctcttaagaactgatttcccagtagggtttatgtttggagctaaattagtcctcctggaagcagttgacttcatcctccagcagctgtgccatcagcagaggccatgcatgctggggcaagatccaggcctatctcttcctctgcagtcccctggggacgtctgggatctggttccttggttgggccacgcttagctctccttcgcatgggtgtctcaatgccagggtgtcaggagagctacagtagccagctcaggcccccccagggagagctggggagggagctgagggcctggtgccccccatcaggagggacctttggagtctttcttggctctgcccaggccttctgagcacacagagatcactccagccctctgccctctctgtagccaaatgaaaagactcttctagtctttctggccaactagtaagctctttgaaggtgggtaccattcttgacattagaaaaaactcagagccgtttggatactgaatatttttgacatgctctggtcactgaacgagaagactcttcatgaaaatgatgctttgtcagctctgtagagaaaggcgattggaattttggttgaccaggttagggtaagggaagaatgaatccccagtgtcctaagctggcaggcagtcgtgccgatgcagttctcatttctgctgtcaatttgccaggagactcagaaaaaggccgctatgcctttctgcacctcagtttcctcatctgtcaaatgggcagtgttttgggcgtgctgggcacaggtttgtctgagaaccagctgaggcctgtgttgcgcatgggacctactattattctttataatattaataccaaggacatttaacacctgcaacaacaagaacaagcacagtctcagaaggaaagcccgtcctctaaaagagtgtctgtagagcagagaagcccccagtgccatccttctctttctgccaagctcctgtgccagtgctgtcgtggggggccctgcctgcaggtgtggggatactggttcagggccagtggcccctggcaactggtttgtcttttagagaaggcaggactgaaatgatcagctttccatgtagggccagactctgggcaggtttctttttaaattttttaaatttttttgagacaggatcttgctctctcacccaggctggagtgcagtgacatgatcagggctcactgcagccttgacttcccaggctcaagcaatcctcctgcctcagcctccccaggtagctgggattataggcgtgtgccgctatgcccggctaatttttttgagttttagtagacgaggtctcactatgttgcccagattggtcttgaactcttggacaatcttcccacctcagcctcccaaagttctgggattacaggcgtgagccaccacacctggtctcaaataaaattttattggaacagctacactcatttgctttatgtcattgtgtccggctgccctcatgcagcaggcagagatctgctgacccctggtctagaatgtggaatgctggatccctgggttgagggactattttaatggtaagtacccatatttagatcttttttactgtggttttgtgatgtgatctgtcatctcctctgggcttgcatttctccagtgacaaggcgctcactcctcccacggcgatgcattccagccgtcgaattatgtagttctactgcttaatccttccttaacttgctcttcctgaagcctcaactcactcatcttctttctcaacccctcaggcccagcagaagtcctctctgtcttctccaggcgcagcccttcagccatgcaatcctgcgtgtcctcgttcttcattccacaaatacgttctaagggcctcctgcatttcaggcacttcagaggaccttctggaagcttcccagggcctgctatcttccctgtactgtaaggggacactttgctcaactgttcacttgaacagagtcttcaatgtcttctagtgaattctgggctgaaaccaatgtcgacttggccaaattaaggccacggtcttggtcagccaccttccaggttgacttgccagggtgtcctgggttggtttgttttacagaagcagagctcccagggctcatcgcacagccatggccgaggtgtcgggactcaaattccgggcccttggctgtgcttctcacattctttccattgtccgacgcactgaggcagagacaggaattttaactactcaaaaactactgtttacgtattttactttgacttctttctgggttcttgcataggcttcaaggagggaggatatggatgtgagcttattgtacaaatgccctgggttttccaaacgtgtctgatcttaaatacacagccctgcgtgctgaccttgtgttagaacttaatgatgcgacgtttgctttgcaaactgtggtcccctcctcatagatccttcaattcaacaattgaattcaacaagcccctgggcacccaccgtgcaccaggcactgtgttaggtgctgcagagatgaagatgaggaggatgatggcctgtgcccaggcaggtaacagactagcagaaggacaggaagcaaagtgggcatgtgtaccatgtgtttaaagcctgagggaacagctggtaggatcctcctggggctaggtggtggcagcagcaaagagaggggacatttgaattgggctttgaagggtgcataagagtttaacggggccgggcgcggtggctcacgcctgtaatcccagcactttgggaggccgaggcgggcggatcacgaggtcaggagatcgagaccatcctggctaaaacggggaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaagagtttaacgggacagccacaccactgatcactcagaagtaggtgggttgtgaatcttcagcattctggaaaatgtaaaaagttgttcagtgggcagcagtaaagagggtttcgttttcctggagacactgttgctactttgctggcttatacagggacacccagagagcggctgggaaaatcaagaactgtgtcacctcctccgttcttgcccactgtccagggctcaaggagattggggagcagtttgcaaaggcatttgaagattaggctccacagagatggacactttttttttttcctaaatagatacagagtagccttgtgaaggtttcttttgggtctgagtaggggacgcacagggcatggctatgagggtctcagaaactggtacctactttcctcttatttggcaccgggagcccctgccggaggacatgttctagtgacagccctgggctcaggcttggagagtgcattctcttccccaggaacgctagtcacagctcagtaattcaccccagggaccgcacagagcaggtgggatggtattgatttgtgggccttttggcaaaacatactcattcctaactggcgagggaaccgccagttcatttattcatttactcttctgagtccagcaacaaccttaagaggcaggtgttacctctggtttctgtttaaactgatggccagcaaggtagggcaatttgcctaaggacacgcagctcctaagctactaaacctcccgctcgcctggaagagaagacaggacgggcctatagtgaatcatgagtgcagcatgagagtgttaaaggtcacaggacgcctcttagtgccaagggagttcatagtggagaccccttttgcctgagggactggggaggtggtagttttgaactgggacttgaaggacagactggggtaaaagcaagaggagaagcttgagggaggacggtgtgtgccaggacggtgggactcagagggtggtggggggcacatccactgtccccttccatcctgcagccactccctgaggtggcatttccttgaatgacaggagaggagcctgaggcacgggaagattaagtaaccggtcctacgtataaggtggcatttgaacccaggtctacctggctccatagccaggccccgtgccccacacaccacaccacctggcgcttggccaacaggaaatcacgtcccccagtgtgtaagtcagggaggcagaggtgctgagatgctctcacctgtgggctcccgggcccagccatgctcttggtgttccctcaggccctggcttcccccctccctccaggtggacccatgcttgtgcccctgtgcattctcccacagactcctccctgcggggccacccatctccaaatcccagctgcatatccacaactgtagagtgttttaaaatagtgatggtagcctaggcaacatagcaagaccccattacccccaaaaatacaaaattagctaggcgtggtggcacatgcctgtagtcccagctacttgggaggctgaggtgggaggataccttgagcccaggaggttgaggctgcagtgagctatgattgcaccactgcactccagcctgggtgacacagcgagactctgtgtctaaaaaaaaagatggtgatgctgtccaggcttgacgtaggagccttccgttcctcctcagggcctgtgctctccttttgaggaacagcctccttttagtaaatgtgagggtggctgaggtgggacatgagaggcttgcagtacccaccaagccaggccagccacatggccttctcaactcctggcccagcccaggttgtcagctctctcaggttttgctctttctcctgcgtgctttccccgtgttcttctgcactgttatctttcctcttcatctgaggccatgtctttaccttatgtggtgctgatgtgggccagggaagctgtggcaggggcccgggaaccaccccagggggatgcagagggagtggaccctgtggggctcggccatggcagaattctgctctgattggctttagatcgtcgcctgtgacagcgtttcctccgcggagtgtgttaggaagagcagaaatgcctcctgcatctttattagatccctccaaatggaaatccagcagaaagccgatgttcttgtaaatatcacgacctccctccccatgaggtgtttgtagaacagttatttactcgttttgttttccccacctgcagtttacagaagaaaatcaagaaagcgtgtttttcctccatgcataatcccatccccgactgtaacaacaacaaaaccgtcctcctgttaggaagcagcagtgacttctttaggcaggaaaaaaaaaaaagcgtgctatgccagaaagcaggagcagctgggaagggagagggagggggccacacctggcctacccccagtcaccttttacccagggatcccctgaggaaaacaagctgtgaccttgagccggcaccagccccagggctgaaaccccagccctgtctgaagggttcctttcccgtgtccaccacggccccgtgctgtatagcagccccggtggaaagcctctttctcctgtacctggaggagttgctggaagaaggagaaggctcagcaccagcttctggctaaaatcgtggccgatggctggatgattccggccccactttaataaacaggatagatgtgcggtaacatcaggttgtcaggccctattttgtgatagaaaggatgaggagggaaacaagcacaaatcagtagtgtcacaatctcaaccacttcttccattttcgttaatagaatcggagtctcactatgttgtccagactggtcctgaactcccagctgatacggaagtggggcagggaagtgctgggaggagaagggcgggtccctgtcgagggctccacccctgggcccatgcccacagccctaggtgaggacagacactcctgcctttacacccaaatgctgcatttcccaagaccaccctggcccaccacactcccatcctgtgcctataaaaaccgcgagagcctagcaggcacacacagaagcggctggacattgagaggaacacgtgggtggaagaagacacacgtggctggatatcaagaggacgtcgggggaacatgccctggggaagagcacacaacagatgccggcacgctggcaggccactgaccagcagaatgccccggagtttggctggggcggtcggagaagagtcaggaaaaccatctcccttctggctcccccatctgctgggtgagctcaataaaaccttgcactcattctccaagcccacgtgtgatcttctggtacaccaaggcaggaaccagggatacagaaagtcctctgtccttatgataaggcaggggtataattgagctgactaacacaagctgcctacggatggcaaactaaaagagcaccctgaatgcccaccggggcttcagctgtaaacattcactcctagacactaccatggggttggagccccacagcctgcccgtctgcatgctccccttgaggtttgacccgtctgcatgctcccctcgaggtttgacccgtctgcatgctcccctagaggtttgagcagcgggacactgacgaagcgagccatacccccatcacatgccctttgagggggaaaagggaacctttcccgtttcacagccacagtttcctgctgttttctgaaattcctggtggccactcccttggtgtccatgggtgtctggtgtgtgcctatgtttgctgcgggctggctcggcgagggggaggtgggcagctgggggctctctggaccctgcggctggcatgggttagtggctccgtgtcacctggttcctctcacctctgttttcccttctagcccctgcaggcaggagacttcaacgcagagattaagaagttgagatgtctttgttcccagaggaaagtccctgcaggccccggcctcatggcctctgtgacagcagcaggattagaggcagagttggcccagagggaacatttctcccaccctctgtccctcggggaccccacttcccaggtggcctggaggatgaagtcagggctctggcctcattgagggcctggaactctttagagcccatcaggaccaagctctggtggccttccaggcccactcagtggctggcggtcccacctccaaatgcaggcagaccacactccctgaagggcagtggcaaggccaggccagcacctctccactctgaggaaggggccttacccagatccccgtgtcccccacagcggtggcggttttattgatgtattgtgaaggcacagggagggccctttccagagcaggctgcatctcccctcagcttccacactctgaacctgcctcctgcctccttccacagtgcccgccgggtccacagcgcccgccgggtccacagcgcccgccgggtccacagcgcccaccaggtttgatgtgggctgagcacaccgtcactaactcattccttcattcattcttcactgtgtggggtgtcgggacccagcacgggctcctggcgcagcaggcctcagaccctggggagagctttgctggaggaagtgcagtgccaaggacccatgtcctcattccccctgggtagagcgtgtcgggtgactctgctgcggtctccaggagctggcaagggaggggtgcaccaccagggaagggaattccaggcagcaggcaccaggagcctcatccaagagaaagagaagttccctagactcccaggcagggtgagccgaagggccttggagagtccctgaggtcccgtttcatgggagacttctctcacaaagcgaatgagctcaaatacggaagatggagaaatggaaaacagaaacagaacagaacctccacctgctgggtagatgttaactgaatcttttttttttttgagatggaatcttgctctgtcacccaggctggagtgcagtggcacgatctctgttcactgtaacctctgccttacgggttcaagcgattctcatgcctcagcctccccagtagccaggattccaggcacccgccaccacacctggcaaaatttttgtatttttagtagagacaggatttcaccattctggccaggctggtctgaaactcctgacctcgggtgatccgcccacctgggcctcccaaagtgctggcttgagccaccatgccgcccggccttacctgaatcttatcacacattcctttggaaaatgaatctcctgtgatgggaaaccagccattttcctggtgaggcctcagccctgtagccattccagcatagttaacctgggactctcttctcctctcttgtctctcctcttcctcctatctggcctgcttgctccatcctcccctgctttctgtctctctcctcaccacgtgcctttggatgttctgaatatgcttttgtttgcctgtccagcagtattctctccacggtctcctcctgggtgtctggcgtgtgccttgcgtgtgctgcgggctgggatctgtgggaatgacatagtcggacatggtcctgagcctgttggcctggggactccttttctgtcatactagatgagacaggcgagactgccctggaaagcccggcgtgtctggcctccccagtgctggacggtggccagtgtggttttccaggcgagtccgtgggctcctgggtgggtggtcgggctcgtggggagatcccaagcaatggttgtagagggatgggagggaatgggtggatcccagagagagagagagagagagagcaggctggttccactgtggcctcgttgtctaatgaggagagtgtacagataagtcatgctttgttttgctctgtctctggaattttaatcagttgccctaattgccttcaaattattggaagggaaaaacgccagcagagggtcctgacagatcccagctgtctagctgaggacttatcttctcattgttcttgggaaaccagtcaggtttagggacttgaggtggatgattcattaattcttttaaactgatttcctcagccatgtacacaggtgtgaaagcccttcttatgttatcagtattaccctaatatatcagagggctaggatttctcataaggcgactgttatcttttgataatcacataaataacgtttccatagttctcgaaagcttgccagatgctttcatgtacattagctaacttcttaaatttttttttttttttttgagatagggtctcactcttgtcaaccaggatggagtgcagtggcatgatctctgctcactgcaacctctgcctcccaggttcaagcaattttcctgcttcggcttcctgagtagctgggattataggcgcccgccaccatgcctgcctaatttttgtatttttaatagagatggtgtttcatcatgttggcctcagactcctgacctcaagtgatccatctgcctcagcctcccaaagtgttgggattacaggcatgagctgccatgtgtggctgacattagctaatttaattcttacaataatcttatgaattgggattctcatctcttttaaaatgaggaaactgaggctcagagaggttaagtcatgtgcccaagatcacttagctagtaagtgatgggcagggctgtggagctggttcacttgactctgctgccattgcatccagtttgctctgccagcgagtcaattgagcatttggagcatttgctgtgtgccagcctcatggaggcaaacggagcttcggaacccaggtgtcgagaatgagctgttggcactcagtcctggagtggcagcatggggggcgggggcaggagcatgggggacaacagtccagggagggccacatgacagcaagcagagcctcgaatgcctgagtcctggctccagagagaggccagcctgagctcctccatgtcctactcctgtggatagaccccccggaatgcagggggccgggctgagcaagaggaggagaggacagggaaggaacatgtctgcttctttccttcaggaaaggaaaggtgagctgggcgatggggaaggcctccacggtgttctgttgtaatgttctgccacttggcagcctcaccagggacatatcagccccaggctgattatctgcagaccgggatcccatttctgctgctttgggagagaagggagggtagccctgaggccatcccaaatgcgagtctgttcacagaggggctctcctggcaccttccccagcccagacgctgaggagggcagccagaagcccctgcatcaggtaggagtgctgagtcatgagattgggttgaatggcggctttagcacagctgtggcctgtgttagagagggtgagtttggaccattcctgagcagagggggacctcagaggacagtcggactggggaatccctggcccagagagggaaactggttttcccagagtcacacagctaggtgcccctttgatggttctctcagtgactcacgcctgtaatctcagcattttgggaggccaaggtgggaggattacttgagcctaggaggttgaggctgcagtgaaccatgatcataccactgcattccagcctggccaacagagcaagaccttgtctcaaaaagtaaataaaaaataaaacccattctcactctaacccatgctgtatctgatttttttcctgaggtaggcttgagatgggagggttgttattttttgtaaatgcattaggggcggagtggtgggagagtgattcccctgcagcccttctgaggtcactgccacaccatggcaagaaaagtatttctgactcctggagctccacggtgtgacaggtgggcaggagctgctgggggtgctgggcagacgtttaccgtccagcacccccatttctgctgctctgataacttggatcgactgaagaacctcggggctttcttggctgtttgtaggagcttccagaagcgacctttcgggatgcctcttacatagtcctgcctataccctctacacgtggcgtttcaggtctggagagtcatgtggtgtagctgtatttctgggaagtgtgtgacccgaagcctcctcctgtcagaaccaccggggagctcacaagctaaagtgcagattcctgggtcatcccagacctgctgaagccaaatctttagggtggggccaggaatctgcattttaaacaagctccggaggtggctctgaggccagccacagtttgggcacggcaaggctggggagccaggcttgtttcggatctccagtccttgtgtgggctgcgtgaccttggatgagttatttcccatctctgagccttggttctctggtctgttaagtggcaatcttgccccttctgttttaggcactgtcggggttgcctgccttctggtaagcgtttagtgccctgagccgactcagctggtgctcagggaggcctgatgattcggggcgcttggccgggtggtggggtgggacaccccagagggaagggcactggtcccagcttggtggggcaggccacctggaggaggggtggaccttgggagtgggttatattagggcctccaggcctcagtttgggaggagcttgcagtgaccttggagatggtagtgaccttgtcctcctgccctgcctgggtgcacaggctcccagcacgtgggtggcaaaggtcctagagagcacccagaggcgggtgtctgcctggggtcgagtgtgggagctgggcccagagcccccacttctgcctggcatccgggggtccctccgggaagctgaggttgttttcttgaacagtaaggactggccagagccctgagcaccgagaggtgagggtgaggccccccctactctttcccccaccctcctgggaatgactgccgacatcagggaagggaggggccccaaggccagtgacctggaatgcgatggccagggaggcaggagctggaggctgtgtggggcacgaggaggccgatcgggtgtcccgggggagactcctcgctgcttccctcgggatggtttccatgaacttccctccccggccctgacggcctcctctcctaagctcccgcctcctttttttttttttttggagacagtggctcactctgtcacccaggctggagtgcggtggtgcgatcatggctcactgtagcctcgacctcccccggctcaggtgatcctcccacctcagccttccaagtagctgggactacaggtgcatgcccccacaccagactaatttttgtatattttgtagagatgagttttgccatgttgcccaggctggtcttgaactcctgggctcaaacaatcctcctgcctcggcctcccagagtgctgggtttataggtgtgagtcactgcacctgaccatccctccccgcttttatgtccttttctccctctctgaggtagggggaccaagccctcctccccaagccctgtccactgtggggccttctacaatgtgagcttgtacatctctgtgatgtcacccaggtgccaccaggtgtgtgtgtcctgatgcctttggccaccagcctcaaaatctcccagagttccaggtgcttggtggaagggattcatgtacccctatccccatccctaaatgagagtgtccacaccacccgccctgagttctgaacttagccacctcatgtacggaaggagaaatggaggccgccagagaggtctaggcctccgaccctgaccttgctcctcttggatggtattgggtggcattccaggacagctgggatcttgatcatccagtgggtgccctcactgtgcacctgcctccaggtggtggcgcggtaattgcaagagcgtgagcccctcctctggggcatgttcttggaaataaatacacctcgtgtcatggagatgggcagacgaggtgccagctatttgaacggacagcccggagtctgtgcaggagttggaggtagagcgggtcgaaggcttgcggagggacaggtgggtctcccatggatggcttttcttggaggctgcagccaggagccattgtttctcttcccacctgaccttgggtggttccccttcagccctggcgttatgatgtcccgcccaacccccgaccgcacacctccctcccccttagctgcttcgaagccaaaggtgtggcaacagctaacaggtgcttggtggtccccgcccaccctccttcaggctccctacacccacctgagtgggcctttctgtgttcacttcagggatgaggcttggagaagagggtgtgtgagggggtgcgggtggccctccagactggacctaggcctgctgcattctgggttgaggtcctcttgctgcctctctgtgagcgagcctcgcctgctgggtgctgagcccacaccgcatgtcctcggcctcccattgagatcagctatacgtgatatagaccagggatgcacgcctcatgaggagacgctcactcccccagacacactgagtactctttcctcaagctcagtgcagttcgtccacgtttgcccagcagcacgcctcccgcagcgttgtcaatatttattcgtggttgccgctgcctccctcctggaccgcccattccctgggccctgtctggtggtggctggccttggagagctggcctctcagcacagcaccgggcaccagggctcaaggtcagtgggtgtgtctttgggtcccttaaggagcaaagtctcataatttgctttattttgttttattattattaattttttttgagacagttctcgctctgtcgcccaggctggagtgcagtggtgcgatctcgtctcactgcaacctctgcctcccgggttcaagcgattcttgtgcctcagcctcctgagtatctgggactacaggcacccgccaccacacccagctaatttttgtatttttggtagagacggggtttcaccatgttggccatgctggtctcgaactcctgacctcaggggatccacctgccttggcctcccaaagtgctgagattacaggcgtgagccaccacgcctggccccttaatttactttaaataaagatctggttctcccagatgaggttcacagacagatgttccaagagcacatctgtctggcatcaggagactcacccataccaagctcacagtgctggccatgatccgactcccgccctgcagctcaagcttggtctggagaccttctctggcacctgccccggctccccagccccgggcttcctgcattgtgtgcttccactcccgtcttctccactaggagctctgtggtacgggctttctgcaccttgacctctgggcctcccaccacagcacggtgaaggcaccaactatttcactgctagatccaaggatgctggggccgggggcagctctgagtgtgtctcatacagtgaccttgtttgaggaggctgtgtaggcccaggattttcctggggtgagggacgccaggttccttgatgtgttgggacaaagacgttggctgggcgaggaggctgcctgagatcccacagtgaggctggccctgcccttgctcgcccagctgatctgacaccctccagatggcccaagagagaccgggaggagcatctggtggaggacctgggtgttctgtctggagatttcccattgcttttccagtttattgtcatctgcttgggacttgagggtaacttcatctctcaaaataggctgagactttttacagttagatatttaatatacagatgacgggcggatggtagtgttgttttaaggggggattttgttgctgtcgttgttgttgttgttttgagacagagtcttgctctgtcacccaggctagagtgcgagctcgatcatagctcactgcaacctcaaactcccaggctcaagtgatcctcccacctcagcatcctgaatagctgggactacaggtgtgcgccaccacgcatggctaattttttgtagagatgggatgttgccatgttacccagactggtcttaaactcctgggctcaactaaaattttaatctccaattcatacatttcagaaagtataataatatgtaaagcaaaatcataatagcaacaacaatcactgtcatcccacgggttggtttagatgtaaattttatgcttccttgcaaaaatttgtcgaaagtgccagaaaagcccttgtcccatatcacagtcccatgacccacactcccatggaaagccttagaactgatgtcagtgtgagccctgtgctggagtggagggtgacagagcttcggacatgagcagcctctgctgctgcggccaccctcgccggccctggatccccacacagtgtggggtgttcaggattcctcatgtgacccttaccctgcctgccctgggactgtgtgcctgtgtgcttgcatgtgtgtatgtgcgtgtgtgcccatatgcgtgtgtaggtgtgtgcatatgtgtatataggtgtgtgcatgtgtgtatatacctgtgtaggtgtgtatgtgtgtacatgtgcattgtagatgtgtgtgcatatggtgacctcagttccaaagctttccatgtgtgtgtccatacacatgtgtaggtgtgtgcctgtgtgtgcatatgcgcatacacatgtataggtgtgtgcatgtgtgcacacgtgcatgtgtaggtgtgtgtgtgcattgtgtgtaggtttgtgcatgtgtgtgcatacgtgtgtgtaggggtgtgcgtgtgtacacatatgcatgtgtgtgtgtgcattgtgtgtaggtttgtgcatgtgtgtgcatacgtgtgtgtaggtgtgcatgtgtgtgcacatatgcacgtgtgggtgtgtgtgcagtgtgtgtaggtttgtgtgtgtgtgtgcatatgtgtgtgtaggtgtgtgtgcgtgtcagcatatgtgtgtctgcattcactcggccagagctccttgagggcagggtggttcccacctctctgttcccccagctcccagctccggcctggcttttaatcacagagtaagtcaagcctgctttgggagccttctgactcccccagacacactgagtactctttcctcgagctcagtgcagttcgtccacattttcccagcagcacgcctcctgcagcgttgtcaatatttatttgctgttgctgttgcctccctcctggaccgcccattccccaggccctgtctggtggtggccgcccttggggagctggcctctcagcacagcgccgggcaccggggctcaaggtcagtgggtgtgtgtttgggcttgaactgatgtgtgtgtttactgagctttctccgcagcctgctccggcagctccaaaatggcatttcaggaattgaattaccgacatttcagtacttgcggaatccaggaatagattatttgattgtatctgttggaagtcattgccgtaactggcttcgttttcttcaccaacatctaaaccgagtggggagggaccgcaggagaatgctgtggtgacttgattttcccaaaagcacatctcccaagctggcggcagccgatggcgttgccctgtgactgggggaagcctgaggactcacggtcgcctcaggctggccaccttcgcactggaacctgcccatcacatcaaggagccctctcaggctgaaaaccctgtgccggggtggctgcagcaacacaaggattcccctccagctctgtgatgtggggagcagagggccactgagtcctgccatgtgagtcacatgatgcccgtggcctgatttctgtgcccccatcttgcctcttagagtttgttgacctcagggctcacatatcccttgtaaggggttgtgatggcttccacggccatcatggctagttaggattttcctccagcccttgaggaattctctcgggattttttctggccttgcctgtctgcagaatccatagaggacctacaggaatgtctgcctctgagtccatagtacttgcaggcctgggaggctggatcaaggtggatgttgacacttggtggggccggagccctggcttcctggctgcctcatagctcaggcccgtttgacagcatttgtgagcacctgtcccaggcaggagcaagttcaacagcagcaagggctccaggcagagggaggtgggctctgatgggactcaggggcagcctaaatgtagcagagaactgagaggggatccctgaggccttcttggaggaggtggtggttaagccagctaactttgtccattggaaactgtcaccaggtccttattaatcaaataataatgaatatgccgtgttcggatccactagggaaagctgaaattgagctcaaaggaggcatagaagttcagcttgtaattttgaaaaaggaaaaggctctggcctcattaggctgcccccagtgtgtccttgagacctccttactccttgaaatgtgcttcttaacgttttggaaaaaacaactttctccttctatacttagcccttatctcaatgtgcaggcgcctacctggcccacttatcttcaagaaatgtgctgggttaggcctcaggagtggcaggcacatagatactgtatttggccttggccttctgcccaagtggagtctccgcattcctttgtatgggcccattgggcatgcctggctaatctgcgcaccctctttccactctccttcctgcatttctccttcccttcagtagtggctcccttcccattccccaaatcgcctctgcttttatcttcttccaatcgaattcccgtcagtcgtggagcaggtgggacacctgtgtatgttgcgggggcacagagaagcagcctgtgctcacccatgcctgcctgcaggtgcatgcttgggacttggcagtgggggaagattttggggttaggatttccaggctggcttgacactgacctgttttgttccaacccatacaagccctaaaccctcatgtgcagatcctgctggctctctggggaacacttagttggatgcaggtaggaagaggcttcaaggagcagaggaggggctggctgagggccagccactttgtctggtccccagagcggggtctaacatgtgggaactgagcagcaactgtgagctagccctcaggcaaggctgccccatgatgccagggcacatagggcagactccagatgatggggccactgctggcattggccttttgcagggcacaggagtctgccaggggtgtgttttggagccacccatacaggtgtaccagcttttggaaaatcccaaagatgtggtgccctgctcctgggggtcttgggggctcccaggtagcaacagcgttctgggaggacgtgggctcaaattccaacttttctaccaggttttggctatccttcatccccgtggggctcagtttcctcatctccaagctaagggggcccacctaaagttgtcacagaattggacgtgtgacggggcagcccccttcacctgtgggatccgaggcagagctggcacctccaggctgtgggtccagtgacccggcatggagccagcaaacagaggaggcacctccaggctgcagggtccagtgacctggcatggagcaaacagaggaggccagtgggcaggtgggtgttaccagggcctggagcagcaggggtggagccctggggccaggcagggcgggtttggggtggcatgtggtttgttgtggccctgtcatttgcagtttgggttagtgggtctggctggccaccggggttggaggggaatgccagtgggactatacattgtctccttggaggtgactgtgcccccagaactgagtggacaagccaggcttgtgtccacacctgcccccgtcttttaccctcttctggctctcctccaagaagagcttttcctaaatcattcgccctgttcacctgggctttgaggccccaggtgtaggcccagggggtggggtggggtggggggatggtctctgactggatagccccacctgggtaggaagcccccagtgtggccccaccttggctgtgacctgggggtcctgcagagtcctgtgtcctgttgcagtgaggggtcagtcagtgggaagagtggacaattaggagacaccatgtctgtctcctcgacgccagtcaacactgttgcctttgttcccagggcagccttccccttgccttccattccaaactcctcctcctccctctaagattccctattcacctcctagaggaggccacctgagtgtcagccaggcactggacctgggcctgcccggaaaggtccctgggcctggtgtgctccaagaacctcgctgtcaggggtcagcgtgccatggaggatagggagaggcatgtgcccttggggacgtctggctttgtccggggggttttctgctgctcactggcttcaggtcagggcttggctctgtgctgcagccttaagccagcgggcccaaccgcctcctccaggcccgccagcgcctcagatgtttctctccttcttagagggtgtttcacatcctttcttttgtttgccctgattatttttgcagatgaaggaatacacacaatggtcatctttgtcttatttgaaagccaaacacgttgcttacacgttgggtgcacagtgaatatgtatcagtccagcgcttttcaccatctggtctggttttagtgttgctttatttctggtcattcctcaatcggggctaaagatcagaaaaatcgcatctccaggtcctgagccatggcgaggaagctgggtggtgccctgtgctgtgtggctaaggtgggggacgagggttgtcggtgggggaagccccatgggggccccactggagtcataggagcgaatggagcacccactccatgccttctgtcaattacaaagcacctattatgtcccggatactgtgtccaacacagtggacacattgatgggtaaggcataatccccccccaggagctcccagttggattgaggaggcagacaggcgagcgtatggctgtgacacacccagcaactcccagttggatcggggaggcggacaggcgagcgtatggctgtgacacaggggggcaagtggcgtcaccaaggcagaacccagcagccggggcctgaagccccctcacccagctgcagccttcccgaaacagctgagatcagcctggagagctcttcctccctgcctgcccggagggtggcgtgggtcccatcgctctccgtcagccacggccagagcacacctgtgctgctcctcagaagggcatcacctgtggagacggtgacagctgttcctgttccctgccccaaggacaggatctggagcctgtgggtgtgtaaggagccaactccctgaccccaaaactgtggccagttctggagaaggtggccaggctctgggtcccgggactgtggcccccctcctgcctctaaagcccctcttctggcctccatgacttcagcccctcctgcccccagaaggagggatcagccctacaagggacccaagagagggagcctcacacacaggcgctgcctgactctcctccaagctggcctgagccctgggcagtgttctgaggctcagccacacggctgtgcagggcaggtgagagcggcagcctgagagctgcgagccggggccggggttttcctggagcagcaggagggatgagttgggtttctgtaactacaagggccaagaagagggagaggatgatctgggaaggagagtggctttgggccagcatttgggccagcaggactcagaggcgagggaggtggtaagatcccttgcttgggatgagaggcagatggggaaactgaggcttggagcagagggaggggcagggcctgggcccccagcaggtcccagttcatgatggcatgctgcttctgcatgagtgagacatgagggggtcacagacgcccggaagcatcggcatcatcagatcatccgactcgataatagaaaaattaaaatttaaagtcactgaaagtgacgagtgacagaaatgttcctagaaactggagattgggtgctcagcggatctcaggatagatgatatcagacacaatgtcccctgggctgaggtttttttttgttttttgtttttttatgtttcagaattctaaggcaaggatgaaagtcttctctattcttgaggtgctggggttcctcagcctccaccgtccagcctcgagcagctgccccctctcacctgctcctcagccttctggaacagacaggccccccacagcagcccagcccaggccaccagcaccacccccagaggtttatgccatcttcatgcagtgggaggctcagcccccacactgggacctgtccactttagccccaaggatcttaccaaggtcaaatctttggaactcagggtctttgggaacttctgggccagacaacccggccatcacaggggcttctgcggggttggctttatgatgcatttgggtcaggaggtctgtttttatcctttgggcctctgggaaagtccgtcctggccaagtcctctgtcccctagtctcatggctggctggccctggagctcgggtggcctggcccggcccgcctgcttccccacaggcagcggctcttgcttctgctgcctgcagtgctccagatgctgcaggctccttccttccttcagggcatcctaagtcccccgagtctcgaatccccagtctcagctgagtcctcgaggtcagtggggcagaacgccagagccctgggacaacgggctgcataaaacacttattttaattataagagtgatgtaagaacatatcagaaaattggcaaaatacagggcaaaaaaaaaaaatcactggtggtcgccttctcacacagtcacacacagtggtgtgcagccttctggcttttggttgctttgttgcagtattggcacctgcgttacaagattttgtgttgaccattcttgttcttgctgtggtctttaaggtttacagcgacagctgttcctcttcaggatgcaaggagaccgagcctgcctgccctcagggagctgacggtccagcaggaggcatcctgtctgcagggcccatgcgggggacagggcaagaggtgcggtggaaccagaccttgccctccagaaatgcagggagacagacacgggcgtatttaattcaactatagcatgtggttctgagaaggcttcttggaaagggcctggggttgagctgggcaccagcagggaggtctcagagtggaggcggcagttccaccctacggcgtagaggaggcgccctgatcactgcctttcagccgtggccctgcctgtaatcttatcctttttgttgattgttgttggctgatgttggctgttgctgtgtcctccaccagagtggagaactccctggggctggaccccttgtccttattcacccagagaataggtgccttaaaatactgactggacagaaggaggaagagatgggttggggggccgtgtcatggaagaattccttgggccagccgcagaggagtaggccttggcagagagctgggagcctggaggggagctgaagacctctcccatagtcagctgcctttagggaagaaatactagaaagtcacagaagagaaaagaggcggggaaggggaggaaagcatttccacccacagtcctgtcgggagaggtaacattttggagtacagtgtgccctgccccagcaggccctggctggatgcatattcctatagatataattctataagtgagatcattccatatctactattttacaacctgtttttgttttttgttttttccacttagcaacactttgttcttacctagaattcaccaggcaggacagggctgatgagggagcccctcccacctggacactcagtggcccctcccaggactcggggctttcctgggggcctcagctgcggagcaacagctccctgtgcatcagagccgtgggggaggggggccagggggcataggtacgaccaccactcccatttcgtgtcctttaggaagcttgaagaaaagtggttagccaagaacacaaattacggtgatgttgtttgcagtgtggcgtgttgggttaacataaactctgaagtcagaattgacatcaatttgagcccagatcatcctgttagcagctgtgtgacctgggacagggtgcttaccttccagactttagttccctcactgtacaacagggacagggatcatacctttctctgagagttgaaggaagaagtgaaaccaaacacagccccatgacagccccttatgcatggtaggcactcagcaggtgctggctcccttacggcccgaaggaatcgattgacaaactctcaaattaatgacataattcaagagagtagctgcggagacaataaataattatagtagctgatgtggtttggatgcgtgtcccctccaagtccatgttgaaatgtgatccccagcattgcaggaggggtctggtgggagttgattggatcaggggggcagattcctcatgaatggcttgggccatccccctggtgatgagtgagcaatttggtcgattaaaagagtgtgtcacctccctattcttttgttcccactcttgccatgtgacacattggctccccatcgcctcccaccatgatcgtaagctacaccagaagcagatgctggcaccacgcttcctgtacaggctgcagaactgtgagccaattaagacacttttctttataaattccccagtctcaggtactcctttgtaataatgcaaacagactaacacattagccatagccatttattaacataattttaaaagatttcagtcttgtgctgaaattgttatgttgatggttacacatttgtcaaaacttagtgacctgtacacctaaaaggatgaacttaattgtgtgtaaagtataccttaataaacttgactttacaaaaaaaatccctcttttttttttttgagattgggtctcactcacccaagctgcagtgcagtggcacaatctcggctcactgcaacttccacttcctgggttcaagcaatcctcctgcctcagcctcccaagtagctgggattacaggcgtgcatcaccacacctggttaatttttgtattttttagtagagatggggctttaccatgttagccagactggtcttgaactcctgatctcaagtgatctgcccgcctcggcttcccaaagtgctgggattacaggtgtgagccactgcccccagcctttatatctcttgactgtcacaaaatgcatattttatttaagtttgccataaacagaacatttttacatactgtattgtaacagtatataatacaatacataccgtattgtattgtgtgtagtacaatacatagcgtattgtattgtgtgtagtacaatacatagcgtattgtattgtgtgtagtacaatacataccgtattgtattgtgtgtagtacaatacataccgtattgtattgtgtgtagtacaatacataccgtattgtattgtgtgtagtacaatacatgtatgtaatacaatacatactgtattgtattaatcagatatgttgtcctgtgttattaaaatcatcccttgtggcccaaatttgaaggcagtactctgttcctgggtgtgcaccgttaacttctttaatgaacatcctgctgttcaatagtgaggctgcatccttctagaaagcgctgttgagaggtgtgaggaggctgccacgcaggccgcgccgccccgaatggcaggtggaaggcggctgagtggagccgcagcaaatgcaaccctgcccccgagccaggccccaggctgcacctttccactgcttcacaccagcagtgctttacctggaaaggtgtctgaacagtgcttgcaaaggtaactggcattctgccggctgctcaactctgtggacaccagtacagtcaacaactctcactcgccgcgggcacctgctgtgcccacctgctgccatctgagtgtcacgaccacacccccatccctgtcctttcacgcactgtctgcccgcacacactcttccaccctctgtcggcagggcccctgccacctctgaagccccctgccagctctcggcagccccctcctccccctggctcccgtgtcctgcccacctccccacactggcacctcctgagcagccctggctgagcatgcactctgagggcagaccctggccgggcaccaagatacaaaaggttatgagggtgttctcttgaggaactgagtccagtgtgaacagtgaacacagaaacataaagggacaccagaatccccatccccatccccagggtggtgagccaccgaggggggccaggcacgggggagggtattcaagggcggcaagccaccaaggggacggggcaggcacagggagggcatttcagagagtgcaaggaggcggcgaagatgctggttgagggcacgggtgaggcggggaggcgtttcgactttggactgaaggccttaattgaccaaggcggtaatttccagtcctgtgacctcacgacaggctggacattggaggatgggatgacactggctcttctggggtaacttgtctgggtttaaggttcttgatggggtttaggacatggcgggaccctaaggatggtgccagcatctgaattctctgccgtcttgcagagtcaggattctgcagctacttgcccaagaaaaagtagagaaaggtggtttcatgtttttttttttttttttttttttttactgctttgaagggaggtgtgggactcgtttgcacacacagttaatatttccaaggcttgtgcagggccagacagatttggttgcagctgttagttttacttcctgtcccgataaaggagggtgcttgcctcagctctcacctgctgccataacaaagctccatggaccgggccgcctaaatgcagacacatactcagctctggaggcgggaggtctagatcagggcgtccgcattgtcaggttctggggagggctcttcctgctttgcaggtggcttttttctctgtgtcctcctgtggaatgagagcaaactatagtctcttcctcttcttacaaggacactaataccatcatgggggcctcactctcctgacctcaccgcaacctaattactttccaaaggccccaccccctaccaccatcgccctcggggttagggcgcctgggtacacatttgaggagagggcacagccgttcagtccatgaccacattgcatgttccagggaggaactggagagaggctgctgtttgctgggcacctgagctggttatagatgttaaatcctcacggtagaaaatgtggaaaatacagaaacaattataatgcataatcctacaattcagagatcatcacagcagacatatgggtccatttcttctggtcagtattcatttacagcgaggcggacagactcatgctgtaattgagtcatgctatgtatttgtttcaggtcccgctttttctttccacttaagacaatatcattcatttcctgtatcattaaaaatatttgcggtcgggtgcggtcgctcctacctgtaatcccagcactttgtgaggccaagacgggcagatcacttgaggtcaggagttcgagaccagcctggccaacatggtgaaacccccatctctactaaaaatataaaaatttgtccacctgggccagtgcgtgattccgaagactacatttgaagtccagccttgcagctttccaaaaacccgtgcctccctctttctgcttgtaaatgtccctcacaactggtttcccagaaaaattgtgaggatgagcgaggtgttgcttgtggaagttactttggagggaaagtgtttgtgacaccccatgggtgtggcccatggggctcctgagggtggatggatgtgggagtggacaggcctggctccttttcttggtgggctgggctgggctatgagcaggagctatggccgtggctgacccttctgcaatgggagctgagcagtggtacagttagatagctgcgcagatggtccgatggcccggcctccaaggccttgagtgatgggatgaccatgaccactggatgtctctcaataggctttgccttaaccatgccagcagttcccccatctgctttatcagccctggtatgtacatcagattggctaagggtgcaaaactggaatgctattaaattccagaggctctggtcgcttgaaaagatgagctgaaaataagataaaatttcacagggttaaaggcaggctttgcactctggtttaagtatagagtcgtccattcatgagagtataggtttgggagacaatagcattgaagaggcttgagcgcacactcagaaccagtggctctttcttagtctgtccatgctggctatactgcagcccccctcaactggaatcagatgtggcccaaccatgaatactttggacaaagctcccccaagtcaggcatgccctcttgttagggaaggtggattcctgacctgagtccatctggaggtccaggcaggaattagaaccacttcagaaaagctctgcacagatttaattgcacgagtacctgcgtctcagagctgcagactgagtgtgttgtgcaattgttgggcggcttttcccttggccacagtagattcgcaattaagaaaaacaaatgcagctctcagtcagaagtgtgcaaggtttgcttggtctggagacagcagcttctgtgctctggggtagtgaggaagtgtgtgggcaggttggcaaataagccacatgtatgtcccctgggctcagcccccatcttagtgggcacaccagggcccacgagatctggggactatttatgtagggtctgctggggcaggggtgtgggtgggtgtgcgctgcttgtgttgttgaattgggatttttccagccagaccagtctgctgggacaagccttctggctctgggccaaaggcctccccagctgtgatccattcaggcctagaaagctgggggtgctgactgccatcacccactggcctccatggtgtgtccacagagggccaccttcctgcagggctgagctacttctgtctgggtgtagcttcttgtaaagtccctagcagggttgctccctacaacccacccctccccattttctctttctctctgcatgactattattcactcttcaagtctctgtttagatgtcacctcctctgggaagccttcccagattccaggtggggctggaggcccttctgcggactcccctggcatcctgcactcactcacctatggcacatatcattggccgcaaaatctcctgggcacttatcacactgcgggttccttgaaaacaggaatcattcttgttctctgctgcatcttaggatggtgactggcacatagtaggagtccaattaagaatgttttgaataagcgaaagagtgcctaaatgagacttctattccagcttgaagaccagcccaccaccctgataagaaagttcaagtgtgggaaccgctggggatcttgatggcctgggacctctggatcagtgcttgtgcaggacagaggcagccccggagttctcatgggggctggtgagcagagtggggccccaggatgcctgatggcccggtctgaggtgtgcaggtgcccctgaggtgggcaccacccaggagatgcatgtatctgtgaaataccagataggcccttagtctaagcaaggaggcatctaagctccttaaagattccacaaggatgttacgttgtgctttgaacaacagagacgtggctctgctgagccccagccaaagctctgcacagggaccttgactctcccttcccgctgtgtggctccagcaagtttcctcccacctcaggtctgggtttccaggcattaagtgacaaagtggatgcgacgctccttctggactgtaatgcgcactgcgtggagatgttcgtgttccagtgtagacagggcgttgtcacatcaggcaggactacagggacaatgtttgtcagcctgtcttctgggcaacttggggtatcctccctttatatcacctcctgcccaggtgctctgcgccgccagagcatcatgtcatttgggatccctgatggcaattttgagactttggttcacagtaaagattggtcctgtgtgatcttaaagtaatgtggcttaaaaacaaatggctgtcagggaattgtaaatcaaagcaaacaccgatgagaatggcccaaatccaggacactcagcaccaaatgcgagggaggatgtgaagccacaggaagcctcactcactgctggtgggaacgcaaaacagtacagccaccttggaagacagtttgacaaatccttagaaagctaaacacacttttaccctgtgatccaacaatcatgctccttgatatttacccagaggagttaaaaaaacttatgtccacacaaaaacctgcacatgggtgttcatagcgactttattcacgattattcataacagctggaacttggaggcagcgaaggtgtccttcagcaggtgaatggataaattagctgtggtgcatccagacaatggaatattattccacagcactaagaagaaatgagctagcaagccatgaaaagacatgggggaactcatctgcatatgagtaggtgagagaagccaatctgaaaaggctatgcctatggaggattgcaactctatgatatcctaggaaaggcaaagcgatggagataataaacagatcagtggttcctacgggttaggagggagggagggatgagcaggcagagcacagggcatttttaaggcagtgaaactgctctgtgtgatactgtagtgggggagccatgtcattgcacagttgtcaaaacccatagaatatacagcaccagcagtgagtcctaatgtaacctacggacttgggtgataatgacgtgtgaagagacaaggcgggttcatccgttgtaacaaacagccaccctggtagtagggagggcaggaggtatgtagagaactctgtgctttccacgcgattttgctgtgaactaaacagctctaaaaaataaagttcattaattaaaaaaaaaaaaaaaaaaaagggaaatgaccacatgcaaagcactgcgtggagggccacgcatcccaagcaagtcagctagagtagaggcaggaaccaaacagctctatgaggttctggatgagaagccgcatgcaccaccccctccctgctcccgtgtgggacccagtgaagacctcctgtgcccggctgcagctgctgagtgtgggagtgtgctctccacagcaaaccagccgtgaaggctgcacaccttcctgtttctgcccagccacaccacagggcactcagcccttttcctgagcacttgaagctgcgtttcctcgagctccttcctgtttaagaacaggaggggagtggcggctcgcttgtgcaccactctccagggcagtggtgtgcgggacaccctgcagcacctttgactcctcctctgggaatgaggcgtggtttaatctgcaaccccttaccattagagtctgcaactagtcaaaaggtgaatctggctgggcgcggcggctcatgcctgtcatcccagcactttgggaagctgaggcaggaggactgcttgagcccaggagtcctgaccagcctgggcaacatagtaagacctcctctctacaaaagtaaacaaaactagcctggcgtggtgtcatgtgcctgtggtcccagctactcaggaggctgaggtaggaggatcacttgagcccaagaggttgaggctgcagtgagccaagatcgcgccactgtgctccagcctgggtgacagagtgagacccaccccccttttttttcagaccgcatcttgctctgttgcccaggctggagtgcagtggcacgatctcggctcactgcaacctccacctcccaagtttaagcaattcttttgcctcagcctgccaagtagctgcgattacaggcacctgccaccacacccagctaatttttgtatttttagtagagactgggtttcactatgttggccaggctggtctcaaactcctggcctcaagtgatctgcccacttcagcctgccaaagtgctgggattacaagtgtgagccacccagccctgagtgagaccctttctcaaaaaaaaaagaaaagaaaagaaaaaaaaggtaaatctaagaggtgaccagtaggggaatatatttgtcgagtctcctcacctcagcactgttgccatttggagaagcataattctttggtgtgtgcggggaagggggggctgtcctgtgcattgtggggtattgagcagtatccttggccctacccataagatgctggtaggcatgtcccctcaactccccagttgtaataaccaaaaatatctccagacattgccaaatgtacccgggaaaatcactcaggttgaagtcactaaattatatgtgtgtacatataattacacatgcatatacatcgcgtacacacacacacccacacacacacacaccttttgctggtggctctggattggtaagctggctccatggcaagaatcagcatcctaatacttgccccaccctttaaaataaacttcccaatcctaggcagacaaaagaacaaccccagacctcctccctcagggtggggacaaggtgagggaggtggcggcccggcaggaaggtcatttctttcttcagtcacatcagatgagctgcttcccctcactaggagtggatggggctgccagtggtgttcttgcaaaataccccttgtgggaggagaggggtggagggagagaacaccctccacacatccccgtgggatgtctggagggaagggttttgggcacccaccctggggagagaggagagcccaggttaccatctgtggtgtcccctcgctcacactcactactgccctccacaaactgccatgcttgcttggtgcacggtgctgtgctgggcactggggcaaggccccctcccccatggggctacagatgctaatctgcaaatcccagaaaagtggaatctcggtggcagagtggatgaaggggaggtgctcagtgctatgaaagccagcagctgggagtttcaggggcttccctagggagggaccctgagctggggtctgaaggaagagcagttcactggggagttagggagtgttctaggcagagtaaacagtgcagtggcagccggggctggcacttttaaagaaagcctcaagacttctctttctgattgtgaagtgagctgagcagactgaaatcaaagatgtgaaaataaagatagaggcgacaggctgggtgcggtggctcatgcctgtaatcccaacgctttgggaggccgaggtgggtggatcacaaggtcaagagatggagaccatcctggccaacatggtgaaaccccgtctctactaaaaatacaaaaattagctgggcatggtggcacacgcctgtaatcccagctacttgggaggttgaggcaggagaatcacttgaacccgggaggtgaaggttgcagtgagccagcctggcgatagagcaagactccgtctcaaaaaaaaaaaaaaagatagaggtgacaggaagaccccaccatgagtggcctccactgagtgcgcatgtgagtgagcagctgtgcggtggtccttgccatcttcccatcagcccctcccagcccctgggcctggagaggctgagaatctgacctaaggctgcccagtggcgtgaggctggcctgccgagcttacgtccctgggggactccaggaccccagtgcttcctactggtggcttcagctcccggtcacttgtcgggaatgcagggctgaacccctggaggttgtgtgggacagggcccaggaatctgcattctagcaagcacctgctccaggcttgcttccctggcagggaggcttggtgatccaagttccttgggtgcagacacttgctgcttctctcggaggccgggctgggctgtgattttttcatccaatgtgctgggctgatttcacttgcggatgcagaatgagaagctgtagaggagatcacggcaagctgtctgcatggacgatggcagaatccggtgtctgcttggccgcgtggtgtcactaataggatttgccgagccttttggatgtttgtggcgcgacggctgctgtgggaacccagaggctgctcatttgcagggaatgaataatttatttctgttttcagatgacttattccttcatctgcagccgagcccccacatgttctgtaggctcctgattaagtgatttcagcaggagaatttggcttaatcccccactgccctggacgcctggttccaggctgctgatttgtcggcctcgtgtcggggggtgtccggagcctctcctctctgggggcttttcttcctgctctgcctgtttgggaagcctctggccactgagcatgtgctggccttgggttttacggctgtctggcaattagaatattaatgtcgataacacagcaggacttgcgtgtgacaagctgagccacataacgtcacagtcgctcttgaacatctcggactttcacatgggccagccacaccccagcctaggttgctccctcacctcctcagggcctccctgatgtcggtttagacatgtgccttccatcttgcctgggccaccatgttgatcctctgggtccattgctcaagagcccaccatggctccctgttgccaaatgcagcctgaattcagtattcaaagccctccgtgaatgggcttggtccttcctccctggcctctcttgcgtggctccatgctctgagctgcctactcgctgactcattcatttaatgtttattctttggttgttgtttcagcactgagtgggtctgtggaatcatttacatgtttattgagagtccccctggctgcagatgctgggcaggggctttgatgtggggagaaagacccccccccaggttacaggtaagccctcccaagtggcccagggccctgggagggggtgaggttgtgtgagatggcagtgtgggagagtctcaaatttttggcatctttaatctgcccactgggtgagattgaggactcaggtgggtgtcaggggctttgaatgccaaaccacaaaggtctgcaggctgggggagctgcaggaggttgtcatcagtggcaggggccttggagcttggtggaggagaccacgcttcagatggccagctggagcaccccccaccagccccgctgcctggaccccttccacctctccatggacccacctcaggccctacccaccctctgcaccgccttgcacggcattgcttaatttcactgcaatggctcactggggctgctttcctccctctcttattgctctctgggtgagagttggtctctggcctccacatgaggcagggacagtgcccagggagtggccagtgggagaagcggggcttgcaggccaggtgggcccaagtgtgattcctggtgcagtgctggtggctgtgtcgcccggggcaagtggctcagagcctgtttctcatctgcagatggggggatggtctgtacctgtccagcacccatgaggagcaggtggaacaggatgtggcagtcaagggctcctgaggggacccgtaagtgccacattcagccttctgtgttaaggaccatgagtccaaagagtagtcgcgtgtgaatccacctccttgtgccagcctcacggcctcctcaggaagggcatggaggagcagtgggatgcccacggtaccgtggaggaagcagtcctggaggaagggtgactggccgagggccatgcggtgacgcactggggactggctctagctgctgtggggcacgtccacgtggagaagcgcttggtgtattcccccaccctctcacccccacagcgttcctggtgctctgggtgcctgctgtttctgagccatctaggtgggcacagggacaacctcaccagggacagtgtggccccatgctggtaagcaggcgatactgaccctggttccaaactgcattcctgttggtcctttgtcttgctcttccggtatcattacgaacacaactttagaaagtttaacagtggtactcagagaggcttgtggccccaactcatgtgacagtgaccaacaggtgaaaggtgacttgtggtctgaacacctgcaagggacacttattccgatgcctgaatctttgcatctctgcccagcagatgacagcacctggagtgttagctggtcatacctggacctgcgagtgtaggtaagacccttcttctcagggcctgtttgctcaactgcacgatggaagggttgggcaagatggatctttcctttcttttcttttcttttctcctttgcagttgaacatttttcttgccactgaaatcacaggtggaggtctgtgtgttcggcaggtgaatggccatgcaggggtggagggaggcctggatgctttttcttccctgcactcgcaggccccccatgggaccctcagcccccagaggacaattggaggcttctggactagggttctaaggtctcctgagaaggtcagaggctcgttgtccggccaagacagacagcagacagttggcgtgtctcagggtaggaggctccccaaatagaaagtactggattgggagcggatttattgttccctgcctccccggggccgtcggcatttcccctgtggctgcctcactgttctgatgttggcaaaggtttgttttatcttcctccttccagaacaggaggtgcctcagtgcctcagatgctgcctgagaaggtcagtggcatctgggagccatggtgagggtggcagtgactgggctcgggaggttccagaattctgttagtgagcagtgagctgttttattttccttcctgcctatggaaggtcctgagtgaacaaacaagtttcagtctcaagacaacacatcgtgtttcgaggtgacctgtccccaccccacccctgtcactgggagaagactgcaggtctcacggtctcccgtctgtctctgctgcccccaggtccagggactcctgcgatttctctccctggtgcctggtatttttgtagcactctctggttttcaaagttttcctacaacaattgtgcttaaaatgaaatataaactccatccccagcccccaagtcccactccctgccgacctcgtctcttactgggaaggcccatctttgtcaccagcagcagctgtgagtgcctcgtcagtgtttaagagtccaggtcgctgcagcatcttggtgtgtactgtggacccattgtgtgtgtgcccccaaattcctgtgctgagaccctcactccgagtaggatgttattaggaggcggggcctttgggaggtaatttggtcattagtgcccttataggaagaggatgcgagccagacctgcctctgctgtctaccaggcaagtatataatgagaaggtgacgtaggaggcgggactcgactccagaggcaggactcagacaccagaccaaattgaggactagctacaacagggccagggtagaaacagctttccctaagacgtgcccaccagtgtgcatgtcagtttaccactgccatggtaatacccggaagttacggctcctttccgtggcaatcatctgacgacctggaaattaccacccttttcctagaaatttctgcataatccaccccctaatttgcatgtaattaaaagtgggaataaatctgattgcagtgccgcctctgagctgctgctctgggcacactgcctgtggggtagccctgccccgcaaggaacagtccctctgctgccgctgggcacagctgcttcagtaaaattgctaataccaccggctcacccttgaattctttcctgagtgaagccaagaaccctcctgggctaagtcccagtttgggggctcacctgccctgcaagatcaggagccatctgtacaccaggaagacagccctccccagaactcaactgtgctggcaccttgatcttggacttccagcccccagaactgtaagaggtaaatgtttgttattgaagccacccagtctatggtaatttgttagagtggcctggaggaagacacagtattaagtaaggcttcgtgtctgacttcactgaacactgcggttgtgagacgcatctgttgtgtggggcactgaggttcattctgattgctttatgggactctgttgtgactgtactccagtttctctgcccgtggaatgtacatggatgtttggatagtttccagggtggggctgggacaaattgtgcagctctgagtgttcctgcacatgctttgtcttggacatgtgtccttctttctgttggacatacatgaaggaggtcagctgctgcttcacggggcatgtgtgtggtcatctttagtaaatatgccagtttttcaaagtggtcatagacagtagattccttttattatgtgacaagagctcaaatgccctggtagtgggagtggcagcaggagctacagtaagacattgcacattctctggaagtcagggatccctgccagtcagttcccagtgccccaggaaccaggggtttggtgctgggcactagtcatgaccactcgcggctcaggtgttgggtggtctttccagaccttcacctgtgtgaagcttgcaacctggatggtctcatgtggacatcttggcttccaccctgtgctctgtgtctggtctcagaccacagcccaccctggtggtctcctcaggacacataggctcctctgtaactcagtttcttgaattgaacaatggaagaaaatgcctctatgaagagaggtcattgtgcaaaacgtctgtgtgacagtattcttggagcaactgtgcttatcacccggaggccacagtggaattagtcatttgaaaaccagtcacctccaaaatagtcataatccaaaaccatccatctttgacttcagactccattataattttttctccctaagggactttgctttgtaattatgttggatttcctaatatattaaaataatttgtcatctcttgagcacacatctgcctgctatgagcaagcaggagaggccacttccggttttctgcaggtcccagtgagcatgtgaagcctgcgcctgggcaagaggttggatactgggaggaagaagcttttccagtaccctttcccaaagaccagccagtgagggaaatgggcaccgaatgcaccccaccccccggcctgggactgggccaagaaggaggaactgaccccagaaatggccccggaaccataacctgcttacactgtgacctgcagtgcccatggtggcagcctgggctgtttctggagttgagcggagagttcctccagtctaaactccttagagaacatgaatattcctgagggcctggggtccggcaccaccttcagtggactggatcaccttcttgaaggcagagagatcttaagagcttatgtctgactgcctacccgatgcccagcactaatctgcatgcaccccactgggccatgggcttctcaaaggtggggacgctgtccctgtacctaacacacatggtgggcactcggcctaggtttgcagggcctgctggggagttctccaaggcagttttatagctcagctccagcaccttcctgggggcccagtcctggatttgaggctgccaggggggtttgcagtcagctaagttggtacccatccatcccttcccctctgtaaggggtgacaagcactaagacctgttatgtcccctggaagctctacactctgtccccttgctcttgtgactctgctctttgctctcctgtccactggcatataggagtaggaggatattgacttagattcctttttattatttttgtttaaatcagctttgtggaaatgtaattcacataccctaccatttacccatttaaagtatacaatgtaaagtatacaattcagtgatttttagcatattcacttgtatgtgcaattatcaccatggtcaattttagagtgctttcatcactccaaaaggaaacccgtaccctttacctgctagcccctctttccccatccgctcttctgccagccccaagaaactacgaatctactttctgtctctgttctggacattttatatagatggaatcataccacatttgtccttttgtgtctggcatctttcattatatttttggggtcttgttgctgtttttgtgacagagtctcgctctgttgcccaggctggagtgcagtggcacgatctcagcttactgcaacctctgcccctccaggtttaagcagttctctgcctcagcctccggagtagctgggattacaggcgcgtgccaccacacccggctaatgttttgtatttttagtagagacgggatttcaccatcttgtccaggctggtcttgaactcctgacctcgtgatccacccaccttggcctcccaaattgctgggattacaggcatgagccactatgccaggctgttgttgttttttaagacgtggtctcgatctatccctcgggcgggagtgcagtggcatgaccatagctcactgcagccttgaactcctgggctcaagtgatccttctgcctcagcctcctgagtagctgggactacccccatgcaccaccatgcctagcttgtttatttatttagtagcgatgaggtctcactatgttgcccaggctggtctcgcagtgctgggctcaagcgatcctcccaccttggcctcccttagggctgggattacaggtgcgagccaccacacctggccaagaattggtattccttaaatatttgtagaattcagtagtgaagctatttggccagggcttttctttgtggatagtgttttgattactaattcaatctcttcacgtgttataagtctttcaaattgtctctttcttgagacagttctggtagtttgtgtctttctacttggcttagattttgcaggcctcccctgctctttcagtcatagttgacatttattgagttctttctatgtaccaagcatttgttgtgcattagctcatttaatctttacaaaaacttgatgagctaggtagtactattgtcatctccattttacaaatgcgggagtggaagcagggagaggtgagataacaggtcaaggtcacactgttaggaaataggaaacagtccagctgggctttgattccagacagtccagccatgcagcccctggccttgccacctccctctgccattctccagagactcggagaggggcctaaggcctgacatgaacgaagggctgggggaggtggggtcggaagggccccaggaaaagcgtgtgtgtgaagggctcagactcccagttggggagttcggatgtccccttctggggctttcatcttctaacctcctctcccaagcgctcagccaaagggcagcacagagcaccctaccctaaggtgtgacgccccagctggcaggactttggagcagtagatctgtgcccagcaggtctgtatgaatcacccaggcctctgcattttgcttttctagaggaagaggcatggcaatttgtaagacaatcgccagacagaaatcgggagcaaccagacataactcaacataattatttctgcataatgacttctgctacttgattctgtctcgagcaatgactgtaatctctatctgtcactgggaagctggtggccagggagcccctgtggcttagagatagagccaggaggaaatttgcaattcgagttaatggagtgttcccaagcagcctgagcgccaattccttcaaggtctccggaacagcagacccccttcctgctaggaagcctggtgtcagagctggctgggcctcctctgcggagtccagctcatccactttgtcacagatggggaaactggaaatggcagaggtcacaggatgtgcccaaggcacaggccaacctggaaccagcacttcctctccaccctcccaccacccagcattttccccttcagctggcctggctgtggtgggacagaggaaagatgcctctgtggagctggtcactgagagtgctggccaggcagggctgcccccaggaagctggagacagtggggcctttgcaaccagatagcgagggacctcaatgtggagatagggtgtgcttgctgagcgtgccagcaggcttgtgctcacctgctccagctgggggcatgcagaggcccctcctaccccaggaggatgcttattcactgcattccatggccttttaaaaatcccctttaggcccgggcgtggtggctcacacctgtaatcccagtactgagggaggccaaggcaggcagatggcttgagcccaggaatttgagaccagcctgggcaatgcagtgagatctcatctctactaaaaatgaaaaaaaaaaaaaaaaagattggggtgcacctgtagtcccagttacttgggaggctgaggctggaggattgcttgagcctgggaggttgaggctgcagtgagctttgattgtgccactgcgctccagcctgggtgacagagcgagatcctgtctcctgaaaaacaaacaaacaaaaaaaaaaccttgtaactaaccagagcagctgaaaagaacagagcatgggtttggggatttgtgttttgggcgccccacaccccatttagccgagtgtcacctgagctggtgtcccggagtctctttccttctccataaacagttgagaatgagctctctgccaggccggtaggaaggggatgatgaaatgaggacctggtacattctgctgctggttccattgctgggtttctcctcgtggagagcccttgaccctgtccaggtcttgatttctcggagtgtcaaagcagtgcgcacggagctgtgagataaattggctgagatcatcgatttgaaaacgccgtgagaaaatatggggcaaggcagagagcacagaggggctttagggcagcgagcccgcgctatgtgatgctgtaatggtgggtgcgcatcggtacacgtttgtcaaagcccacggagtggcccacgccaagagggaaccctaacgtgagctgcggacctggggggtgatgatggtcagtgcaggtccctcagttgtaacaaatggcctgctctggcaggggatgtggatcgtggggaaggctgtggccgggagtggtgtaaggggtgtgtgggaactttctgctcaattttgttgggaagacctaaaaaataaaatcttttattttattttatttttttgagacaacatttcactgtcacccaggctggagtgcagtggtgtgatctcggctcactgcaacctcagccttctgggcccaggtgatcttcccacctcagcctcccaggtagctgggactacaggcacgcaccaccacgcatggctaattttttgtatttttagtagagatggcatttcatcatgttgcccagggtggtctcgaactcctggagtcaagcaatccacctgcctcagcttcccagagtgctgggattacaggcgtgaacaatggtgtccagcctaaaatctatctttaaaacacacacacacacacacacacacacacacacacacacacacacactgctatcttaaaagcatagggaccttgcagtgagaatttctggtgggaagatgtatgactttgtcaggtcttgaattctagcagtgagtttacattccataattggcctacaaaattctatatttgggaaacagtagaaatttaactctgagcaagatacaccctatttccaatcacacgtgatgcatctcgggggcattcatttgtcaaacattatttgttgagcacctgctgtgtccaggctctggacgcatagacgtgaaacggacgatttcctgaccttgtggcgctcacagtcaggggggtgggttggtgggtgggtggaaggaggggagaggtgcagcacccccattgtgcaggagcgaggggagccccgctggcacgccgcactgtgctgaggctgggtgttctagggtgaacaagccacttcgtctagtgggtgcttgtaaagcgggatcgttgctatgagagagagaaccttgcgttgggagaaagtaattagggagtgtgcggtagatgcggaagagaaacgggccgtcaggtgaagtgactgtcaggattccatcctggctcggccccttggaagacacatgatcttgcaggtaattagctcctgtaagcctccatttttccccgtctgtcaaatggggatgatgattgtgcctgcctcccagggctgctgtgtggattacgttggataatgagtacaaatgcatagacagcctttagcaaggagcctggttgtatagagctgtcggcctcaacactgttaatacacatatgtaccagaggctgcaggttcacggaggaggagtcaccaatccatgcccggggagcaggcagagaagagggaggcgggcccgtcccgagttcacgccacgtgaaaggtgcttggaacgcttgtgccagagctggcagtgagggttgagggtgggagtggccgagcacctagacacccgcaatgcaaattttccttctcagtctctggatggttttctgagctgagctgcgggctgaatgtcaggtgatgcgtcctgacctcttcctgagcacctagtgtgtgccctgtgctgggcccaggaggcatgctgggggcaatgtgggcctcaaggaggaggtcgggtgatgaggggccaacccaggtatgccagtcaagaaaccgtggaggctggagagaccctgaagggagcagggcacagtcgtgggtggcaggcctgggtgtgcctgattccactgaaccctcgtaacagccctgggtgcagagtgtagagtgctgggtgaggacggaggctgtgcgtctgtgatggccccaggtgacaatgctgttgggatttgaacctgagtttgtggaccacagaggtcccggccacacttagtttccatgccagttttgtagtaaccagcaacctcactcgaagggtggccagcatcttaccttggggcttctatcaacgttgtcctgggcttctcgcctgctggggtgcagcggccttgggcatgtgcccctgtccatggtggctggccggaggccgggagccagggctttctgtatgtagcatggcacttgcaaaaactgtgatcccccagcaggcaccacagaagcaaccagagggaggggcatgggctccgggccgggtcgtcacagcctgcgtgacctgtcgctcttctcttccaggggcatggtctagtggcccagtcaggacgcggaaacactccctggaggttctgacccactccctctcagcctccgcctggtctctggtaagtcactcccagaggccgactggctcagggtgggtgaggactgaggatggaagtgggtggctcctgctgtgccgtggggtcctgcccatgtgtggggactggacccagctcagcagaaagagcagggaagactgggcgtggggggcagcccagctagcacccctagacaggtcaggaaactgcggctcggaaatgcagagaaacagccccccaggccccacagccatctcagctctcgccctaagctggccaggtctttctgggtaaatcgcgtgaccttcggtgcttctgtttggcgatttgtcaggggaatgaggggcccagaactttgagaaggacgtgtgggtgagggcaaggagggcactgtcttagtgtccgggtttctttgtcttctatcccctgcagcccctgtacctggaagcttccttctcccaggctcctgtgcatggtcagggccactcagccctctggacccccacccacgccagataagctgtctgcgctgggagctgggcatgtggctctcccctcagagcagttaccgtaggctgccgggcccagggtctgtctgaatccgccaccctgcagccccccaggcccctgcctgctctgggtgcgaggaaggcttgagggagggcaaagtgcttacagcttgaatgcaccaccctggcctggccactggtcgcctctcccccagtgttagcctggcttaggggctttttccatccggaatccttcctggccctgcctgagctaactccgtgagctcgggagggctcctcatgaccctggtcatcctgccagctcccgagacaggaaggcctggccatgtcccggggctgccctcgggtctggagagcctgccagccatgctgtggggctgcccttccagcgttgagggtttggttttgtttgtaagcaaggaaccaggtatgcgatgctggagagtgtgtaattctggctgtgcctcttcacagccccttccaatctcgtgcatattaaggttgataaaaacaccctcttcagggtcaatgcgagatcagacctggagtgaagtgtccctgtggtatctggaccagcaggacctggctgccccacagctcctcctctctctccctcctccctctcatggtctcatgactattatggtgactcttgtcactcaccaccctgccccacctgctcctgcatactgtgagcatcagttggggccatggatgtagcaagggtcagctgtcataggctcccggggggacacctgggggagggacatttggggacagagccccatctggccatgcccagcccctgagagccctcatcaccgacttgcatctggtgagtttggcagggtcctgtataaggattaaagtcctccaagtcctcatacaaagtcgctttccaaaagtctggaattttcttggccctagacacgggagatgctctttataattttcatcttcccactcagaaggaaccacctttgaatactcagccaggctaaaatttggacccaaaacctgttaaagcatcactgtcttaatttcagtgttcatgatggggttctgggctgtgtgaggggtggagggcagataccagtggcaggtttcatctgtggccctggtagatgtgagtcccgcagccggtcagcccagggcccagggcagaccccgggcgtggctgctttcccgctgggcaccaacgcacgcacgtggtgtttccagggcaaagtgagctccccaccctctgcccgtcccctgccccgcccttagatctgcatcccgtgggtggggtgggttttcctgccttcctcttcctgagggaggcgatttctccttccgctttctccttgccacagtagctgctgggttgggaggagacatccaggctggggcctcagcctcagggtgccagttagcgtgtggttagctgagaaaaaagtatttttctcagcagaaaatagacacaactgcatgtgaaggggccacttccactccttcattctccatccaccagccttactggagctagagagtgggggaacatctgggtccgtgttacctggatgtcacctgcatacaaatgtcctggcccgaggccactgtcagcacgggtgcacaggggaggcgcctggcccggcaggtcgtgctgaggctgatacccgtgtcaagaagctggagcaggcgaagagatcagaagagggtagaggaggtggtccgaggtgtccattcccatccccagacccctggggcatttcagtgcacgcacagcaaataatatcactgcaccaccaccaccaccaccaccaccaccaccatcaccaccaccaccaccaccatcaccaccaccaccaccatcaccaccaccaccaccatcaccaccaccaccaccaccaccaccatcaccaccaccaccaccaccaccaccatcaccaccactaccatcatcaccaccaccaccaccaccaccaccatcaccaccaccaccaccaccaccaccatcaccaccaccaccaccatcaccatcaccaccaccaccaccatcaccatcatcaccaccatcaccgccaccatcaccatcaccaccaccgccgccaccaccgccactgccaccgccaccatcaccgccaccactaccgccaccgccaccaccaccgccaccgccaccgccaccaccaccaccacgagttgagggactctgggatcagaaggcactttccagcacattcacaccattggccgtggatgttgtgggtcaggtgatgggcactggaagggccttccgcttctctctgcccctggcccttggtcatgtacagcaggccgctccccgggcagtggagaagcagcacctgcatactaaggctcgagtcccagcctcccctaccagcctccctctccacgtccccagacactcatgcgttccttcccttgaggtgggttcatggagcacgtaccctgtgtcagacaagcttccaggctctgggcttctgatggagaacagaccagagtaaacctggccccaaggaccttgagctccactcaaggggagacagacagtgaactcaacaaaacagaaatgagagaaaggatcaagctggaaaggggataaagaatgagtgtcggttttggatagagtgcttggggaaggccttcctgagatgagacctgaccaaaggcctgcaggaggtcagggacgggcgtgcttctagctaaggagcagctggtgcaaagggcctgtggcagacgtgcacccgtggcaaggagggggcgagcaggcggctcagccaggtcggagtgggtcacacctgaggggcaggacgctggcaaccccgaccgctgaggaagacaggtgcgagcagcatctcggcacagccagacccccaccatacggcagccctctgtgtcccttaaataaggatgcctcctcccaggcttaagagatcattgttgctcatagtgatttgtgtagccaacaattcttctggaagaagttagatgaacagggccatggagatttggggccggaagagcaggaccccaggcttgcctcccctctagtgctggccaggccgtggatcccaggcgggcatctcagagagccatctgagcggcctttctggaagtgccctcctaggcagacgctggtcatgaggcagggcagcggggaagggacaatcctcctgtgttgtacattgagggttatatttagggtgacttgggatgacttggcagtatcacttcctgtggtcgtcccctccagccctcagccacggagggcagatcctgtctgacaagcattgtgggcagacacgtgcctgcacacacgtacacacccacatgcacacatacacacacgcacacacatacacacattgtgggcaggcacaacttggcattctcatctgccctggaattggtggagggctggggacattgtcctggcccttctgcaggaccgccaggtgcctggcgggggaatcctagccgtcagcatctccggagcatctgctccatgtcgggctctgtgtgaagggctgcatccagatcccacatgagcaagaccggcctagcctccccatctggttgggagatgccaggcagaggtggaaggaagggcggctgacctgccccttagtctgctcagccacacaggcagccacagccgaggctgcacaaggacactcccctgaccttgctgcctgctggccccgggtctccaggccaggtccgagccagccaggctcctccccacccatgtcaccggcctctctaggtggagtccacagtgatctttgctccccttccccaggcatccagcaccacaccaggcacagggcctggtatttctgggacagcccagattacacgttttctctcagttaccccctagaatattcttggacttctcagaccccatgtgcaaatttttagcttagaagtaatcactgggatcatagacgatgtttagcaaatatctgttcttttgggtgttcctaggcccccagagggtctccgggaaactggctcttttgctgaggctagagactatctgggctagaatgtgtctgatggggctctcggagggtgcacagacagtgccgcggtggccgaagatccactattccaaggccggatctgcagaggatttggaagttgtctgtaaggagcgcctagatcacccggaccttctctctccctccttgacttccttcctgcctctcgtcaaacaattactgtgtgcttcctgtgttctaggcgctgtgctaataattggttatgggattattcctagccacaccctgggtaaatggaacccagctctctgtccttgggaaaagggtcaggagagaactggggcccagctgggaagctggaggcttgaggctgctggtccatgttggaatgctgtctccctctgccatccagcacccaagcccggcgccaggctcagagcaggaactgaagcttttgctgttgttgttgtttttgttttttgagacagtctcgctgtgtctcccaggctggagtgcagtggtgtgatctcagctcactgcaagctccgcctcctgggttcaagcgattctctgcctcagcctcctgagtagctgggattacaggcgcgcaccaccacgcccggctaatttttgtattttgagtagagacggggtttcaccatcttggccaggctggtcttgaactcctgacctcaggtaatctgcccgcctcggcctcccaaagtgctgggattgcaggcatgagtcaccgcacccggccaggaactgaaccttggtaggagaaggaaagaaggagttcctgtcttgctttcccgaccagactggaagcgctctgagggcgttttacacttcggtgtcttcccagcacttagcattgtggcctgcatgtaaggggtgttccgtgactgcgtgttgattacactttgtgtgtatgggtgggtgcgttgccacaactctccctgcagaatctgtggcctctggtgctgtgatttaaagactaaagatggcaaagagtggcttttatgagctgccccactcctgattataaacacactctctatgagtcagaggcctgggtgatcatggataagtcacttgccaacagttaactccagactgtagctgctggggccaccgagggcggctggaacatcaccattctgtgcctagcgtttcagccgggctgaggccattttattaataatgatttattgtttttattgcttcccagagatattaaacatgaatcaaataatgcatgtgatgattcactggaggttcccttccaaatttaaaaaagaattaaagaaaaagtttttgacgggtgtgctggtgtggacaccaggcaggcacctgagagccctcccaccttgagctcagccgtgggcagcacagcacagggtggaccttgccctgcagacagagccatgcagcctgcgcaaaaccccagggaggacgcgcgtctcacaaacacctcttcagtctaacatttacaatggtatttcttacaaatggtttccacccgagatatattacaatgtggccaaaccccattcatttgggacacataaattcaaaatttggaaatagttcctttggggctcatgaactgatcaagtttagtcatttctcaagcagggacctggcagaaatgttgctttttaccatctactaagacaagagctaggcagctggttctgctgaacaaggtcccggggagagggacaccagtcctggctcagtgagcagctcctcaggtgctttggaagcctcctctggggatagactcaaagaagttttctatttatttatttatttttctttatttttaaatgtttttctcaaggatgttttttagagctagctcatacctcaggggccacactgtccaaacacatattggaccctgatgaggaaagtgagagccgtcagggtgtgtgacatagccactgtcacccaggcctccagctccattctgcagttgaaaatgatgccctcataacaaagagttcttttgtgtgtgtgtgtgtgtgtgtgtgtgtgtgtgtgtgtgtgtgtgtgtgtgacggagtcttgctctgtcacccaggctggagtgcagtagtgtgatcttgtctcgctgcaacctccgcctcccaggttcaaatgagtctcctgcctcagcctcctgagtagctggattacaggtgcctgccatcatgcctggctaatttttgtatttttagtagtgatggggttttaccatgttggccaggctggtcttgaactcctgacttcaggtgatccgcccacctcaccctcccaaagtgctgggattacaggtgtgagccaccgagtccggccaacaaagagttcttatccgttcattacaaacgcccactctttccagtccttacctgatcaagaattcagaggcaatttttcaggtatttttttgactcggactttacaaatttgaactaccattcaagtaattggtctgaattcctaagtttcgatggtatttttctcttccttcttctggctgcctctcctccccataccctgcatttgttaatgtacccatttgttccatattctgtttgttctttattgctctatacactgctccataatgttctctatcatttgtccattcattacccatgaaggtacatgcagaggtcaccagcccagaggtttgtagcagggacaagttacttgctggtggtggtctccccaaaagtttgggcctgcgagtcattgacacctacacactttgaaaacaccccaggatgaagtctgggactggaaggagctcccaccttagccagactctggcctcctccccagctgtgtccccgccagcccttctccagccatgcccttttgcctcccagcacactgaggattcctcctggaatgcccctcaccccgtctttgctgggtgagtgtttccccagccccgctgagctcaggtatcagccccagcgctctgggtaagtctgggaccatctcctacattgtctgcaaaatcctgcagaaagcctggcctgtgctggtcagcaggatgctgcgtttccttttaaacagacccaaagcagtcagcagccacagactccccagagacggagatgagaggagggacctcatgccctgaggcagccccagcctcactcccatgccctgcaggcgctgagcagcccccagatcccgggctcctttgctgccccagggtcgggcagttcttgcatcttggaccgagtgggctctgccctgctgtggcatgactgggcttcttctgtcctttttctttattttctctttgaagaacaggagttggaatttcactcaccctgccccagctggatgtgtctaggccaccgtggtcccaggctctctgcccagctgggcctcaggaccaggttttaatgccgctgcttgggtgtgccgagcgagaagggctcgccaggcagtgcagagattccaccgagcccaggccgcagcccccacctcccgccgggctgtgctcagtgtcaggaatcggctcccaagatggccgcctttcttgtaaagctgtgccaataccccaggcatctgactggtgctttccagctggcactccttttacagattccatttccctttatcctcacaactgctcagtagaacctgcaggcagggacccttattcccattttacagtcaaggaaaataaggcccagagaagttgagacagccaggaccatatggctggagacggggcaggctgggcagagcccccagcagggcccctgggtctgcgggctgctcccagcagcacccctcatatacacaccctcatcctgactgcaggcccctgaagctggcattctggttcaattttacagaggagcaaacaggctgggtctggagcgttgacactggcaactctagcccagccttgcctgactccagggcatggctccaagaccctggaagagctgcctgtccctccatggcccctccagggcgtgctgggtgctggcagggcaggctgaggcactcgacagcagagttggccccgtagtctcagttttgctcccgctagggtgaaacacggttccctggggaagggctgttgctcacctcttggcctggaacatcagggtggaatttgcagacggaattctgccatctgacgcgtagatcttccccccaggcatgggtcagtgcttgagtcattctgcagctggcacaaagagccaggaagaatgcgctccaagatgcctgggagctggcatgccaaatcaccaggcgtcatcagcacagccaagccagggtgggggcctcgggcaggagcagcgccctgccagctctggctgactgcacgaggggccacatctagagggactgatgaaggggcgtctaaagcctcagtatctccagcctgctgtgccctcttacattttctcccaaagagcagtcagcttgcagtatgcgccaagtccccgcaaatgggacgttgggtgattcacatggttgtttcagcttttgagtttttgttgtgtgattgaatagtaatagaattattcttggtgttctatggagcattaccgggtagtggggaggtgggcacactgagcctctactgtttctccccttcacccctccttgctgtcatcaacatgcgttctcctacagtcatgctccgcgctaattcctttagtcattccttccagcattactgaaactggaagagtcttttgtggcatgtggggattcctcgtcgtgcagggcttgagtgccacaggacccagtgctcgctgtccccatgccctggcacacactgttccctttgtcccagctggagaactcctggaacctttaagccctggctcagccctcagctctgtcccatcccagctgacctctgtgctctgcgcccgagctcctgagcccacgtaagtctcttcatgcccatcactgctgtttcatgggcgtgtgtggggggtcacttcaaggagccccaggaagggtctgtgtcttgtccatccacgtgtgactacacccagcatggaacaggactcgggaaccactgaggtgtgggtgaaggaaccagtccagagactccactctcacttcagcctgatgtttctggggtctgtcactgaaaaccccaacttcgccttcaaagcgagatcctgggtgggggcagaggaagtcccaggctctgtggccaggactccacacccagatttccaccgggctcgctctagcctggccctggcacgggtgctgcgtggctctgctccccgcctggcatccggcacccttcacctctgtagaaacacggaactgtcacagggacagacgtacatgggtcgggggttgctttcagaaagtctatggtctcattttggtcctgcctttgagcttccttttcctgctgggttagggttccggacggaaggggagcattctcttgggcgtttcccttttcctgtctccctgttctctccccagaggctcatgtatgtccgtttcactcacctccctttctctgcttgggaggcagctcaaagagctcctctccaaagactcaagctggagtgatgttcgctctatgatgacgccgcactggtccagggaatgatctcactggagagtagcaggaagtcccccatcctgtcccccaccccactggctgaggaccatatagctgggatgtgttcacctgggaaggagattggcaccagtttgataaatggacacccccaagtctggcatggccccaaaactctactctgctgcagctgtttccatgccagaaaacagagatttccagaataccgagtctgaatgtgccttcttggagcagcttcaaatctgagcaggagagcacttgaccatcctaacccctgaccttcctccagcaattcctaaaactggaagagtcacagaatgttagaataagagggatcctagaaaaagaaccactcactcattgctttgttcatttgctcaggcactgtgctaggcgcttggaatacacaaccattcattcaaacatatttattgactgaattgtgtgccaggccctgttttgggccctgtgggggtacagtggtgaacaaaaggaggcagacagtcaagagattttgtaaatatagtgccaggtggcaggaaatgctgagaaaggggtcagggtgagggaccagagggtgagggtggatgctctttgaggtgggtccttggaggaggtttccccacgactgttgagcaagaacatgaacttggagggagtgagccttgcagacactgaggggaaggaagagcagacaggtggagggaactgcaggtgcgaaggccctgaggctggaacacgctgagcagcttctctgactgggacaaatgaaggattctccttcccccaggagctcccagtctaatgaaggaaaaagacaaagaagtgacgcgttcaaagctgagttcatactagaaaaacgctgttagaattcaaagggaagagcagttgtaggggctgggaaaggcaagcctgaggagtgacctttgcattgggctttggtggatgagtaggggttggcagggtggctgaggcgagcgtgccacacgggtgaactcatatctgcagaggcacaaggtgtgcagggacagccacccacacattcctcttcctgtcgcagtagcagcttctgcaagagaaagtacagctcttggggatttcccttttcctttctccacctcttccttctcaccagcttcatttagggcatttcagccttgagagggtggaaaagaaggagagattggtagaggaaggggatttctgtgccctgctgggtctctctctctctctcttctcatatgttatgtttttcttgtaaggttttggggagttgtggggagtttaagaggctggggatgggtaagaagtcaagaaggtttcggttggatttctcaacaacaggtcattggcctggagcccctccagtgggtaaaatgccgtgatgcaacagctttcaggaaggcctccagaaatgagctctaggtcagtgggttgggtttaggtgcaggcacgccctggaactgtcactctagaggtgttactaacctcctctttccccggatctgactcagcagggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtaattatgaaatacaaacgccatgatctttcactcaagggcactaaggagtgaataaataaaggataccacagggtgctaatgagcttgaagagtccctgtttggtagccccagatccagggtccctggtatcacccactgaatgctacttctacccagcactgcccacgggaaataaagtgggagacacatacctatgtgattgtaactttttctatagccgcattgaaaagtaaaaaagatgaaatttaaaacttgtttgatttaaaccgttagatcccaaatggtatcatttaccatttcacatgtaatcaagaaagagaaagtattaatgagatattttatgttgttttttttcatatgaagtcgtcaaaatccggcgtgtattttacactaagggcacatatatgagttcagactggcgacggtttatgtgctcagtagccacgtgtggctggttgtgaccatagtggacaaagcagccctagcttataggtggagacacggaggcacctgagaggggcggggtctcagctcaggccctgggagcctgttcaacagctccctctagcgtcggcccagccacacttcagcctggatggtcccagatgcatcggctcctccctgcacctgggtcctggcagccggcacagcctccccgcaatcacccaggggcaaaacgggcccctccttggagaactaccgggaagctaaggctgcaggcagcttgactgtcacttgcttatttggaggaaagaaggacacaggcccgagttgttttgaaaaatgcaatcagccctaggagaggggcttagctgcaggggccgtgtgggtccagcggtcaccgggagaaagaactgggttgggtgctggataagaaagagcacaaacctgtttgtcttccaccggccccttctgccttccaccttcctgttccaccccaggaagaacaagctctcatctcaaatggcctgagccctctgattccttgaagttcaaattcacaacaaacgcctctccagcctcttcctgagcctcagtcttttttttttttttttttttttttttttttgagacagagtctcgctctgttgcccaggctggagtgcagtggcaccacctcagctcactgcaacctccaccctccgggttcaagcaattctcccgtctcaacctcccgagtagctgggactaccaggtgcgtgccaccgcacccagctaattttttatatttttagtagggacggtttcaccatgttgctcaggctggtcttgaactcctgagctcagacaatccactgccttggcctcctgaagtgctgggatgacaggtgtgagccacggcgccccggccagcctgggtctctcataagcatttggtgtttcccacctctctggtcgccttccctcaaagcatctcagagtctggttggcctggcaagcttcggggatctgactgatgaaagcattttggagcaatgggatgagatgccaaccaatgccgtcagccggcactgaggtgggattaacaggacaatcaagccctcggttcccaggagcctcactgagcagctgctagaactgtgccactaaacaggctttaatttacaggcaataccgactctgggttaactatttctcacagggctccccagctgcatgtttacatttctttccttgttcctctttttcttcttcttctttttttttttttttttttttttttacaattcagcagattaagaacaatagcagggtaactgagaaccacagaggtggctgtaagtgactcattaactccctctcccatgtttccatcaccgtgaattacaacgtcatctctgatgccctcagacagctgttactagtttgatccgagccttgcttgaatatgaatctttttaagccgagcaggagatggttctgctctcaaatagactgccctcccctgggcctcccatttcttaccccaccatcctccttggagatgaaagacttcctgagaaatgaaggctgggtttgcctaattactggagcaaggtggctgttctgctgggaaacgtgagtggtggctttctgtctctgcagaaaggcttgcttttgctcggtcgtcttactagacagccaagcaccaataaggttggctcctttgcttaatgaatgacagaggggtcacagcagcatgcagcattccccccgccccccgtttcttgtgaggcagcctgcgtcgggcccgacagcctccaggagagagctaaaatgaggtccttcagattacatatttcatctgggcccttgttaataagcaaatgctggctgtcccagtgagtgactgggagtgtgtgtgtggccgtcaccttcatttggcattcatgggctccatttaccagtttcataaaagttccagtggggaggccatcttgcaaagctgtcctggcgagcacaagcagagtgctggacaccagccaggagcaccctgggtggcctccacggctgcttatggtcttggcatggaaagggcccagaggaggttacaggacaatgggaaggaggtgggctctccactcagacctcctgggtccacagcccaccaccccaccgaagcctcggtcccttgtccctaaggtggagctgacattgcctcctctcggcctagccaggagtgaccccactttcccagctcctagaatcttcactgtgtcctcccctggatgtggcctacagggactgggcctcctgcagcctttgaaatcctccttgtcattcagttgtgattccaaatgccgttgtcctaggcaagccgccgagtgccccgggaatgagcgactcccctggaccccactttattcactttttatgccccttcctgggcatgcctacaccataactcaagccccccagggagctggtgactggggaccggcatcccagtgctcagcctgggattcggcactcagagggcccgacagcctggaatacactgagcaccccgctggcaccaggccccaaggacaggctgatgtttccacttccctggagaaagatcctccagtcccctgctcggaggctgatcccggctggctgcccgcttgctcagggcaaggaggtaggctggagagggcagacttccctcaactcacccatcttctgtgggttcctcaccagccttcctctgggcctgttgttctcctgtccagtgtctttccagagaagattcctcccccaagctttggagatggggctggggtgggggtggttacctgaccgctgagtcgcagtacagggttccatgttggtcaggggtggctaattgctgtaagaagcaagtgccaacctttgcttggcccagtgaagtggtgtttcctgatgtgttgcagtgggatgtcaccgcaggagacgaaggctctattccacgcagtcacgcaaggacttaagtttcttctttttagaaggtctttcgtctcacagcctttctcagccggggttccaggagggaatcaaggactcacagcaaaggcatcatggtgtgcagggaacgactttcctcctgcatacctggaatgaaaccagttacacaccatccttaggtacatgactggttggggaaatgggcacaccagtcattgactgcaggctgtggttcagatgagaaagcctggttgagaaatgctttagggtctatgccctctggggcctccaagtcctcccctggatagtctgcttccaggtgcccagcaagaaagggcaggaaagggcgtgtgcagcaagggctgccctgacagttatggaggctcaggccagaagtgtggtcatcactctggccacatcccattggccagagtgtagtcacatggtaccacctagctgcaagggaggctgggaaatgtagtccggctgtgtgccctggaagaaaaggcaatagagtaagaagagcacatggtctcggcacaggctctattcttgcacattccttcagactctgcctcccacacctcctgaggctctggggataccctatccctgagccttctggaattttggggccccagttgccctgtttctccttcctggcccccctccctgttcagctgtttgccatctccctgcccacttcccactgatatgtgttggggcttgtggatgtgatcaaggtcataggcacagtctttcttttctttttcttgttctccttgttggggtggggattttttcaaaaggaagcggcaaaggtattgtactatttttgggtccctacactcttctgcctccacattcttctgttgtgtttatgctgctagacctggaaccttaggatgagcaggtcttggcatcagactttgtttgcatcagcagaatcctttctttgaaagagaacagatgcagaaacagatcagagggttgctgctctggtctgtgctgggcctggaggcccagagtccttcctcctcccctgcccatcctgtggacccccaaagccttaggaaggtccctggggctcctgggacacagctcagaggctcctggctggtgtcactcctctctgtgaggcttgaattctctcccttgcattccgaaagtgggtcacactggaataccagctttgtccaaacctccctgcctctggagttagccaaaccttaaagcaggttcttgtgcatgtgtgtatacacagcaactgcaaccacagcaagagtgtccattcacccaacacagacacccaccttgtgccaggcccagctgggtcacctgggagagggtgaagggtaggaagcccttccagaggaggtgctgagtgaggcaggaggccgcaggcgcacacgtctgccctctggcacacgcaggaaggtgctgggaatgcagggagcttctccccagcagaccatgatgcactccgcctgttaccttctagcggtgtgctcactgggtttggcactgcccctaatctggtacctccctttctatacgcatctgtgatttcaggcagataagtgttatgagtttggcattccaatgggatcggtaagaacataaatcaccgatccatcctgggataaatttctcccttcgttctgagaggtgatttggttttcactgaggtgagtggattcttaaggcagtgatcctcaactcccagggcctagaacttcacagaaggtggctcattttgataatgaaaaatgcaggggtgcaaatcaggcagaaagggcctgccactagccaacaatgtgtccatcaccatgtcgcccttgcctgggccagcctcccctctgctgcccatgcaaggcctggggaggaggccagaccgcctgggtccaagccctggctttgcctctcagaggttccggggctctcccagggttggtttacttgtggtgaagcgtgactaataggtaaagtatctgacaaaatgggccccacaggccatggttgctgcttctggctgtccctgctgagagcaggtgtaacgtacctggcatcactcctgccccagagacaccgataacacatgtttgtcagctgtaggtcagttccccaagggtggctgctgtgctactgtaacacgggactgcagactgggcacttaaactacagaactctgttttctcacggtctggaggccagaagtccaaggtgttggcagggttgggtgttggcagggttgggtgttggcagggttgtttcctccagaggcccctctcctagaattgcagatggctgtcattttgctgtgccttcacacggtttcccctgtgtgtctgtgtcctcatctcctcttcttataaggacaccagtcatattggattagggcccaccctggtgacctcattttaacctaatgacctctttaaagactgtgtttccaagtacagtcccattctgagggacctggggttaggactttaacatgggaatttgggggaagcacagttgaggccatagcagcagctgtctcattctgctcacagctggttctctctggccacgtgccagagaggagtacgatgccatccccttaaaccacacacggacatgctgccaggaggaacgtcatcacctttcagctgaaaggagtgaggaatgaggacaagcaggtgcagaacacagccttctcacgtactggtccattctgcacgtgcgctgctgctgttacagcggcagacgggaggctgaactagagacacctaagacaaaccctgctttcccctccagatgctggctgcaagaacgccacagtttgagaggagtgtggacaatagaaagccttgagagcagctgagctgacgaagggatgggaaaatgggcccttttgaagcctaggaatgaccaagtggagatgtgcagggtttgggggtgccccagcttgagtctcagtgctctgagggacatagcgcagagtgggacagcccggtgggtcaacccctgcctggttctgcagacttggagaggtgggacttctgccccaggccgcatggagggccggccctgggctgggtgtgcctcacgctgcctgggagcctcaggcaacctgctgcagctgcttgttttgccactcactggcctgactgcgggagctggaggggctgggaggtcattccctactccacagcttagctcaacctcccaggtgccccgcacccccatccctcccttcccataaaaccagttattcctcatcctcataagcgctcctaggacacttgccatgttctatcagtttgggggttctctggggcagccatccacagatccatgccccgcctatgagccatctcccctctccttctcacccccgtgctccccgtgtggtgtcggcccccgaggcaaggaccgtatgggttttgttcactgcccacactccctctgacacacaggaagttctggaaaagcttccgcatggtgaaggagccacatgcggtttggtcgggtgccccaggcctcctcttgatcatcacgaccaccctgccatccctgttattcggggggagtccagagctccaggaagttgaccacctccccaaggtcccccgagcaggggtgggtggaactggctctgagcccacactcaatgcctttcccctgtgccccggagcctggcttggtgccacccaggacttgtttgtggaagtgacatgtgaacacctagcgagctccatgggctctgcgtgtgtacgtctttgctgactcagtggccccacacagcaacccgagggccagggcagaaagcacaggaggagccaccacgggtgctgcagggcctcaggctgggcatccatcctctacctgtccttctgccgtccatctgtgggttctccctcaggtgccacgcaaggctggtccttcacaatggcccaggccctcaaactcagtggtcaggagggttcccaccacctcagggcttagcggcagtcaaggtaacctcaggtcctcaggctacctttgcaaataggtccttgcaaagaccctaattcacattcacagatactgggagttaggacttcaacatcttttaggcgggccatgattcaacccatgcatctgggcctaggaagtggaactgccccagtgagcgatgccctgggcactgtgcagttctgggggacacagccctgacagccggaggggggctttctgggcacagagctgtctgggatccgccaaggcaacacaggaaggagtccagagctcacctgggtgagacccgagagctgtcagtgacagcagaatccagagggagcccacatctccaagccaggtccagagctcttccaacaggatagcagtcttgtcaggcactctgggaggccaaagtgggaggatcactttggggccaggagttcgagcaacctgggcaacatagcaagatccctatctctacaaacaaaccaaaaacctcagtagcatctttgttgttttttctcttctgtcaggtattttggtagtagtgatcttctgattttacattccctttttttttttttccatgtagaaatctctatggccatttcctcttgtgaattaattgagtttctaaagtgaactagctgcatgttagaaccaggacttttttgagccctttagagcatgctggcaggcgtcatccccaagccccagggtgggtcatatttctggatgatggaggcagggggtgcaggggtcccctatctgcacattgttctgagtctgatgtgattcctcaactcctccatgaaacaggggccatgcttgtcctcgtctggggcaaactgcagttggagaggctggcctcctgtggctgcatatccagagctgggcttaactggccaggaggagagaagaatcctctctcttaataaaaagtccccaggggctgggcacagtggctcacacctgtaatcccagcacattgggaggctgaggcaggtggatcacctgaagtcaggagttcgagaccaggttggccaacatggtgaaaccccatctctactaaaaatacaaaaattagctgggcatggtggtgcatacctgtaattccagctacttgggaggctgaggcacaagaatcgcttgaacccaggaggcggaggttgcagtgagctgagatcgctccattgcactccaacctgggtgacaagagcgaaactccctctcaaaaaaaaacaaaaaaaaaagtccccagggcccatgtccacccagccgtctctctccctcccggccaatgttattctttcctcataagcccttccagagcacaaacacacaagcacgtatgtttgtcttcttttctcataaatggtaacaagctctgcttgctgttgtgcagcttctcttttcacataaaaatacaccttgaagattatttcttatgagtacgtaagatgggcacctgagtagtttgctgttacagaccacgtaggcaatggccacctgcacagattatttgcacaggtgggagtatcattagatgtttctggaagtgggatggctgggtcaaggtgaatgtgtgtttggaattttgaaagataaagtcataaagataagtaaaaacacctggcatcttggctcacggctgtagtcccaacacattgggaggtcaaggtgggaggactgcttgaagctaggagcttgagactggcctgggcaaaatagtgaggccctgtttctacaaaaaaaaaaaaaattaactgggtgtggtggtgtgtgcccatagtctcagctactcaggagactgaggtgggaggatcacttgagcaccggaggtcaaggcttcagtgagtcatgatcacacactgcagcctgggtgacagagtgagagcctgtctcaaaaaataaataaataaaaaatagatagatagattgattgattgatatagagaggataagtaaaaacaaaaacatgtatgtactataaaacctgggatgggctgggcgtggtggcttatgcctatactcctaacactttgagaggccaaggcaggcgaatcacttgaggtcaggagtttgagaccaacctggccaacatagtgtgaaaccctgtctctactaaaaatacataaataaataaataaataaatagccaggtgtggtggtgcatgcctataatcctagctactcaggaggctgagttgggaggattgcttgaacccaggaggtggaggttgcagtgagccgagatcacaccactgcacactcctcataagtgcctggaagggcaacacagtgagactccatctcaaaaaaaaaaaaaaaaaaaaaaaaacaaccctgggatagaggcagagaagaaaggaagtggtgggcagtgtgggtggtctgtcttacctttcataatggagagctggtgcctactgtttagaattcacaaacacagagttcaaagtggttgccactgtggctagggtaggagacatctttttatttctcattcttccatgtacttcaaaaattatcacgccctgtatatcagttaactgttaatgtaagaaaataacatgaggtggtgcagtggcagccgtgtgaatgccggttgatcagtcttgcattcaggacttgtggagaaccgccctgggggatggttttgagcagagcagttcctcgttcccacaggtgcctcatttttccctggttccattcagaacatcatttactgcctagagctaattccagatcctcctcccacccggggcagtttatcaaaggcaaaataaagagggtgggccggggacagtggctcacacctgtaatcccagcaccttgggaggccgaggcaggtggatcacctgaggtctggagttcgagaccagcctggccaacatggtgaaaccctgtctctactaaaaatacaaaaaattagctgggcgcggtggtgcatgcctgtaatcccagctactcaggaggctgaggcaggagaattgcttgaacctgggaggcggaggttacagtgagctgtgatcctgctactgcactgcagcctgggcgacaagagcaaaactccatctcaaaagaaacaaacaaataaacaaataaagaaggtgggtgggggtgactccctgaaagtttctagacgcctcttctaaagataaaaacataatgtgatgcctgaaagagggaagaactgccccaaagagtctgggatgtggctgaggtggccactttgccaggagctgatgagggggatgaaagtaagaactgattttaatcttcgcctctcgtacaacccctggtgggcaccggatgatgccctgttccactgattttaagttgcattttcccccccgcatttccacattctccaagtgagaacgtgtcccgcagtgtgagggtgagctgtcgtgatataattagagtctcttggccttcttggtggtccataagatagcggcatgccttccgatgggggacccgggagttgctgagtcgcagcgcttgcacagcgatgggcttatttggtctctccggcacatggctcagccctgctccgtggccgtgggtggcgtccccggctgaccccctgtcttgcaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggtaccggcgcccgaggccccgggtctcaccgcgggcccaggtcccctcccagctcccagcccccagcccagggcttttttttttttttttttttttaagacaggaatcttgctctagtgactggagtgcagtggcactatctcagctcactgcaacctctgcctcctgggctcaggtgatttttccgcttcagcctcttgagcacctccatgccctgttaatttttttggtatttttgatggtagagagagggttttgccacattatccaggctggtcttgaactcctaggctcaagcgatctgcccgcctcagcctcccagagtgctagaatgacaggtgtgagccaccgtgcctggcctccctgtgttctttatgttcactcgacattgggtctttcttggccaggttgctacctggtgcactttggaaagtgagcagttgtcacctgattgggcagacccttgcaaagggcaatggtaaaagccaatgtttattgatcacttgctatacatcagggccgggtggagcactttgatccgttttcatcttcataacccaacaacgtgggtcattctctgcattttacaaagtctgagactcaaatagatgaatttctaaaaattatattttatatatatttggagatggagtctcactttgtcgcccaggctggagtgcagtggcatgatctcggctcactgcaacctccacctcctgggttcaagagattctcctgtctcagcctcccatgtagctgggattacaggtatgtgccaccgcagccagctaatttttgtatttttagtagagacgaggtttcaccatgttggccaggctagtcttaaactcctcacctcagttgatctgccttcagcctcccaaagtgctaggattacaggcatgggccaccgtgcctggccaagaattgtatgattgctgggctccttggcacttgcaagaggtacctgccaagacctggggaaagccctggatttgagaactcaacagatagcttgtgatgtccccaggaatgcgcagtcatcaagtaaaactgaagcattaacgatcacgagaatcagctcagcacgggaaagacgtcactttaggaggcatctcttcaccttcatgcctatcaacagctctagcagaaaggccatgtttcagaaggaaaccaagttttgttcacttggccaggtgcctaggtatgcgagagagagtagagagcagagctgcccctccctggcattcccctgagtgcctccctgagcccaggagcatccaattctagaactcatggccaggcctgtaatcccaacactttgggtggccgaggctggaggatcgcgtgagcccgggagtttgagaccagcctgggcaatatagtgagactccatctctataaaaaattaaaagagtagcagggcatagtggcatgcacctgtagtcccagctacttgggaggctgagatgggaggattgcttgagcccaggagttcaaggtgacagtgagctgtgattgcactgctgcattccagcctgggtgacagagtgagaccctgcctccaaaaagaccaaaagcaaaataagaaaaaaatggaactcttcagaaggggtggtcccatggtagggaacttcaggggtgggcctccagtagcgggtatcaaatccgtgaacttctgcagcagcagtggcccgcctcaggaatgagcgacccatttcccacgtagatggttttcacactgtcagagtaaattaacatgggctcggggaactctggtactgtcgtcactttctggctcttagcttcatgcagtggcggaagtaagaattctattccccaggaatcacccgtcctgtcctgtgtgttaacccttaccctttgcaaataggtgtgcctgtcactggccgtgcagaggcttggtcagaacatcaaggcactggtagaactgttccaagcagtgaggagcagccacttctgtccaaacgggacagcccccaaaccaagtccccaaaccctgaaagccttcccccgacgccatcgatggctccctggccggctgggtggtgtttctcatgggacacttggttgctacctctttctcacaatgagaaaatggtctgttgtcaggaatgagaatatcaagccaccttcacgtggagtgctcagaaaatcccacagcagtgccaccactccccacgcatgtcactctgctcagtggccactcaccagtcccatcaccgtctcctctgtacacccaccagcagcacagagtcacatgccccaggctgggccactcaggcagagacacgcagagagaccagtggctagactgagccctcggctgacagtgccctaaacaggccatggagaccccagtgctgctgcttcctgtcctgtcggggctggtgatggggcttgccctgtgagtttcagggactcagtctcttttaaactgaggggtaacagccatggagtaaaatgcacacagctcagcaggcagtgtggggaatttcacacatctgtgaccaccactctccctcagcattcccagcccccgacagggacacttaggcaccttcctggcactacccacccccaggcagagataccagcaccctcaccaccctcccagtagaacccttctgccagctctgctcttgaacttcacatagacacccgtgaggttcactagggaacattctccccactggggaagggtcccgaaggccaccgggagcccctgacctctccgagccttgttgtgggctgggcggaagcccacccttgctgcacccgcccaagcccccgggcctctgagcacagtgtcattgcccccatccgcaggccatctacaagatggtgtcgtctgtgatgaagatgccggaggatgagtccaccccggagaagcgcacagacaagatcttcaggcagatggacaccaacaatgacggtagtgcggggtgggggcggggctgcatgtgtacgccacggtaggggcaaaaccatgtggtttggggcaccccctcccctctgcagcttcttggtctcctgagggccacccccgcccgccacctgcctggcgcctgccatgcccagggaagagcgggatgcagtcagggacacccgtgctgtatcctggctcctctgtgcagctttgtgatgctgggcatgttgtggcctctctgagccactgtctccccacttatagaatcgggcatacccatattcccgtgggtacaatgtttaggggcagggaggcaagcatgctggtggccctgaacctggaggggttgagatcaaaggatcccagatgttggggtcctggggtgctggccatgcctctcttgctgccatcctgagagaagaagctgcccagatggccccagtgtccaaggggaactgtcaggatgtacgctgccaccttgtccacctacagcagctctgtggagactcagccccactgcagaagtgcaagtctcacgatggtgggtggcagcagtggtgacagggctgtgcctcgagtgccctcctctgcattggctgtgaggtgagggcggctgtgcggccctcccattctgctcttcttgccggctttgtcaagagcagccacagcaccaggtttgctttgcttttgagcaataaagaaacacgaccttaagaagagaaaatacaggctgggcgcagtggctcacgcctgtaatcccagcactttgggaggccgaggtgggcagatcacgaggtcaggagatcgagaccatcctggctaacacggtgaaaccccgtctctgctaaaaatacaaaaaaattagccaggcgtggtggcgggcgcctgtagtcccagctactcgggaggctgaggcaggagaatggtgtgaacccgggaggcagagcttgcagtgagccgagatcgcaccactgcactccagcctgggcgatagagtgagactccatctcaaaaaaataaagaggaaatactccctgggttgtgctggggattaaacgataagctaatgcccaagaagctgctctgcgaagtctggagtgcagccctcgggtgagttaagcatggccccagcgggagacgggatgtgggggagctgtaagcagcaaagagcattccaggcagccaggtcacagtttcaaaacacacacacacagaaaacaaggctgcctggtgcctggcgttgcctttgggctgatgggaaatgtgtgttccaccctccagcctagcagggcacctgctgccgctctcctgaggctgtccgctcctcgtggggatggtgaatccggtcccatggggttgtgaggtttcagcgagatgatgccttaaagcttttagcagggcttgcactccacaaataatggctgttgttcccaacttcacagtgtccctggggaagccacccatggtcactcgctgcccgaatctgcctcctggcttggccctgcccacctcttcagagggcatcttctaggttggttgggaatttggatggcatggtcgttgctaatgtgcctgctgggatggagcacttcctcctgtgagcccaggggacccgcctgtccctggagcttggggcaaggagggaagagtgataccaggaaggtggggctgcagccaggggccagagtcagttcagggagtggtcctcggccctcaaagctcctccggggactgctcaggagtgatggtgccctggagtttgccccaacttccctggccaccctggaaggtgcctggctgctccaggcctctaggctgggctgatgggtttctccaggacacaagtatcattaaagccaccctctcctcagcttgtcaggccgcacatgtgggacaggctgtgctcagcaaccccctcgcctgccctgccctccatcaggaggagccagtggaaccttcggaagctcccagcatctcagcagccctcagagtcgtcctggggcagctctggttctcctgactggaggtccatctgggctggcctgctctctctcggcctgagacaggagggcctggggtcaggaactggaagtggggaggctggggccgtggactctgaggccccacacctagccaaggagatgaccacacagctggctgccctgagtggtcagaggtggagggtggggagccactctctccattggcagaggttcctggggactgtctgctgagggcctggctgtccctccctctccctacccaccccttagcccgggcattgtttgggctctcttggggccagcaggctgcccaggccccagaggcatcaagttcgtgccctggaagaagccagcctgcccaagcctgggccagagtcccatgaggacaggtgtccctgcctgccagtgggctggaggggctgaattcccagcagggccctactgtgcaggggcatcctccgtcctggtgctggtctgagtcctcaaatgcatcctcccaggtgcctttgagatgggtgttcccattatcccaccttcgagacgaagatcctgagacctggaaacgttggtggcttgccatgcgccagagccgagagcccctcctgcatgccttcccctgtgctgggcctggctgcatgcgtctgtgttgcctgcacagacattttgcagggtgccctagtgattccagctgacagcacagagcctcaaacagacacatggaggggctgccccaggaccaggccgccaggacgcagccaacctcaaacctcatccttccccaccagctggagccagagggaccgcctcctgcccttgaggccatgtctgaacgggcagaatccttacagcctatcctgcttgtggactagcagagccagggctatagtgaccacagtgtgagctcattgacagcggttatgggatggggagcggagggtcagaaaacctcaccccacccagctcagccgatcagccttacggagccctgccctaggccacgagcctccagaggccactcagcccagtgtggagtcaccgagtctgtgtcctgggagagggaatatgttgtcaccagcattggatgcggaggatgagggggcagctgattccttagcacgaccaatctttttctaggttttcctctcaccgcatggggccaaaacagtacagagcatgagtttggtaccccaagcctgagcagcgggtctacgctgatgccagggaggatccggaccgtgcttccgggggcccccaaccagcatggccttctcagcctggattctgtatgggttagaggcaaatgcttcatttttctgcacagtgtacacgttccttaataagcgaagtgtggggtgatttctaaaaggatttaaatggccctcatcagccacgtcctgctgagcttgctgggtaagccctttgaggtacctgatgtattgcagggagcagggaaaggaaaaaggattttttttcagaaatgcctgtaaagtgaatggagactagacaccgtccagcttcaagaaggctcaggactttcaacaaagggagcatacctgacctgagagctgtccccatcctctctggaagcataaagaacagtgagcactggctaatcccattgtctctggtcccctgcaggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctga

SEQ ID NO: 1750 - DNA, 123918 bp, Homo sapiens
agcttctgccaagggtgggggcccacgcggaggcgatccgctcgttcctcccagggccatggggcgacgaggagagccctggcctccccgcgacccgcactgcgacctgggccagacgcgccaccttccccggtcgcggtttgcttctctttaaaatgaggacagctcctcccttgggggctgtggtgacaggtgaaatgagaacgcactgaagacagctcttggtccaaagccccgcacacagtaggtactgtgttaattggattagcgtctcctgtttaaaatcctttttttttcccctttatcgtgggtggggccttacattttccccgggcgtgttttgtgcctctccctggccctaacttaaccgcgaagcactgagattcgagaaagtttagctgccagctgcgctgcctcctgcagcacctcccgggcggcgccgcctccgcgagtgcccgagagcgccgcgctgggcgccggccctgccccagcccccaggctcccgcgcaagcgtgggggtccctctcctggccgggaggcagcgactgcggagttgagaaccctttggttcaacaagttcctagtccgggaggatgcagctcagctcgtggagtccgagagtcacggcgtaaaattggcgcttcccgcacatgcagatctcgggctcccggggtgtcccggccgccaaaggccacccctttcctcctggctgaccccaattccaccagaggaggatgtttgccagggacgccgagtccagctgctggcctcggcattagacaacccccagccccagcccctgccatccctgctcccttgcagccagcctcatgccgggggtgccacatgggacacctcctcctagtcccacaccttaatttaaaacatttacttttgaaacctactagtcgtaaaattgaaccgcagtgaacgagcacccagctcttaccacgactcactctctggagagttctggcgcctcggcgctggctcggacgcagcaaggccagctctaggggtcgggtggctctcggccagagcgaaggatattctttcccttcatcgccttggtgtctttctctgggggaaaaaaatcgcctttaaccaagggagccaagatctcaccagtgcaggaggctctcaaaatggagcgccggcatggggttgggctgcggaggggacagcatgggcggccttttggtatggatgcgcttcccaactgtcaggggctacgtgatggtgttcccagagaggcgggctgctttgcgggcttttaggagccagggatagaaacctggtccggttcctttggtttccctcggccgagactgaagccctgcaatcctagccatggcaggccagggggatgcgatgaactcattttctcatttttcatcctgacttagtgacaggggcacacttagaatgcaccctgttttctgtttcatcaaatgattttatgtcctacaagaaaaaagggcttttggtgtgaatcctactctttcctcataatcaggttccataataatattaaaaaaaaaatcagtctggctttctcagctcagaagacagacccaaacccaggtttgtgttttgttttgtttttgtttttttctagttaaagccagccctttgtctcaagcaagccagtgttttggccttagatctatttctgtttcacttttgaaagtgcctgtaattactgagctcttgaggttttattggataatgtggcaaagggaaggcccgggggccctgcctctcccttgcggtgggatgtggtgccacggtggcacattctagccttgcctgctccctctgcgtcccactttcatgctgtttttaaggtggaacagaaatgtcaatgtgtgataacaatttgggagactttgtctttggaatccaataaatggaaggtcctttgatctgtggagaaaccagaacaagtcaaaaccccagaagaacagagatttgcccaaactccagccaatgacccatttatttccaacaagccctcctagagatagattctaagtgaaatacaagaacgtggacacactccgtcccctttctggccacagggctgtgcagaattagaagtgcagtctatggaaggacaaggactggacttcgcttggtgcaaacgccccagccaggcgccccatactcacctagcaccatttcaccctggagctgtttcctcctgttgaagcgctggtgctcacaccccctaccttcagggctctgcaagcacagttccaaggtctgcagcgcgggtacagtgcatgccctgctgagtgtgcgtcagagcagttgtctccctgtgacacttattctaagaccctttttgctactcataagtggtagagtaccacactcactcatgaaccagtgataatccagggtactaacgggggccccggagtttatttggcaccgaagattaagctacttggcagctgaatttttatctagattggggttaggtttgtattaaaattttgcattccagcaagccctaaaccgtgcttgttcattgtgggataatgcgttcaactgatgagttgccaggccaggattgatgggggattatgtgtattctgctagtttgtcagcacctgatgtcactgtgctggggggtgggggaggcatgtttggagttaggatgagcagacacttgtagattttaatcacactctactttggggctccctgctctcctatggtagcagggggtttctgtgtcgttcttatgtcctcatgtaaagctgcacatctgtgaatgtcaggtagctcttgtgcttttccccttagattgagtttctaatctgggaatgacagagggtggctgtatatggagacagcagcatgggcttaggggctcttttggtgccagttaccctacggaaaaaaggtttcttcaaatcactttctacaaagactaaaaaatggttggaatctagtggtgcagattgtaatatgacttcaggtaatcaatacggtttgacaggtggaacatttcttagatgctgatgagcagggcgcaagtctcaagatttttaaatcatctgaaaagcacagtaaatcctttaaagagccctaccttggccatgttgtttcaagtaaaattgaatttcagaggcaaagcttcacatcggaggcatgacgaactaaagaaatccttcccagagacctccactctcttcctgttgccaccctcctctgccagcagcagggcaggaaagatgacttcttggggctgtgtgcctttaccttaagaagcaagtgcaccctgaatgcttctaatcccgcagctgggttgtctgggtatttggatctttttggtgcttgaggtactacccaagttggcaggaagccaggagcctgggggtggaggtgtcttagccccacctgtggcatgagacaagaggtcttctccagcaagggatgggtctctgacccttggctaagaaaactcaggattgttaaatacgtactgcatggataaggttgctgtgaccctgaaaaaaggaagaaggcttttgggtggtgcgtggttctcctcttggaagtcttcccagatttcgcctcagtactctcttgccctagcttaaatctttccttgctctgtgtccccttaggcaagtgaggtctcctctcaggtaggcatgatattaagtgcatgtctagaggacagttccttctacctgcccaggtgcactggctgaactcacctatgcccacatctgtgcattggcaggtgatatagatatacacctgagctgtccccctgagctgcagacctaacactaggtgtgggctccgagctgttccacatcaaaacagagccgaggacacatctccctcactgaagctgtgtctcctacctattatggtcaacacgtctcatctactcatttgttaaagctagaaatctctggagagttttggagctctttctctgtcttcacttgaaatctctggagagttttggagctctttgtctgtcttcactttgccatctaattgggtcagccctctctgagggctcacacccactcttccggcacagcggagccttatctgcccttggcccagagaatgcttccagttccttcactccagccacaccggcagcacttcccagtttaaaacgcagatttcatcatcccactgtcttctgcctccccaaccccaccaaaccttggtttgttctcttaacgcagtaagtgcttctgatacctactgtgtgccttggaccaagctggagtctgagaaggttgggcccaggcatcctccctacctgtgcagagtttaaggtcttgggctgggggttgtatgtggggtacctatcaaataagaccagggagcgtgaagtgctatggaggggagctcctaccccagtatagggggctccctggagaagcaccctctaagctgatacctgggagagttgggggtgcaggggaggggttggagttggggctggattgttcgatgcctttcttctgtctcacccagacttccttatctgctaaactcctactcatttttgttttaattaataccaagatagaatttatctctcataaagcatgcccattctaagtgtacagtttaatgattttcagtaaattaatagagttcatagccattaccacaatccagttttggaacatatccatcaccccagaaagatccctcttttgtacaaactccctgtccccgtcctcaagccgccagtcccccacagatttgctttctgtctctagatttgccttttctttctatgtttcttagtgtgttttcataggttcggcccaagagctgtttcatttgggccttcctagagtcttctagttagaatcaatttatcccccagcaccgacgaagtgagctgggtgcttggccatcccgctgctagatggcgagctctcttacctgcctctcctgcctgcacctggctcagcactggcacctacagaatacccaaggtgtgttggctggaccagctgaagttgtgttcctcacatttcttttgtataactcctgagtatctagcagagtgtggggatttaaaatacagcgcatgtattgatgtgtcaggtgatgtgagccctgctacatacataccttaacttgtttcatcaagaacttgtgaggcaaatggcaaatcaaaaacaaaaacaaacaaaacaaaacaaaacaaatctattttctaagccaggcacagtggctcttgtctgtagttccagctactagggggtgctgaggtgggaggattgcttgaaatcagggatttgagcctgggcaatattgtgagaccctgcttcttaacaaactttttttttttgagatagggtcttgctctgttgcccaggctggagtgcagtgatgtgatcccagctcactgcagccttgaactcctgggcccaagcaatccccctgccatagtctcctgagtagctaggactacaggtacacaccaccatgcctgctgatttttaaattttttgtggagacgaggtcttgctatgttgcccagactggtcttgagctcccgggctcaaataatcctccagccttggcctctcaaagtgctggaattataagtgtgaactactgtgcctcagcccaagccatttttctaaatgaaaaaactgaggaggcccagagcaaataagtagcccaagggcatcagcagaaagtagaaggatcaagaattaaacgaggtcactttctcttccgcccttgttttggtagtaatgatatgcccttttatggccttgcctgggctggtgttcagattttcctgtacgagtcttgtcatcccttcctaagccatggaagctccttctagggcatgagtgctgtgtgacacatgttcacacagtgttgccccagtacctacctagtccacaactgaacaggtagagatggttcaagcaatgtgtgtgtgtagagaggtctcctggtaaatagaaggggctgggggagggcgttgaatgcagtggtgctgtggccttgggtggcttggtgcatttctgatgcatttctcaccttggatcattttcactctttgaggaagagagcagaggatgagatgccatttgacagatgcacaaaccaagacacagaaattgtatacccattgtacgccaggtagatcacaaatgaccgttctctcccatggttgtagagaactctcatggtggacagaaaccatgaaagaaatcatggtggaaagaaccaagacattcttgaatcggagtattagaacctcatttgcaaaataccttggaaagatcagggacactggggtttgaattgtagtctttgctctgttgtttattggctggtgatggtctctgaatctgtttgctcaggtgcagaaaggggttttaggctgagctcagatattgacaggaactacaattcaaacccaggtctgcagatgtggcagactgggtttgaactgtagtctttgctctgtttactggctggtgatgttctctgagtctgtttggtcatgtgcagaaaggggttctaggcgcagctcagacgtagatggggacgcagatgtgagtacctaggtgagtctggctggtcacgtgtggaataagtggtggtggctgccattactctttaagcattcttggatctagtgcctcctctgccactgagtacagaattccttttcaaattcgggcttatgaggcatgttttgatccaggctgtcgtagcaagggatttgatgctggagtctgtgactgctgtgcgtgtggaggcttccggaaggcagccagtgctggttactgcttggagtttggggagctgccattttggattgtcctagcctcatgccttctgagaagcatctgtcagggtccctgatgcacctacagagaccctgagcttggtggtgggggttgcacagagagagctgcaggttgttcctcaggcataacgaggcccggagctggtggtcccctccctctgtgagtgtgtgcagagcatggatcgggtctgggagtgttcgtgctggcaggccggaggaggactgctgggcacacttgcagaattgcggttctgtacagcagtgtgtatcgactgcagcgctctttttctctagcagcaaaatgctcagctctctgccttctttctgtgcatttaacagacgtttccagaaagcagaattgatgacagccccaactcctccctttcactcccatcttttctatttgctgccctgtaatcaatttttggagagaagtgagaacctctcgaaatcgatcacctatgttgaaaaaaaatcatttttaacatcatgcagttttccgtatttactgtgtgtggctggagacactcctggcagaatgagtgtgggatgtaggaggtccagaaaagcccccagcttcaggggctgagatagggccatgggtggcagaactggttgtccccccgccccccaatccctcagcagtggttgaggtgtgctttattagaaactcttcagtcatgcagtttggagcccgtgctggtgatgcagcctggatgcctggcaggggcttagcctccaggggtgggacatgagatgtggctgccgtggcttctctgtgtctttcttcccagcgagtaaaggtagacgcagggctctggcaggtgctaaggccctgcttgccttcatgctggaatgctggcaggtacaatttattcttatttcttaggaggtgctttcccctcttctttctgaagacatccagggataaagaattgctgcttttatgagcacatgttcttggtgatatgctgttaccttatctaaaaacaatacggcctggctgattattctcagagctcattgtaaggtgaaaggttatgcatttgagaattattttcacagtgtggatgggagtggggggagaagatgtagagcacaggtaaggaattccaggttttggggccagggatcgccaagcagtgtaaagggctcactgtggcctgtagctccttccccctgtggtttgtgctgggccagttgctggctccccaaaaccattatcaccattatcattatcactatcatatccatcacctcaccatcattatcactgacatcatcacttttctccatcaccatcatcatcatcatcactatcatccccatccccatcatcatcattaccatcatcattgctgtcgctatcatcatcatcattccattcatcaccattcatcatcactgtcatcatcaccatcatcatcactgtcatcaccatcaccaccaccatcatcaccatcgccatcatcactgttatcgtcaccattcatcatcactgtcatcatcatcgtcatcactatcatccccaccatcaccaccatcattatcaccattctccatcaccatcatcactatcatcctcaccatcatcaccattctccatcaccatcatcatcatcactatcatccccaccatcatcaccatcaccatcatcatcactgtcatcatcaacatccatcatcactgtcatcaccatcatcatcactatcattaccatcaccatcaccaccattatcactgtcatcatcacctttctccatcaccatcatcatcatcatcatatcatcatcatcatcatcatatcatcctcatccccatcatcatcaccatcaccaccgtcattgctgtcatcatcaccattcaccatcaatgtcgtcatcaccatcatcatcactatcatcattatcaccatcatcaccatcaccatcatcattactgtcatcatcaccattcaccgtcactatcatcactgtcattatcaccatcatcatcaccaccaccatcaccatcatcactgtcatccccatcctcatcatcatcaccatcactgtcatcatcatcaccatcaccaccattgccatcaccatcaccatcattatcactgtcatcatcacctttctccatcaccatcatcatcatcatcatcactatcatccccatccccatcatcatcaccatcaccaccatcattgctgtcatcaccattcaccatcactgtcatcatcaccatcatcgtcattatcatcattgtcaccatcgtcaccatcaccgtcatcatcaccattcatcatcactgtcatcactgtcattatcaccatcatcatcaccaccaccaccatcaccatcactatcatcgtcatcatcatcactgtcaccaccatcaccatcactgtcaccaacatcatggtgcttctcaacctttgggctgctttgggtcgtgcttgacatggcacattcctggtgagttagctgttctttgggggttttctactgttggtgtggtgattagggtagtcaggacaggatgagtataggcatagagaacccaagtggatgatggtggagtgtgattcttctgaaagggtcttcatgagaaccactgatctagaagattctgggagaatctcacgtattctttcaggcccaggagtaagccagtgttacctgctctgtggagctctcctttgtccctccagggaggacaaattctggctggagcctgaccttactgcttgtccatctctcccagggtggtaggccactttaggtaggaccctgtggatttctccttggtgacccccgcattctgggcacagagcctggaacacaatgtctgcccagatgtgtgactgaaccaccccccaattccttaactgtaggatggcggctgccttcattagaatcttaacaccttgcctgagggctggctttgcaggtctgagtggctaggtcagggcactgctagtgttttctatgtttgtagtcaattggtgagagtttgttttacgcatttgttaaaactgtgggacagtggtctggaagccaacaaggctttagggttggcagagtgactcccatcccatcattgatgtctggctttgacttggcatgggagacattgcctctccagatctcagttctctcgtttgacaaatggggcttagggttgaacagcctctaagtcctctgtcagctctgcaattcaggaaagatgtttaaaaatgcatacttgcattgtaggtacatccaacatagagcaaagagagaattttcctagctaaattgactgcaaaaaaatgaaacctcttgggccgggcgtggtggctcatgcctgtaatcccagcactttgggaggctgaggcgggcaaattacgaagtcaggagttcaagaccagcctggccaacatggtgaaaccccgtctctactaaaagtataaaaattagctgggcttggtggcgggcgcctgtaatcccagctactcgggaggctgaggcaggagaattgcttcaacccaggaggcagaggttgcaatgagctgagagatctgagccactacactccagcctgggtgacagagcaagactccgtctcagggaaaaaaaaaaaaaaagaatcctcttataatatgcaggcatcttagcaactgccatcttagcaactgccatcttaagaggcagcattatgattcagaagaaactgataacattgaggaatacatttgtggagcacagattaggagagattggtgcaggggtggggggtggcaggaagatattaaggttggaatttagggaggtgagctctgtgggttggtttcatgcatccagctcaccattcaacctttcctgttaacttcctatattaaggaggctgagattaagaagacagggactcgtggcgtaagggcgagacagacatagaggtgagtgactgcagtgggatattcactgtgggagcattgaaggttggcagtcagctagattcttaggctgtagatcgggggccttatttagaagctgtttactgttcccttaagaggatcctctagcaggaaaaaccactgctagggttgttgctttcctcattataatgatgtctttatgttcgtcttaggaggtgatagtactgattatttaagaaactggtcagccaaacttcttaactaattgtgaattagagaaaagtcagaagtagggagtattatagagataagtaattgtattattttcagacaaaagtatatgtagtaatgtaaactactgaccagattttgtttcaaattgttttttttaaatgaattgctaagaattatttgaaattagcacattagcggtaataagatagtagatattagatagattagattaggatagtaggtagtagatgtaggtataaagagactgaaaatcagctgtttaaacatttttcccaaatgtggggctaggaagcaagataaagaattatgcaggccaggcgcggtggctcacgcctgtaatcccagcactttgggaggccgaggcgggcggatcatgaagtcaggagatcgagaccatcctggccaacacggtgaaaccccgtctctactaaaaatacaaaaaaaattagccgggcgtggtggcgggtgcctgtagtcccagctacacgggaggctgaggcaggagaatagggtgaacccaggaggtggagcttgcagtgagccgagatcgcgccactgcactccagcctgggcaacagagcgagactccgtctcaaaaaaaaaaaaaagaattatgcagacagtttcatttcatttatgtttggacggggaagaaagtcagaaaatagatgggaaggaaacatatctaaatgttaacggtggttgtattccatgggatcatgggtctttcttgatttttcatgttttgccacattctaaattttcaccagtgggcatttattatttttgcaattagacaggaaagagcctccaggaggaactccaaatacccatcctttatttaccctcttaatttgcttaccaaactttcttgttatggttagactggctggcatccataatttccatacttgtgattatttaaattaatggaaatttatcataatcccttattaaaatttcttcgctgcactgaaattcaacactgagcaaatctgttacctaggacataaagaaaaacattcagtccacgtgcggtggctcatgcctgtaatcccagcactttgggaggctgaggcaggcggatcacttgaggtcaggaggtcgagaccagcctggccaacatggtgaaaccccatctctactaaaaatacaaatattagctgggcatggtggctcacgcctgtagtgccagctactcgggaggctgacacatgagaatttcttgaacccaggaggtggaggttgcactgacccgagatcaggccactgcactccagcctgggcaacagagtgagacttgctctcaaaaaaaaacaacatccagagtcttccaggaaatttaccgtttcagtgtggcatagtgtagagtttgtttattatctagaatatggtttttcttttttgtgttcttgaacttgggcgttcacttcgtttgttgacctggaaggagccatctcggcgcctgctgtttgaaccttgggtattttaatgaagtggtttgatgtcctgataccaccagcccctgctgttgcttttcacggccctggcttttccaggaataatctccttactgtttgtcattctaatatgtttcagctccctttttgaaaataactttttctgctccccttccctgcccattcttcatgacccccagagaatgggcctgctggtctctagcccctgtgaattggaagactcctggcgatgatccttctttttctctctgtgactcaggcggttgatgttgggttgaccgtatttctttgctggctggtaagcagggccacctcagcccttgtgagggccatgcctgactttcaatggcttccctccaaaggcttcttaggccgttcctccccatcgtttttcagaggtttaatctgtttgagtccaggatattgagtcagcagtggaaagttatgaagatgaggccagccatcagaaaaattggctaatatgaaagattaattccagggtgaacaaaggagagggatgctggggccgggctgcctccccaggcaaatcacatcactgtaaaatccgagaaaccagaagttgcctttgctactcactcagtggctgcttgctgtttcttggattagatattgaaagaatcccatctttatagtctactgttcatatttatggtctggagaagaaaatgtaattttcagcaaaattctatcacgtctggtaaataatttcaggatctttacctatgataccacattaaaaaaaattcgtatggcttcagcattcagaaattgttcttttcaaactctgggccctcgggttattacaagatttaacaccgaggcaggaagcctgctcgcctatcactggagacaggtaggttgctatggagaccaggtgtgtgtccctgcggtttcctgggtatcccagttgtcctggaaaagaaatcagctcactttatgtgatatttctgcaatagtgtgtgtgaattaagtttttctaaacacagatcagatgtttttgttgacttacagtgtgatttctgacataattttgtcctcggttttgttttgcttaattatgaatcctacataaccctaccttttcctatcagaagcacttccatgcatcaagaccccctatccaaaacagccacaacaacttcaccaacaaaatctcttaaagctagagatgcctgctttggtgtgaatgatgattaccccttaaaataattcaacaattttttttttttttttttgagacagggtctcagtctgcctctcaggctggagtgcagtggcgtgatctcggttcactgcatcctgtgcctcctgggttcgagcaattctcctgcctcaacctcctgagtatctgggagtaccgggatgcaccaccatgcctggctaatttttgtatttttagcagagacggggtttcaccaggttggctaggctagtctcaaactcctgacctcaggtgatccacccaccttggcttcccaaagtgctgggattacaggtgtaaaccaccatgctcggcctcaacaattattatatatggtttgccagatcctggcctgggcactggggatgcaagatagagcaagaccattggaggccctgccctggcggagcttgtattagggttgtgatcctagaccacatgaagcccacaagggggccctgggctcacccgttcctggctcacattcactgtcagccacagctaaacctcggggcctggaacctctcttgttgtccccatgggacgagtgggcacatgccttgttggatggacaataacatcatctgtttttgtttgatgtgttattattcagaggcatttttcagaatggagaacagtgccttatcagtctgcttctgataattttatacatgaaaaaaatcctatttgtgcatattcttgggtctctccccatttctaaaggcagtcaacttggtggttggctgtaaaaagctctttacacttcctaggacttgtcaaatattgacaagtctttctcctttcatccagttcagcaccagcatcctcaaactcactgaaacagagcatcccacagtggcagccactgtaggccccaggtgggtatcctactcctccacccccgccccagactcccccaaccccagctcgcacctgcagaagttacgtctttgcagttatttcaggagaaaaaggcggccactctttctctcccttctttgggtttgtgttcagcaagggtctactgcagtcccggtgccggacagcctgttttgcccatgcttgttaactgatggggtcctcaagtggccttgtgacaggcctgataaggccgcacgtgggtgtggttagagttgatgaccgctccggacattggcgatgtgaggaaagtgacagactccagcctccatgtgcagccggtgattggccgggtgggctcggttttctagtggcaaaggatgctgtgatctgaataagaaaacaaacctcaggccccaagtgccacgggcttagagacttgagaggaggtgcttgcaactccatctgggaggctaagggcagccaagagctgctgtcttgaggctgacccactcccttgcagtgtaatgggtagtgaacaggccatcctttttaaaggaaaataagtgcctccctatggactctgttcctatcctgctaccctccctgaagcttgaatagcacccacccgtgccttctccatgccagcccttgggtctgccgggaccactgccatgcttttgatggacacggccttgtagcgtctatatcctcatctgtgaaatgggaattccacagcctccctttcgcaggctgcttgtaatagttgccattaaacctcttctgaactctaaagtgctgtatcaatgtaaggaccatcatcaacatcattgtcgtcctcatcgtgagtctttccaaattcacctcctgctgccccagcacgggagtgtctgagactgcaggtttccttgatgggttcctggggcttcccttgtggaaatttgagttctgagccttctgcacttttccatcccccagtctggagtcaacctgtatttttcattttccctctgcaagatgtcagcccataggagaggcctggaggcttgcaggggaaatgggacgatgtttgaaggaagcccccgtgcctgtgggagcatgcagcctcctccgtctttttgtctgccaggcaggggagtaatttgccgttatgtactgggcagtctgggagctggactctcagatgaaaaatgcttgttcaagcacagacagccaggcatggctcaaatcagagcatcgatttagcaagcagctctgctcaaacagccagctgtgtgatcaccttttcaggggatgataggctgacgggcaggtggggtggggtggggtggggtggggtgggcagactaatacagggaccctgtgtttgggagcctctgtttaagcagagaccgggcctggagagagtatccctgggtagggaaaggtgctctcacattagtgggttccacctggccccttggtggagctcccattcattcattcactcattcactcattcattcacatcgtgtctactatgtgccagtctctgtgctaagagagtgatccaagcagaaggtctgaaatcctcagggattcgtttcccagccgacttatgccttactaagtggagcaggttctgggctgcaggggactgacttgctgctgcaggtctgggtcttgaactaagggagaaagacaatgcccatcttcttcttggcgcagtcatttgaggagaggagcatttgcttcttgccaacctgcctgcctgggaggccctcttgctcctgcagccccccgagtcccctttgcagctcccagtcttgcttggggttgcctcctccaagaagcctcctgggctagctcaggcatcctgtggaggcactgctgggccactgatgcctgagctcctgtggcctggctgtctgcagggcttcagtcctggcctttcacttcccagacatgagtcttatctttccacttggttagggcctccccacggacatggacggatatggtttggatttgtgtccccacccaaatctcgtgttgaattgtaatctccagtgttggaggaggagcctggtggggggtgattggatcatgggagcagagttcctcttgctgttctcatgatagtgagtgagttctcacgagatctggttgtttgaaagtgtgaagcacctccccctgctctcccttctgctccagccatgtaggacgtgcctgctgtcccttctgacgtgattgtaggtttcccgaggcctccccagccatgcttcctgtgcagtatgtggaaccgtgagccaattaaacctcttttctttataaattacccagtctcaggtagttctttatagcagtgcgagaactgacagggaccgtgtgtttgggagcctctgtttaagcagagaccgggcctggagagagaatccctggggagggaaagctgctctcacatcagtgggctccacctggcaccttggtggggctcccattcattcattcattcactcactcattcattcacatagtacctagtatatgtgccagtctctgtgctaagagaatgatctaggcagaagacctgcccgctcagggcttctgtttctagctgggagcaacaacagtaaactaaataagcagattatattgtataatatagtaatacttagaaggtgatgagactgtggaaaacaatacattagtgaagagggtgagggtattggatggaagagcgtgagtgtattaggccgttccacattgttataaagaaatacctgagacacggtcattaataaagaaaagagatttaattgtctcacggttcttcaggctgtacaggaagcatggtgctggcatctgctcaacttctaaggtggccttgagaagctacaatcatggcggaaggtgacgggggagcaggcacgtcacatggagaaagcagaagcaagagagagaaaaatgcaaggtgccacacacttttaaacaaccagatcttgtgagaactcactatctcgaggacagaaccaaggggatggtgagaaaccattcatgagaaatccacccacatgatccagtcgtctcccaccaggcctcatccccaactctggggattacaattcaacatgagatttggttgagacatccaagccgtatcagtgagagatgcagtttttttttttcaggggaaagtgttgttgttgttgttgttttaataagatataatttacataccatataccatgaaagtcgccatttaaaaatgtacaattcagttgcttttagtatactggcaaagttgagcaccagtagctactaatttcagaacattttcatcaccccagaaaaaaatctcatagccattagcagtcactcctcaatctcctcgtgccctaggccctggaaaccaataatttactttaggtgtctctggatttgccacttctggacattttatatcaaggaaatcatgcaatatgaggccttttgcatctggcttcctttaccaagcacagtgttttcatgcaccgccaatgctgcgtgtgtatctgtactgcatgcctgtagatggcggaataatattccaatgtatggatagaccacattttgtttatccattcatctgttgatgaacatttgggctgttttcacttttggctattctgaacaatgctgcgaggaacaagttttttttgtacaagcgtgcaagttttttgtggatgtatgttttcatttctcttaggcaaatagagagacacaattttactttttatttattttattttttatttttttagagacaaggtcttgctctgttgcccaggctgaagtgcagtggcgccatcatagctcactgtagcctgcaactctatggattacatgttcctcctgcctcagcctcttgagttgctgggactacaggcataccccatcattcctggataatttttaaatgtttagtagagatgagttctcactagattgcccaaattcgtcttgaactcctgggcttaagtgatcctcccaagttagccttataaagtgctgggattagaggcatgaaccactgcacccagccacagttttaaatagggtggtcagagaaggtctcatgagaaggtgacatctgagcaaagacttgaagaaaataagggcagaagccacacgaaaaccccagcaggacagcaggtgcaagggaacagcaagtgcaaggatgcttccaccaaggggctggaaaatgaaaggcttgacttcaccagctgcctcccaaccagggggcccagtgagtttaggcctcactggccctttctggctgaggggcagcctgctgcgaggggtttccctttctgaataaagagtcaaagtcccaagacagatgatttttgacccatgcatcttcttcctgcctggaaagcagatgtgattcctggagatggggcagctgttctgtggccatgaggttgaaatccatgtgctaaagacagtagagcagaagaagactgggaccttgatggcattcttgagctaccgcctgaaccttggatctcctgcacctgaactttgctctgtgacacaaagaagaccctttcttatctaagccactcttatctaagccaccgcttgtcacgttttatgttgtttgcagccaaatgcattcctcattgatggaatgtccaacattgtccccaagtcccccagatagatccctgggggctcttgacagacagacagcaggcaagcctgggacacacgctgcccccttctgctttcctgtccctccatcgtgttaagctggtctctcaggtgggcatcaggattcagctatcccaggctgaccctgaggtccaccatgactgtgctgcagccaccaccactggccgcttcatggcatgtttccagcacaactctctgacctggctcccccggttccccagacgcgttccccacggagtcccagcgtgtatgcatggggtcacggtgctccacgctctcaaccgttggttgcaggttcccgtccagcctctcaagctggctgctcccctttctcagttgtcccctgtgcctcttgtaccctaacttcagtgttagagcacctttcagggggaatggcgtaaaaaagccttcctttccagtagacagagtgccctggccagcagaggccaaacacattcccattcagctttgtttcatgctggatctggccccaggcctgcacctggccctggcagtgggcgcacgttaggtgggattgctgaagacaatgggtgactgaggcagttacaggtgtcagccccagatgaggctccccaacctgtaccctttaccctggagctggccccatctctcacagcccagtggtgtactaccttaggtaagcaccagttgcgcctcactctaatgaaaataataaaagctcaaatgaccagcactgtcctactgctttatacgcatgacctcaggtaatgagaattagcccacatccattcattccacaaatatttatggagtgcctactgtatgccagggattcttccaggcactggggagacatttaaaaaacaataacaacaacaacaaaaatctgcgtcttgtcggaacttccatatacacttccactggctacttcatggaaacatctggaacatctgatttttctagtcttcccattactaaatgtggcacaagaacgtagtctaaaggatgtacttcaccatgcaaaagctcttgtcatttcagaaaaggaaggagaattaagtaaaatgtacttcaagaaagtcagttaagaatttttccagttaatgaaaatttaaaatgattggctttcatcttgctgttttccagggtcccactattaagaactcactcatcctgttgttattaagggtgaaacccagacatttccttatgtaaaagccaattaaaataaattaaatgcaaatactgtttcattgtcatgtcagttttgagaaccggatcaatcagaggttgtggaaatgccaaagttgttaaggctgtggttaccatgacaacagctctattgtgtaagtggtctgttatttgggaattcttccttaggtcaggctaacagtgatgtcatttctcagggaaggggacggagttctctggagtcaggtctggggccaggagacctggtgagcaaaaactggggttcagccagaactaccagttttgtgaccatgggagacagtcccttccccttttgcctcagtttcctcgctttggggatagccattgcacagctgtgagtatattgtggccattcagcacttctcaaaagttgctgctctgctaaaaaattttggggattcctgatttgccggctggttttcagcctatgttttggggaaatgcaaatgataggaaaccacccctggtcctgccttaccggttctagcagacctttggtgaaactgggagttcttgggtcctcttggctagtggctagtgaatacctgctgggggagggggtgtttgctttgctttgtgttgggggtggggttgttattggtttttacattttgtttgcaatattgggtttgctggtttttgtgttttttttttttttttttttttttgagacagagtctcgctctgtcacccaggctggagtgcagtggcatgatcttggctcactgcaatctccacctcccaggttcaagtgattctcctgcctcagcctcccgagtagctgggattgcaggcctgcaccaccacgcccagcaattttttttttttttttgtatttttagtagagacagggtttctccatgttggccaggctggtgttgaactcctgacctcaagtgatccacccaccttggcctcccaaactgttgggattacaggcgtgagccactgtgcccagccgggttgctgttttagttggtttttgattttagagagagggtctcgctctgtggcccaggctggagcacactggtgccgtcggagcacactggtgccgtcatagctcactgcagccttggccccctgggctcaggcgatcctcccgacatcgtaattacatttttgcagggttttcagttcacaggtgtgctctcccacatccccatttaagtttacttatttttcagccccagcctctgaggctatcattattttacagacgagaacaccgggactcagagggtgatttgtccctagtctcagggctccaaggcggcagtgccagcgttggtgggggtccccagtgccaggccagggtggcactgttctccctgtgcctctctgcttgtccccactgcctgcttctgcagaggcctgctcagagcaggtttccagcaaccttcctcgccagcatcctgctaagcaggccctggagggcggtttccctgcttccccacaccgggccagagctgccttgatatttatttcagggcatccctgcagagggaactgctaatgcagtcatggctttaagacgtcacaagccacagctgcaggtgcttcatcttaaacatctgccttcctggctgggagaagcccgggagcacctgctgcaggtgtctttgcacctcggtcctgctggtcccaggcccagctgcggccaattagcacctctgttgggcaccatggccatttccttgctgcatgggagccgctggcctttttccactgtgttgggggaaagttgttgggaaatgaggaagcagttggggatttaaaaactctatgcaggaaataggctgttgggttaacatttaagccactgaacagtcatggagtgtttgcttggaagtgaggcccacgaggctgcagagggccatgagattcaaggatggtgttcgtcaggcctgtccgtcatcctctctgggttcgacaccatctcagggtactcatgcctgttaggtgcttggtgaacaaaggcatcccagacagaatcaacccagaaggaagaggggtgggtggtaaacgttcgttaacttagccatgttctcttagggtttcttctcaaaataagggcagatgggagatctccctgcctcaaggggtccctggccaaggggctacaggcagatattgcccagtcagccccagtgaggtgacagaaggcgggaggtggcttcagtgtgtttgaaggaggctggcatcacaggttctaaagcagatggcaggagccctgtggctgggcctgcttcagaaccttggctggctgctccttggaggtgaggtgggggcaggcagtgttggctggagacttgtggggggaattggccgcctggggtgcgtgctggcctgcctgccttccgcttccgtgccatgagccccttgttctcagctgtgaaggtaggtgaggctgccctgcaccagccagcagactgggttaaggtgggaatcaaaggagaggaggtgttcagctggctggagacctgctgagccccttgcatgaggagggatttctgtccagcgcccctggtcctcaagctcctcctcagcagcgttcatgagcacagggtgtgggtgtgactggtccctttgggcagaatctgagagtgcccccttctccctccctgtgcatttgaaagttggctggtgctcgctgacagatgccgaggctcccgtttggcagctggccatggcagccgcttgtcctccactctccctagatttggctgagctgggcccctgctgtgccccacatgccccggctctttgtctcggttgtccctttggctcagctctgggtgtcggctcctcggaagcccttcgtcacccaaccagagtgaactccttctcccaggtggccagagcatgttgaagtgaccctgactttcttctgtgggtcctacattttagcggggagtacaagtgcctcttcactgcagcatctcctaaggaagtgagcctgtggggaggtctctgatgctactgggaatccagcttcaccttcccccaactcctgggatttgcagccacagctaagagtgggagaactttgccttgtttgcattgctccagatcgtgttaaacagaatttcaaaacatgcattttgtaggtagtagttctgtcatccagaatgtgtaaagtaactctctaggtagctgttatggatggcctgcaggaaggatcataccagtgacttcttttgagccccctgccgagtggctagcgtcaggtgggggattagactctggttctttgcttcctggccctgtgagccccaggcaagtcagttaacttcttggagcctcagtttcctgacatgcaaatcatactgacctggtaaggctattgtcaggattatatgagctattatatcctaaagtatattatatcatactttatagagcgtagtatatattcaactaactgcatttgtgttagttcctttattttgttaacatggggatcaatggctttttttttctgatttggtatttattttaagactaggttgggaaccaattttccatagtcatctgtgggtataagtactcttaccttcagccaggacttaattttggccaagagccttggcttattccagcagagagtggagttatttagagccaaactgtaggggactgaattctctgtgtagcactttctgcagacagtggtaacattaatgacttactgcatatacattcataagtgggtgatttatggttagccccggatccataactttcatttcctgactgatatatcagaagcttcatgtataaaggcgcattagatttagtaagtgtaaaagacttaagttgaggtcatttctgtccacaagctgttcatggtgtagctgttcatgtagctcagctgtgggaatggcctggccctatgtgatgcggaaagacagccaagggggacagtggcacatgcctgtggcacttggttctgtgtgtggtctcctttgtatccccaggaactctctgcaataggaaggtgatggccaggatctcattttacagaggaggacactgaggcccagagaggttaagtgacttgtctgagggttaacagctcctgggtggcaggatttacattggcgctcagatgcatctgaaccccaacctggagtggtgccagcacagagcaggtgttcagtaatgtttgctgacctatgtgatggttaatatcatgcgtcagcctgactgagccaagggatgcccaggtagctggtaaagcataatttcaagttgtgtctgggagggagtttctggaagagactggcacactgagtaaggatctgccctcaccagtgtgggtggatatcatccaatcattgagaacccagctagaacaaaaatgtagagaaagagtgaatgtgctctctctgcttgagctgggacacccaccttctgctgctcttggacatggagctcccggttctcaggcctctgggcttgagctggagtgactccaccggctctcctgagtctccagcttgcagacagtaggtcttgcgactcttcagcctccataataacatgaaccaattcctcataatacatttctgtctgtttatttctatatatttattggctctgtttctctgaagaaccctgactaatacttccccatctgaactttctctgccccttttgttcgacatgtggggggttgctggggaagctaattagaatacaggttcctgctgacaccccacccccactcccttccttcatcaagatcactagtggtgagcctttaaatgcctgtaagctgtccgaggggttcttcctaaattaaattaaatttttaattttaattacttaatttttttgagatgggatcttgccgtgttgcccaggctagtctccaactcctgggttcaagtgtcctcctgcctcggcctcccaaagtgctaggattacagatgtgagccgccactgttggtctctaggggttcttatgcacctagaatttagagactcattgctccaagcttcattgaatctttcctgaacagtcttgtgataggcgggataactcccacccctcagatgctcacatccgaatccctgggacctgcggatatgttgccttatacggtaaagggctttgctatgtgatgaagattgaggaccttgaggtggggacagtatcctggattaccagggtgtagtcactgtattcatgtaagtccataaaagtaaggaacctgtcccagctgcagtgagcccgagggaggtgtgactctggaagaagacgcagagatgaaacactgctggctctgctgacaggaatggctttgagccagagtgtggtggcctacagaggctggaaaaggcaagggaacagatccacccttaggtcccccagaggaaccagccctactgacacagtctccgtgggacctgtgtccacagacagaactgtatgaaaacacgattgtggtgtgtaagccactaggttgatttgttacagcagtgacaccgggctttgtctctgcttttgacttttcctccagtgtgatcccttcccctgcttctgacccgtggatcccagccctgcccaggcccagatcctgggctccaggtgggcctgggttggggctcccagctgcaggaatgcaaagttcatggttctacaaagtgctttgaggtgacgttggtcacatcagctcggcctcagatttgctgctttttttctaaagaagagacagctccaggccctgcctgactgacctagttggggatgcaggccgaggccatatcgagcagggtaagtttccaagaatctggctttaggattagtcgggccacacggaaggagttcctggtctcgtgacacctgcacaaatggtcttcaaccctcaaaacacttcctgttatttaaatcttggtcctttgattttttttttttttccttttagagactatgcacaatttatgtggcaagctagagatgctttctttttcagagcggcctttatgctgtgttcggggctgtctgtcggcgccacagggaatgggggctggtgagtcgtgctcagaaggtcccagtctagatgcttctgacatggacaaaaggagaattcctgactttttggtggatgtttgcaattcccagaatgcttattcttatttagtcctcataggagagtggcgaagggcagcagctttggagcaagggccaccctgcccctccccaccaagccctgagtcgtctaaccttcccggtgtattagtcagctctggctgctggaaacggggtcatagtctgggtgccttaaacaacaggaattcttttttttttacagtattggaggctgatgtctgagacagggtggcggcagggttggtgtcacccgaggcctctctcctcggctccgtgtagccctttctccctctgttctcacacggccatccctccgagtgtgtctgagtcccagtctccttgtgaggacaccagccctagatcaggagccacgcagtgacctcattttaccttcatgacctcttcaaagtccctgtgtccaaatacagtcacatctggaggtagtaaggattggggcttccacataggggttttgtgggggacacactcagtccacgttaactcacttcctgcccacggcaggggctctctgtcagtgtgtctccgactgcggaccccgatcatctttgtgagaatgcaggttcccaggcccacaccgtgctggttgagtcagagcttctgggtgcagcctgggggtgcagcaagcccacccctgcattcggagagccttagcgggaagcctgttgcttgtgcctcctttgcagccccggcctctccagttctctgtgtcttgccatcttggcttcttcctcatcccgcctctcgctccatctcgtggcctcccatctgctctcccggctgcaggagcggtttctctaagccttgcaagtgaccgcaccctcttactgcatgcgggccttgccaagagcctgcagagggcggggcgggctctggggacagcctggactctcctgcctgcccccaggtgcccccggcccagccacagggtgctggctgcctgttactcagcacgtccgcctctcctgcctcctgagcccacaggcgcccttcctgtcacccgagcgccctctccttcctcacctcgccacctacgcatcgtcacccctcctcctgcgtttcctcctgtctccccggggagctcggagttctgcaggcacggggctggctcctttcttcatgtcccttgtcccacaggacaccgtttctgaacccaggagacactcaggaaaccttgctggtggaacggatgcagcagcgaggttttccggggcaggaacaccctcccaggagcttttccacggccaagcgctggctggtggtggagctgcgctgaagtcagtgtgtgctttgggcccagctgcactgtgcccggggtccagggatgggtgtgaggctgtctgccccccactgcacgcccggctgtcagaggcatctgtctcttcccccgcatgcatctttctccccgtctggcatggtgtttctagtcttttgtggatggggacataaacaagccgccatcaactgcttggtgacattggccaatcctgtggtggccccagctgggcttgctgcctgtgtgtggtgagggtgcccttcttgtcacccgttgtcatttacgagacagccctgtgtcacctgttgattcagagggagctctcctcatcacctgttgtcatttatgagccccgtgtcacctgttgttgcttcacagggagcactccttgtcacctattgtcatttatgagccccgtgtcacctgttgttgcttcacagggagcactccttgtcacccattgtcatttatgagccctgtgtcacttgttgcttcagagggagcgctccttgtcacccgttgtcaggtgtactcactttgcttctcccttcctgcttttggggacgatcacaggacagtggcttcagaggggaagtacctcgacctggctgaggtcatgcccagagcctgactgctctctccacccacccatgatcccgtcagcttcttccccctccttctccatctgatctgagcatttaccatttccttccatttaagcttcatttgagttgcatcatgatgttctccttttttcaaagttccatctgcccacaggtttccattttctctagaaccctcctccttcctctctagcccctggcccgcccctctgcggttctcaggaagcccctcggtgccccctgccccttatctagaacagcttctgcctagggtgggcaaggcagggtgggaggtggggggtagccgtgcagggaaggggtgaagcgggcccctgtactccctagctgggctgcaggcttggaggaaaataagagtcagacgcttgttaaaacagtgaggacagctttattcgaggaaaatgcagtcggggttgaccttatcagcaggggagagatcagcccaactcctaatacagcaaggaagggacagagctgggaagtggagtgggctgggtgagtggaaagtagctgcgagaagacatcacaggtagggggattcttgccaaaggcagggggggactttgatgtcaaaggtggggatgaggactgattggatctcaagggtggtcagatgtgaagggcgtgagaggctcactaaactgactaagcaggattcttgctgagactgggccaggcaggctgaagacaggaggcagaaagagggctcagaggagcctgagtgaagtttgatcttggggtgaggggtgcaggggggaggggcagggtgggtctttgttggggctctgtgggagatttcagggctcactggatgtgtggggcacagtgggccctgcctgagccccatgacgcctggacgctgccaccaggggcctgacctgctgacgatctctgcactgggtctttaatcagcctcttgggcattgtaaatgctagacaaagattcttctctttttaaagtttactaatttccctacgataaaactaatgcattttcacaggagagactcgggaaattaccaaggagcgtgaatcaggtggtcacagtgaattgtggatgtttgtgtctgtcttggggaactggtgtaacgtttctccatctgacccctgctgtctgttggaggtcaaggagccagcctggcctcacaacttcctcctttcagcaaagtcaggaggccattccctccagggatgggtgggctgcagcctcttggcacctctcgggatcctgctggcagatgtatcaccgtagcccaagccagcctaagccagcctcctgtggcccagcaccttctcttcccacgtgggcagctgtgttcccaggcaaaccttcctggaattgctctgtgctctcagagctggtgtgctttggtgttcagctgtggccattttggctttgagtttgatttgatttttgaagaaagtttttatttctttacccaaatattctatgtctctttggtaagactggaaaacacagaaaaacagagaaaaaaattcccccataactaccctgcccacctccatataacttttattagcattctgagctatacccctccagactcatttctgcctctccagaagtgtgcataaagtctagaaacataggtgaagagacctaatgccatcaagaacatcaacctgtaaaggaataaaataatgtcatctgtgtccagattttacagatgctttgtagatatgtgtaacagaaatgtgggtatgttttagcaaaaataagaccatatttttgttttattttgattgattgtactataaattccagtagagcattacagagccagcccaagcccatctctcctcttctctactcttttctttccccagtgaccaatagccactctgcggagggaagtagggatcatatttgtgcgcgttttacgctcttgctacacatgtgcgtaaccttaaacaaaacattagtttttatgtgttagaaatactcataaatggtggcccaggcatggtggctcacgcctgtaatcccagctcttcgggaggctgaggcaggaggaggcttgaggcctggaattcaagaccagcctgggcaacatagcaagaccctgttttgttttgttttgttttttaaacaaacaaaaaaaccaacaacagttaggtgggtgcagcatcatgtacctgtagtcccagctcttcaggaggctgaggtgggaggctctcctgagcccaggagtttggggtgatagtgagctgtggtcacaccactgtactccagcctggatgatggagtggagtgagaccttgtctttaaaaaaaaagaaaagaaaacagaaagaaatactcataaatggtatatatatatatcactttgtaatttgttcttgactactttgtcaacaatttttaagctgtatccatgttgatacatagatgtggttcatggtcttcttttttctcctttttgttaactgctgtatacaattccattgacttttttttgaggcagggtctcgctctgttacccaggctggagtgcagtggcacgatctcggctcattgcaacttccacctcccaggctcaagcaatcttcccacctcagcctcccaagtagctaggactacaggtacatgcctggctaatttttgtattttttatagagtcagggttttgccaagttgcccagcctggtcttgaactcctgagcgcaagtgagccacctgccttggcctcccaaattgctgggattacaggcgtgagccactgtgccagcccccattgtctaaataagccatcgtttctctagtcatatacagttaggtcacttccattttttcattagtataaagagtgccatatgaatattgatcctccttgagtgctgtggaaggaagcctctaagatgccgccactggtccccacatcctggtcttcacacccttgtgtaatcccttccctcgggtgttggctggacttaactgacttgattctaacaaatagaacacagcaggaggaatgggacatcacttctgacatcaggttataaaaagactgcagctgccagcttgggtgttctctgttgccctcttggattgccagccctggagggagccagatgccatgtctcaaggcagtcctgtggagaggcaggcctaggtgacaagggaccaaggcctgccaacagccatgtgagtgagcttggaagcagatctccatccgctccccactcccagctgagccttcggatgagactgctgccctgaaaacagcaaaggggaacctcatgagagaccttgagccagattcccagcccagagaaattgtgagataatgtttgttgttttcggctgctgacttttggagggtcatttgttacacggtaacagataaccaatacgagcacaccctgagaattccttagaggtctagaatatttagcagtggaattgccaggtgctatggtattctcacgctcaacagtactgtttattactaaattcatctccaaggcatttgtggcagtttcactcccctctacaagggtcagtgagctccttttcctcatacctctccggcacttgtgttgtcagactttaacatctgaacactctgatgggtgtaaaatagtatctcatgattatttgaatttgtacttccctaagttctagtgaagttggacatattttcgatacattattgtcctttctgctttcctctgctgtaaattaattgcatgttcgtatcctctgctgtaaattaattgcatgttcatatcctctgctgtaaattaattgcatgttcgtatcctctggtgtaaattaattgcatgttcatatcctctgctgtaaattaattgcatgtgcgtatcctctgctgtaaattaattgcatgtgcgtatcttctgctgtaaattaattgcatgttcgtatcctctgctgtaaattaattgcatgttcgtatcctctgctgtaaattaattgcatgtgcgtatcctctgctgtaaattaattgcatgtgcgtatcctctgctgtaaattaattgcatgttcatatcctttgtccagtctccttttgggtggattatctttttcttagtgatttgtagattttctttttttcactctagagactaatcctttgtcagttcatgctattttatactctgcttttttcagttagcagcgtattgagaatgttcttctatgccaatgtatacatcattttattgacattccattgtggagatgggtcatttatttatttaggtggacgtgtaggttgtttgcacttttgcattagtaggaacatgactgtgtgtcggtcagctgggctatgctctggtactaatgaccctccaaatcttagtggtttgcagcaatgaagaattctttgtccctcaagtgacatgaccatcacctgttggttgtggctctgctctatgacgttgtccctcagggagccaggctttcagagcagccccatctgagacattgctggtctcatggcagagggaaaaaagatggtggaacaacataattctatttctgtttttcctctttagagacaggatattgctgtggcacccaggctgcagtgctctggtgctatcatagctcactgcagccccggaatcatgggcacaagtggtcctcctgcctcagcttcccaagtagctgagactataggtatgcaccaccacacctgggtaatttttactttttatatttttcgtagagatgggggccttgttatgttgcccaggctggtcttgaactcctggcctcaagtgttcttcccaccgcagcctcccaaagtgctgggattacaggtgtgagccactggacccggcaggaacaatatacctcttaaagcttctgctcagacgtgggaatggctatgtggtgcgtgtcagttcccctcacattgcattggctgaagcaaaccctggggcccaaccagtgttggcggggttagaagtagacccctcccatagggaggccagggagggaggattttgagccaagaccactcaccacgtgctgtgatgagcagttgcctccccctcctttcgtgtcttcgtgcctcctcacgtattcttacaagtagaattgctacattaggaatatgcatatttgtaaagtatttactatttattatgtcagctaggttttaactgtcactgcatttgctgtgaattataggtaattattcatcctgatgaccatttaaaaaagaagaacaatattattaggtagaaatagtccctggctccccggttgcccaccgtgactataacagcatatctagcttggtagttttcaaattatttccacgttttatttacttctcacagcctccctgtggggttgcaggtgcttctccactcctccactgacaaggtgcctgaggctcagagaggctgagaaatgtgctctgggctgcacagctggggatgaggcgtagaccctggccctgctctgttctgggctctttctcctccactctggcctttggaggctgtggctaagatcttcccccagccccttccttcccaccttcccttcctgctcttgtgccccgtttttcacagtcctcagtggctggtttctcagtcccccaggaggtgcaggctggttcttaggaatggtctctgtcaatgttcccggcagtacctccgagcctgccctctgaggatgggtcggccatggctgcgccggcttagtctgtatttaggtatcactgactatcactggacttggggaggggatttactatttttagagaaagtcaggggagctccataaatcctgttagtcaacagaactgcagagaggtggctgtttatgaaggagagtgacttttttagaagtggcgcatttagaagaccacatattctatcattctgtgtacatgagcggtgcagaataggcaattctaaagagacagaaaatagattcgtgattgcagggagtggggaggagggatgggaagcgactcctaaggggcacggggtttcttctgggggtaatgaaaagcgttctggaattagatagtggtggtggctgtaggacctggtgaataataaactgaaaatcactgaatcgtaccccttaaaaacacacaaagcaaattgacaaattattgggaggcaacataagagaatggggtgtgaactttggatcagtgcggcctggatatcagctgtgtggtgttcaaatagattgcataacctcgttgagtctcagtcttcccatctgtgaagtagggatcattcctacttcgtagggttggcatgagactccgtgagatgaagttggtgggtcacttggctggggcaggtgtcacggagcgggacctgtgattgttcagccacctactctgtgcccagtgctgtgttggtgaccaggtatgtatgaagtcagtaagccacagtcctgagttatggtgcagaccccacatgcacccagagtcagcttggcaagaccccttgacaccacgtgcgtggagggtgcaggtcggagagctcacctccatggattccgtagagctttgaggcgtatccacaaagtgtccaggagaggtggcgtcgcctccacttgatagaggaaaaagcagagatggaggcagccagaagcatggtgcagtggtggggtttggtcattaatttgataatcacatggaatacaagctaatgtttattgagtacttactgcctgcctgctactgtaactaagtgctttactcctgttatctcatttaattctcaaagcagccctgtggcactgaggtggctggagatggagggatgtgtggctgccatgtgtttgccaggaagcagcaggatgggagtgagggcacagacagacacacatgccaggacttgtttgcacgaagctgaggaatgggtgcccatcattcattatactcatctctctgttttatgtatatttgaaaaaaaaattttttttgagatagggtctcgctgtgtcacccagactggagggcagtggcatgatctcggctcactgcaacctccacctcccgggttcaagtgattctcctgcctcagcctctggagtagctgggattacaggtgggcgccaccatgcccacctaatttttttttttttttgagacctgtcacccaggctggagtgcagtggtgcgatctcggctcactgcaacctccgcctcccgggtttaagcaattctctgcctcagcctccccagtagctgggattacaggcacatgccaccatgcccggctaatttttgtatttttagtagagacgggatttcatgcctgattaatttttttgtatttttagtagagacagagtttcactatgttggccaggctggtcttcaactcctgacctcaagtcatctgcctgccttggcctcccaaagtgttgggattacaggcgtgagccaccgcgcccagccatatttgaactcttttacagtaaaaagtttaaaaaacaacaatcctatgaggtaggtcctcttatttgtgctttacagatggggaaattgaggctcagagcatgtaagattacacagcaagattcggagatagctcgccatgttcatgcccggcaggacgtagcaacagggctggcgaaacggaggccccaggcttgtgggcctcctggggttcctgtgcgttgaggcctgagcccctgcgtgcgcccagcggagccagcactctccctgtggtcctactgggcatcacaggtgtgtatgtgaggggtatggggaggggattcttggttagtctgggcttcatgacattgggatgagttctttcacttggttttgttgatctggtaaaatctgtggtcctgtgatatcaccttgcttctcatagtatgagccttcaacatttggcctcagtggtggggtgtgcctgcaccgccttcccccatccctgcctcggctcctccccacaacaaagcggaaggaagacatagacccaagggtgcacttcagcccctcaaccagctgtgtggctttggagaagcggcttaacatctctgatcccagttacctttcttgaacgggaaagatatcaatgcttccttcactgattactggagcttcttggtgtgcagtgtctaggctgctttctaaccatgtaaggtgtagccacagtattgtaggacctgttgctaagaactgtgccactatcttgataaacatgttttccagggactggtggtggaatgttctagttattaatgtgcctttaacgttggatgactcagaatatccctcagatagtaggaataggtagctttgagaggtcatctgtaggagggcgcaggaacatcccaggagggggtgtcatacctgttggcaccatggggatgcaggctcagaggggactgaactttccagggccacgcagtctgtaagcggcagagctgggacgcaaccccaagcttgctgctctcaaagctttgctttcaaactctcacttcagacatcagggcttcctttcagactgagtcttatccctaagcactgttggagaagaaagtctccaggctgcagggccccgcagttcccccatatccctgcccttccagccagcccacgcctggggcctgtcctcccctgttcctgaatccctgtcctgttactgccctccgggtaagacagcactcttataatcatgcttcatgccgagttcatgaaattaactctcaaactcctcttctctgggttaaattatttcacttttttcccttcctcatagaatatcattataaattctagatactatattggatatgtaataaaatcagaataaattacatgtgatggccactgaactaacctcccttcatgtgtctggaggcaggttttctgtggagttatgctttaaattggctgtccttcgcgatttttcttaaagcctaggttgactactcaagggtctagatttatgatagaaactgtgggctggggtgcagtgctggggtgctggggtgcctgtaatcctagcactttgggaggctgaggtgggcggatcatttgagcccaggagtacaaaaccatcctgggcaacacggtgaaaccccatctctacaaaaaaatacaaaaattagccagacacggtggtgcatgcctgtactcgggagactgaagcgggaggatcacctgagcccaggaagtcgaggctgcagtgagtcatgattgcgccactgcactccagcctgggcaacagagcaagaccttatcttaaaagcaacaacaacaacaacaaattgtggcacaaatgtatgcatggaggtactgagggccttctttatagtaggctcaggaatgaccaatgggtgggggctttgggggaagagacgggggtctttaagcagaaactctcccctcaacacaagaaagctgctgaaggacttcagaaacctaaacacgagccgtgggcctttctaaagtggggagggattccctcctgcctaggttatgttgcaaggctgcccgagagagggtggaagggggcaggagagtgggcattggctgggtccaacgcttcccaagagatgtgactgtcttaaaagcaataccttcctgattaccacgggaaaaattcaaatgttttgaaaagatctacaagtttggggttgaagaagtcctttatttcaaagtttctctgggctgggcgtgctggctcacacgtgtaatcccagcactttaggaggctaaagtgggaggatcacttgaggattgctttgaggccagcctgggcaacatagtgagactctgtctctagataaagttttttttttttttttaaattagccagatgtggtggtggtgtgctcctgtagtcccagctacttgggaggctaagttggaaggatgacttgagcccaggaggttgaggctacagtgagctctgattgtgccgctgtgctccagcctggtgacagagtggaccttgtctgtaaaaataataataataataataaagctttgctccccgtttcatttagatggagcgtttgtgggatttaagacagatttttccttgctgagtggttatcattaacctgttgaataagcaacaggccgaggtggggaccctgcctcgcccgcctccaggggcacactgcattctttgtggaagtgtccctggaatgccacagccctgcttctgtgcgaggccagtcagtctgggtcctgggatatagccacatgtgcagtccgtgcctccagcgcgcagcctgaaagggaggcgtgcagaaacaacgtagctccaaggaggactgatcagcccagcctgggggagggtgggaggggactcccagggagcggggcttgtgctggactttgcaggatgccagacttttggcaggggaggaaattgaggtgaaagcattccaggcctagggaacagcatgtgcagaggtgctggctggaggaaccccgtgtgtttgcactgtgctctgagctccctctcatgactctcattctttctcgttgagttttgttttgtcacccagccggactcctgggcaaagagaggcacaatctgttcccggttgggccagctgccctccagtagctacgcaggatgctctggccggcctctgaggattctcttcttctgtccatctcatggctgaagaccaaggctatggcctgtgggtggcagttggtacctctccccgctgccttcccccggcccctttttggacaggatgttgctccctggggcctggctttggagatggccagtgctggtttgaagcttctgtcttctgtgtgggatatcagtgccctgccagctgttgcaagttttaaactcaatgtgcctctggatgtgtgtgtagagtaggggtccttccccagctccaggccctgtgtgtttccaagtgggcccgcagctctgatgtgcagtgggtatgcactggcaagccgtgcactgtcacaatattaaaataacttccatggtagttggtaaatagccccatcacccctctcctgggaccctggacctctagcacaccatggaggcctgccccgtccccataaaacacaccacattcaaattacttatctcctcttcccctgccactctgctgagaaggctgatctcaatcctcggagtaatgactctcttctaggagcaagatgatgctaattctcactagcatgtgaaggactgatagcaccatatctccctccaggactcccgggtgggaggtgggtgtttgcataggcaggcaggtgagccagcctagtttgtccacagacttccatgcaagtgattcctgctgttccctgggtcttcctttcttttgcttctgaacttggaggtttcttgaagtctggaggatttttagggtgggcatggctttaggtgggacctccactatatgggtttgcaagctgccactgctttgactgcagacactggattgaccgtggccaatgccaagtccaagagatcaggctgaaaccaggctaaattttaagagcagaaacaaaactcatccttgcgaagggacttttagatcagtggcagatggcatagaaagtctttctgctgttctcttgtgctgggcgtggctcagggctgaggggagagaggagagatgagggcagaaagagaagagggggcaggcctcagggatgaacacatggcccatggctgtgcgcttcccaagcaagcagttctggagtgaggcttgggcctccatgcctcctgggaggctgcacctcttgggatatagagaacgctggcttcagacccggcaggagtaccggcggctgtgtggtgcatcctgcacagagctgttgctttctaactgggttactgagctgtcgaaggagcagggatgaagactcccttattaaaaactaaacaaaacacaacacgaaaaagccagaacaaaacaagcagacggttgaggactgcagtgaactcattaaccctacagctttgatctcgaagtctcggccgctcctggctcagaggaccctggggacgtggtctttgatgcttgctttccccataggcatcacttcgaccagcgtctgtgtggggtgtgcagcagccctgagccaaggattaattacgtaacaagcccagatcccatccctgcctgagcaggccatgtgccagcaaggggggccccgaagtgccgctaggtgcctcacgattagcataaggcccgtttatccaggaagccagaaccagtgcacatctgttaagcgcatgcaccaagcggcgattccatagttgtatagtgattgtctttatggaactccagaatagcttcttagatatcactcttcaggccctgaaatggagccctgtgcaaagaaatgaagaaaagctatcggggcatctgcagccactattataccatctggcagctcagaaatattttataatcaaatgagtaagacgggcgtcccacactccacagtactctgctcccccttcccttcctcccaggacttgctctgtctctgtctctttctctgtgtctgtctgtctgtctctatgtgtctgtttctctctccctctttctgtgtgtgtctctctctgtgcctgactttctgtctctttctgcttctctctctgtgtctgtctctgtctctctctttctgtgtgtgtctctctctgtgcctttcagtctctttctgcctctctctatgtgtccgtttctctttctctctgtgtgtctctctctctgtgcctttcagtctctttctgcctctctctatgtgtccatctctctctctttttctgtgtgtctctctctctgtgcctttcagtctctttctgcctctctctatgtgtctgtttctctctctctctctttctgtctctctctgtgcctgtcttgcagtctctttctgcctctctctgtgtgtctgtctctgtctctgtatgtgtctgtctctgtttctgtctgtcttgctctctctgtttcaatctctctatctctgtgcctgcctgtctgtctgtctctttctttctgtctctctgtgtgtgtctctctctccgtctttgggacagactagaggaacctttttcccaggagtgataatactgtactctgcgtttttgccacttgctagctgggtgaccttgggcggctttcaagttcccttatcctgggtttcttcatttgtaaaatggaagcactacttcacagtgctgttgtgtgggtcaagatgagatgaatgtgacctactgtggtactatttattatttgtcctagaaaaacttttttttttttttgagacagggtcttgctgtcacccaggctggagtggtggcacaatcttggcctactgcaaccttgacttcccaggcccaagcgattctcccacctcagcctcccaagaagctgggactacaggtgtgagccaccacacccagctaatttttgtattttttgtagagacagggtcttgctatgctgcctgggctggtctcgaactcttgggcttaagcgatcctctcacttcagcctcccaaagtgctaggattataggcataagccactgcacccatccagaaaaacttttaaaaattttgtgttttaactttttctgaatataaaagtgatacatgcatgttcactgtaaaatagaaaatataaagaaactagaaaactatttatgacgcccctcccccaccacaaaaggggcaaggactgcgaacttttgccgtattttggaagatttcctaagtcacacaagcacacagatggtctgttgatccaaaccaggaagaacaattgtgggaataagtggaagtgtgagtgtgtgggtgtgtctgagtgtgtgccctgggggtgtgtgtgtctgtgtatgtgtgagagagccaggctgtgtgtgtgtgtgtatgcatgcaaacacttatgtgcaatgccttggggtcctcagaccccccttggtccatcaggggctggtggcctcccagtaggacactagcacagctgcactcatgtccttctttgagggggggtgacggggagaaagttggggagcagcagtgactgctgatgttgtgggggccatggggagcctcctggtattctgtctcgaggctctggggatatggtgggagaagccctcatgccagaattgggaggggatggaatgggactgaccccatcacagcccacgtgcctcattcagggcttggctgtggagtcttgggggaggtgctccctcatcctcaaatgttaactttgtctgcctggccccagtcccctctgtggcttttttcctctttcaattgggaggcagttctgtcttaaagagatgtttaaccctctaggtctccgtgcaggcatttttgttgtgagccagtcaggctataaatggtccattaaaagcactgtccagttgacataaccggtctaccaggctgagacccacagacccgggactggcatttatttatggatatgatgtgcaaggagagtgttttccagtagcaggcgttggcatcatcaaacagaatgaagtgtactgtgttttcaccatgatagtacaaaaacgagactgtgagagcttctcacttctctccccttcctccccttccttctccatgtctttgtgctcctccactgctccctccccagcacagacaggccctggctccctccccccaccctcttccttctctctccttctaactggggtcaggaccaccctggaggatgttagattttaaacatttgttcctcttgtcatccccaccaccccacccacccacccagattagtttctaagggatttatatttgtttgcagagtggtgcgaactgttttcatcctcagaggagcagagtgctcatagatgagtttgacattactgggattcactttcagaagtctctagagagccccgcaccgcccccgccccccgcaggtgctggagttcagcctgacacacaggccggcctcagtgagagggagtgtctgcctccctggcatccgtgacccatacggtgggcgcctgttctttagaacaacttgctccttccgtcgttggcttggtcacccagcccccggcccacccttttctgagcctgtcatccacaccaggcagagccctgtctcagagtctcatggggagcagggccttcagggaaggcccatgtgctgggactgacttggctcacaggaatttcctgatggtataaaatgtgccccccagcgcctgataatggtcacttcgcctaagttccagccccagatgtggaccacggtggggcaaaggtgggcgtggggaggaggaaagaggtttaaaatggccacacccactacttctcctttggaagtgcctcctgccaccctggggtcccaggagctgatctgtgggtgtctgtcctcagcacccaccctgcttttccttcaggccccgctctggctgtctgggcctttctggtgctgttcctcacaggtttaaacactccagcagcagcctttcccatggcactgtgtctgcggggcggggttgggcattttctgaggcttcctgtgtttcacggggatccagtatgaagcctggcacggagtatgggccaaatcggtttaatgtttagctccccaaacccttcacttctgtgtcctcattaattcagacaaggttgggtttagcaaactgtgtctcaaacataagaaaatgcagcgtgggaatgggggaggggaggagtgctgtagaaggaccatttcagaagccctggtttacaggagaaagattggtatcttcataagtcactcttaagcttgcatttgttcatgctttaacacagtgattagatacctactgtaagcctagcatggtggggatataaaagcaagatcaagttcaagggggcagggatttagggtcagtgagacggacctcttaatcacttattttgtacacatcagagcagtgacattgtgtttctttaaaaatactaggggccagcccgggcacagtggctcatgcctgtaatcccagcactttgggaggccaaggtgggcagttcacctaagatcaggagttcaagaccagcctgccaacatggtgaaacctcatctctactaaaaatacaaaaattagctgggcatggtggtacacacctgtaatcccagctactcgggaggctgaggcaggagaatcacttgaactcaagaggcggaggttgcagtgagccgagatcgctccactgcactccagcctgcacgacagagcaagactccatctcaaaaaacaaaaaacaacaacagaaaaaactctgggccagctgtggtggttcacacctgtaatcccagtgctttgggagaccaaggtggggggatcgcttgagcccaggagtatttgcccagcctgggtagcatagcaagatcctgtctctacaaaaaaaaaaaaatatatatatatataaattagccaggcagggtgatgtgcatctacagtcccagctacttgggaggctgaggtgggaagatcacttgagcccaggagtctgaggctgcaatgggctctgatcccaccactgcactccagcctgagcgacagagtgagactctgtctcaagaaacaaaacaaaactctggattctggccttctcctgggaaatccagatttgtctggtatgatgttcgttgaacccatttagtccagcagcctggctttccaaaagtatgtctgcctctcacggtgcccagtagctttaaccaaagagctcaggaaagggcctgtctgaattcaatcacattcagcatctatttcagcgttttactagctttcaattaaagtagccacgcatttgagcctgatggtcttattgttttatgttgttccttttgcacatttcctgcttgtttatctttgtggcacaggggcatgttcttggctgcagttaacaatgctggccacggcagtgcagcgtttccaaatttcttccctttattaacaggcggtaatggaatctgaatcttcaaaaataaattttacatacttgttctctaccataaaagtcatccatacttattagaacgtctcaaacatactaagaggtaagaaggagacaaaaaataatattttgtcacccctgcccaggtagccactcttctatttgagtgcttgtaagaagcctgcttttccagtattatctgacctggcagggagttgggtaattgaaaaagattattaaagaggggatcataaaaatgatatagacgccgggcacggtggctcacacctgtaatcgcagcactttgggaggctgaggcgggtggatcatgaggtcaggagagaccatcctggctaacacggtgaaaccctgtctctactaaatatacaaaaaattagctgggcgtggtggcgggcacctgtagtcccagctactcaggaggctgaggcaggagaatggcgtgaacctgggaggcggagcttgcagtgatccgagatcatgccactgcactccagcctgggtgacagagcaagactctgtctcaaaaaaaaaaaaaaaaaaaaaaaaaaaaaaaaaaaaagatatagacatattgagcatttcgttttgacataaaacgtttcattttcatataaaaatgcatttattccccatctcttgatacagggccaagacctctcttggattatgggtccactggcttctgtcctgatatgtcttttttgcactatccacactgttaatgcattttctgagattctcagtttctgtttctgtcaagtaatgtaggaactagcaccaaatccttgccgatttcatataccactgatattatacagttattttgttcatgcctaattgaacagccatcttcccccaaacattcaactctgtttcataaaaccaactccttttaattcctcttctgagggtttgcataaaatttaattaactttggtaattacataagtactactggtataagcaggtttggaaacaaacgtaactgagtcttggtgggctcagagtgcacctgcccgaaggttcccacatgctctatgcacccagaaggggacagagcatgccccatagtccaggggcaattaggggaagcagctaatgaagtctgctttcttctggccttttaaaaatctatgtccttttttttttttttttttgaggcagggtcttgctctgttgcccaggctggagtgcagtggcatgatcatggcttactgcttcttgggctcaagcaatccccccacctcagcctcctgagtaggtgggactattaggtgcatgccaccatgcctggctaatttttgtattttttgtagagacaggatctcaccatattgccttggctggtctcgaactcctgggctcaagcgatccatctgcctcagcctcccaagtgctagtaagccaccacacccagccaaaatttaaaacacctgtgcctcaaagaataccgtcaagaaagtgaagagacagctcacagaataggagaaaatatttgcgaattgtatagattctagacttgcatctagaatatataaagaactcttacaactcaataatacaagacaacccagttaaaaaatgggcaagggacttgaatagacgtttctccaaagatatacaagtggccaagaagcacatgacaagatgctcaacatcattagtcacgagggaaatgcacatgaaaacaacagcgatatatccagtaagactgctagaatcaaaaagtcctataaactccagcggagatgaggaaatggagaaggtggaaccctcatacgctgttggtaggatgaaaatggtgcagcctcttcagaaaacagcctggcagttcctcaaaagcttaaatctagagttaccatatgacctagcagttgtactcctaggcatataagaatgaaagagaaatgaaaacttacacataaatgtttacagcagcattattcacagcagccagaaagtgaaaatgaccaaaatgtccatcaactgatgaatggataaacaaaatgtagtctatccatacaatggaatatcactgagcagtaaaaggaatgaagttgagattcatgctacaacatggaccaaccttgaaaagatatgctaagtgaatgaagccagtcacaaaagaccacatataatacgattccatctatgtgaaatgtccagaataggcaaatctgtagagacagaaagcagattagttgttgcctggggctgggactgggaggctgaggggaaatggggagtggcagtgaatgggtacatggtttcttttggggaagataaaaatgttctggtcaggtgccatggctcatgccaataatcattgcactttgggaggctgagtcaggaggactgcttgagctcaggagttccagatcagcctgggcaacatggcgagacctctgtctctactaaaaagaaaaaaattagccaggtgtggtggtgtgtgcctgtggtcccagctacttgggaggctgaggtgggaagattgtttgagcccaggaggttgaggttgcagtgagccatgatcgtgccactgcactccagcctgggtgacagagcaacaccctgtctcaaatataaaacaaacaaacaaataaagggcaaaattctccctgtctgaaaaagggggcagtgattctttacaaaattgatcatggtgataagcgatggttgcacagttgtgtcaccattgagttccttccttccttccttctttctttctttctttttttttttttgacggagtctcactcttgcccaggctggagtgcagtggcgcgatctcagctcactgcaacctccacctcctgggttcaagagattctcatgcctcaacctcccaagtagctgggattacaggtgcgtaccaccacacctggctaatttttgtatttttagtagagaaggagttttgccttattggccaggctggtcgcaaactcctgacctcaagtgatccatctgcctcagtctcccaaagtgctgggattacacagccaaccattgaatttaaatatgtgaattgtatggtgtgtgaaccgcaagtgttctgcctatccatatacctcccactcaccttccctctccccatctcactgttctggtgagggaggttcttgctttcctttcgcctgtttgggacctcacttcctttttcccttccccatccctttgtagccccttctcaagagagagaagacaccttgattcccacctacgctctgctaaaacttttccgttctagtcttaaatctctctctcttaagaactgatttcccagtagggtttatgtttggagctaaattagtcctcctggaagcagttgacttcatcctccagcagctgtgccatcagcagaggccatgcatgctggggcaagatccaggcctatctcttcctctgcagtcccctggggacgtctgggatctggttccttggttgggccacgcttagctctccttcgcatgggtgtctcaatgccagggtgtcaggagagctacagtagccagctcaggcccccccagggagagctggggagggagctgagggcctggtgccccccatcaggagggacctttggagtctttcttggctctgcccaggccttctgagcacacagagatcactccagccctctgccctctctgtagccaaatgaaaagactcttctagtctttctggccaactagtaagctctttgaaggtgggtaccattcttgacattagaaaaaactcagagccgtttggatactgaatatttttgacatgctctggtcactgaacgagaagactcttcatgaaaatgatgctttgtcagctctgtagagaaaggcgattggaattttggttgaccaggttagggtaagggaagaatgaatccccagtgtcctaagctggcaggcagtcgtgccgatgcagttctcatttctgctgtcaatttgccaggagactcagaaaaaggccgctatgcctttctgcacctcagtttcctcatctgtcaaatgggcagtgttttgggcgtgctgggcacaggtttgtctgagaaccagctgaggcctgtgttgcgcatgggacctactattattctttataatattaataccaaggacatttaacacctgcaacaacaagaacaagcacagtctcagaaggaaagcccgtcctctaaaagagtgtctgtagagcagagaagcccccagtgccatccttctctttctgccaagctcctgtgccagtgctgtcgtggggggccctgcctgcaggtgtggggatactggttcagggccagtggcccctggcaactggtttgtcttttagagaaggcaggactgaaatgatcagctttccatgtagggccagactctgggcaggtttctttttaaattttttaaatttttttgagacaggatcttgctctctcacccaggctggagtgcagtgacatgatcagggctcactgcagccttgacttcccaggctcaagcaatcctcctgcctcagcctccccaggtagctgggattataggcgtgtgccgctatgcccggctaatttttttgagttttagtagacgaggtctcactatgttgcccagattggtcttgaactcttggacaatcttcccacctcagcctcccaaagttctgggattacaggcgtgagccaccacacctggtctcaaataaaattttattggaacagctacactcatttgctttatgtcattgtgtccggctgccctcatgcagcaggcagagatctgctgacccctggtctagaatgtggaatgctggatccctgggttgagggactattttaatggtaagtacccatatttagatcttttttactgtggttttgtgatgtgatctgtcatctcctctgggcttgcatttctccagtgacaaggcgctcactcctcccacggcgatgcattccagccgtcgaattatgtagttctactgcttaatccttccttaacttgctcttcctgaagcctcaactcactcatcttctttctcaacccctcaggcccagcagaagtcctctctgtcttctccaggcgcagcccttcagccatgcaatcctgcgtgtcctcgttcttcattccacaaatacgttctaagggcctcctgcatttcaggcacttcagaggaccttctggaagcttcccagggcctgctatcttccctgtactgtaaggggacactttgctcaactgttcacttgaacagagtcttcaatgtcttctagtgaattctgggctgaaaccaatgtcgacttggccaaattaaggccacggtcttggtcagccaccttccaggttgacttgccagggtgtcctgggttggtttgttttacagaagcagagctcccagggctcatcgcacagccatggccgaggtgtcgggactcaaattccgggcccttggctgtgcttctcacattctttccattgtccgacgcactgaggcagagacaggaattttaactactcaaaaactactgtttacgtattttactttgacttctttctgggttcttgcataggcttcaaggagggaggatatggatgtgagcttattgtacaaatgccctgggttttccaaacgtgtctgatcttaaatacacagccctgcgtgctgaccttgtgttagaacttaatgatgcgacgtttgctttgcaaactgtggtcccctcctcatagatccttcaattcaacaattgaattcaacaagcccctgggcacccaccgtgcaccaggcactgtgttaggtgctgcagagatgaagatgaggaggatgatggcctgtgcccaggcaggtaacagactagcagaaggacaggaagcaaagtgggcatgtgtaccatgtgtttaaagcctgagggaacagctggtaggatcctcctggggctaggtggtggcagcagcaaagagaggggacatttgaattgggctttgaagggtgcataagagtttaacggggccgggcgcggtggctcacgcctgtaatcccagcactttgggaggccgaggcgggcggatcacgaggtcaggagatcgagaccatcctggctaaaacggggaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaagagtttaacgggacagccacaccactgatcactcagaagtaggtgggttgtgaatcttcagcattctggaaaatgtaaaaagttgttcagtgggcagcagtaaagagggtttcgttttcctggagacactgttgctactttgctggcttatacagggacacccagagagcggctgggaaaatcaagaactgtgtcacctcctccgttcttgcccactgtccagggctcaaggagattggggagcagtttgcaaaggcatttgaagattaggctccacagagatggacactttttttttttcctaaatagatacagagtagccttgtgaaggtttcttttgggtctgagtaggggacgcacagggcatggctatgagggtctcagaaactggtacctactttcctcttatttggcaccgggagcccctgccggaggacatgttctagtgacagccctgggctcaggcttggagagtgcattctcttccccaggaacgctagtcacagctcagtaattcaccccagggaccgcacagagcaggtgggatggtattgatttgtgggccttttggcaaaacatactcattcctaactggcgagggaaccgccagttcatttattcatttactcttctgagtccagcaacaaccttaagaggcaggtgttacctctggtttctgtttaaactgatggccagcaaggtagggcaatttgcctaaggacacgcagctcctaagctactaaacctcccgctcgcctggaagagaagacaggacgggcctatagtgaatcatgagtgcagcatgagagtgttaaaggtcacaggacgcctcttagtgccaagggagttcatagtggagaccccttttgcctgagggactggggaggtggtagttttgaactgggacttgaaggacagactggggtaaaagcaagaggagaagcttgagggaggacggtgtgtgccaggacggtgggactcagagggtggtggggggcacatccactgtccccttccatcctgcagccactccctgaggtggcatttccttgaatgacaggagaggagcctgaggcacgggaagattaagtaaccggtcctacgtataaggtggcatttgaacccaggtctacctggctccatagccaggccccgtgccccacacaccacaccacctggcgcttggccaacaggaaatcacgtcccccagtgtgtaagtcagggaggcagaggtgctgagatgctctcacctgtgggctcccgggcccagccatgctcttggtgttccctcaggccctggcttcccccctccctccaggtggacccatgcttgtgcccctgtgcattctcccacagactcctccctgcggggccacccatctccaaatcccagctgcatatccacaactgtagagtgttttaaaatagtgatggtagcctaggcaacatagcaagaccccattacccccaaaaatacaaaattagctaggcgtggtggcacatgcctgtagtcccagctacttgggaggctgaggtgggaggataccttgagcccaggaggttgaggctgcagtgagctatgattgcaccactgcactccagcctgggtgacacagcgagactctgtgtctaaaaaaaaagatggtgatgctgtccaggcttgacgtaggagccttccgttcctcctcagggcctgtgctctccttttgaggaacagcctccttttagtaaatgtgagggtggctgaggtgggacatgagaggcttgcagtacccaccaagccaggccagccacatggccttctcaactcctggcccagcccaggttgtcagctctctcaggttttgctctttctcctgcgtgctttccccgtgttcttctgcactgttatctttcctcttcatctgaggccatgtctttaccttatgtggtgctgatgtgggccagggaagctgtggcaggggcccgggaaccaccccagggggatgcagagggagtggaccctgtggggctcggccatggcagaattctgctctgattggctttagatcgtcgcctgtgacagcgtttcctccgcggagtgtgttaggaagagcagaaatgcctcctgcatctttattagatccctccaaatggaaatccagcagaaagccgatgttcttgtaaatatcacgacctccctccccatgaggtgtttgtagaacagttatttactcgttttgttttccccacctgcagtttacagaagaaaatcaagaaagcgtgtttttcctccatgcataatcccatccccgactgtaacaacaacaaaaccgtcctcctgttaggaagcagcagtgacttctttaggcaggaaaaaaaaaaaagcgtgctatgccagaaagcaggagcagctgggaagggagagggagggggccacacctggcctacccccagtcaccttttacccagggatcccctgaggaaaacaagctgtgaccttgagccggcaccagccccagggctgaaaccccagccctgtctgaagggttcctttcccgtgtccaccacggccccgtgctgtatagcagccccggtggaaagcctctttctcctgtacctggaggagttgctggaagaaggagaaggctcagcaccagcttctggctaaaatcgtggccgatggctggatgattccggccccactttaataaacaggatagatgtgcggtaacatcaggttgtcaggccctattttgtgatagaaaggatgaggagggaaacaagcacaaatcagtagtgtcacaatctcaaccacttcttccattttcgttaatagaatcggagtctcactatgttgtccagactggtcctgaactcccagctgatacggaagtggggcagggaagtgctgggaggagaagggcgggtccctgtcgagggctccacccctgggcccatgcccacagccctaggtgaggacagacactcctgcctttacacccaaatgctgcatttcccaagaccaccctggcccaccacactcccatcctgtgcctataaaaaccgcgagagcctagcaggcacacacagaagcggctggacattgagaggaacacgtgggtggaagaagacacacgtggctggatatcaagaggacgtcgggggaacatgccctggggaagagcacacaacagatgccggcacgctggcaggccactgaccagcagaatgccccggagtttggctggggcggtcggagaagagtcaggaaaaccatctcccttctggctcccccatctgctgggtgagctcaataaaaccttgcactcattctccaagcccacgtgtgatcttctggtacaccaaggcaggaaccagggatacagaaagtcctctgtccttatgataaggcaggggtataattgagctgactaacacaagctgcctacggatggcaaactaaaagagcaccctgaatgcccaccggggcttcagctgtaaacattcactcctagacactaccatggggttggagccccacagcctgcccgtctgcatgctccccttgaggtttgacccgtctgcatgctcccctcgaggtttgacccgtctgcatgctcccctagaggtttgagcagcgggacactgacgaagcgagccatacccccatcacatgccctttgagggggaaaagggaacctttcccgtttcacagccacagtttcctgctgttttctgaaattcctggtggccactcccttggtgtccatgggtgtctggtgtgtgcctatgtttgctgcgggctggctcggcgagggggaggtgggcagctgggggctctctggaccctgcggctggcatgggttagtggctccgtgtcacctggttcctctcacctctgttttcccttctagcccctgcaggcaggagacttcaacgcagagattaagaagttgagatgtctttgttcccagaggaaagtccctgcaggccccggcctcatggcctctgtgacagcagcaggattagaggcagagttggcccagagggaacatttctcccaccctctgtccctcggggaccccacttcccaggtggcctggaggatgaagtcagggctctggcctcattgagggcctggaactctttagagcccatcaggaccaagctctggtggccttccaggcccactcagtggctggcggtcccacctccaaatgcaggcagaccacactccctgaagggcagtggcaaggccaggccagcacctctccactctgaggaaggggccttacccagatccccgtgtcccccacagcggtggcggttttattgatgtattgtgaaggcacagggagggccctttccagagcaggctgcatctcccctcagcttccacactctgaacctgcctcctgcctccttccacagtgcccgccgggtccacagcgcccgccgggtccacagcgcccgccgggtccacagcgcccaccaggtttgatgtgggctgagcacaccgtcactaactcattccttcattcattcttcactgtgtggggtgtcgggacccagcacgggctcctggcgcagcaggcctcagaccctggggagagctttgctggaggaagtgcagtgccaaggacccatgtcctcattccccctgggtagagcgtgtcgggtgactctgctgcggtctccaggagctggcaagggaggggtgcaccaccagggaagggaattccaggcagcaggcaccaggagcctcatccaagagaaagagaagttccctagactcccaggcagggtgagccgaagggccttggagagtccctgaggtcccgtttcatgggagacttctctcacaaagcgaatgagctcaaatacggaagatggagaaatggaaaacagaaacagaacagaacctccacctgctgggtagatgttaactgaatcttttttttttttgagatggaatcttgctctgtcacccaggctggagtgcagtggcacgatctctgttcactgtaacctctgccttacgggttcaagcgattctcatgcctcagcctccccagtagccaggattccaggcacccgccaccacacctggcaaaatttttgtatttttagtagagacaggatttcaccattctggccaggctggtctgaaactcctgacctcgggtgatccgcccacctgggcctcccaaagtgctggcttgagccaccatgccgcccggccttacctgaatcttatcacacattcctttggaaaatgaatctcctgtgatgggaaaccagccattttcctggtgaggcctcagccctgtagccattccagcatagttaacctgggactctcttctcctctcttgtctctcctcttcctcctatctggcctgcttgctccatcctcccctgctttctgtctctctcctcaccacgtgcctttggatgttctgaatatgcttttgtttgcctgtccagcagtattctctccacggtctcctcctgggtgtctggcgtgtgccttgcgtgtgctgcgggctgggatctgtgggaatgacatagtcggacatggtcctgagcctgttggcctggggactccttttctgtcatactagatgagacaggcgagactgccctggaaagcccggcgtgtctggcctccccagtgctggacggtggccagtgtggttttccaggcgagtccgtgggctcctgggtgggtggtcgggctcgtggggagatcccaagcaatggttgtagagggatgggagggaatgggtggatcccagagagagagagagagagagagcaggctggttccactgtggcctcgttgtctaatgaggagagtgtacagataagtcatgctttgttttgctctgtctctggaattttaatcagttgccctaattgccttcaaattattggaagggaaaaacgccagcagagggtcctgacagatcccagctgtctagctgaggacttatcttctcattgttcttgggaaaccagtcaggtttagggacttgaggtggatgattcattaattcttttaaactgatttcctcagccatgtacacaggtgtgaaagcccttcttatgttatcagtattaccctaatatatcagagggctaggatttctcataaggcgactgttatcttttgataatcacataaataacgtttccatagttctcgaaagcttgccagatgctttcatgtacattagctaacttcttaaatttttttttttttttttgagatagggtctcactcttgtcaaccaggatggagtgcagtggcatgatctctgctcactgcaacctctgcctcccaggttcaagcaattttcctgcttcggcttcctgagtagctgggattataggcgcccgccaccatgcctgcctaatttttgtatttttaatagagatggtgtttcatcatgttggcctcagactcctgacctcaagtgatccatctgcctcagcctcccaaagtgttgggattacaggcatgagctgccatgtgtggctgacattagctaatttaattcttacaataatcttatgaattgggattctcatctcttttaaaatgaggaaactgaggctcagagaggttaagtcatgtgcccaagatcacttagctagtaagtgatgggcagggctgtggagctggttcacttgactctgctgccattgcatccagtttgctctgccagcgagtcaattgagcatttggagcatttgctgtgtgccagcctcatggaggcaaacggagcttcggaacccaggtgtcgagaatgagctgttggcactcagtcctggagtggcagcatggggggcgggggcaggagcatgggggacaacagtccagggagggccacatgacagcaagcagagcctcgaatgcctgagtcctggctccagagagaggccagcctgagctcctccatgtcctactcctgtggatagaccccccggaatgcagggggccgggctgagcaagaggaggagaggacagggaaggaacatgtctgcttctttccttcaggaaaggaaaggtgagctgggcgatggggaaggcctccacggtgttctgttgtaatgttctgccacttggcagcctcaccagggacatatcagccccaggctgattatctgcagaccgggatcccatttctgctgctttgggagagaagggagggtagccctgaggccatcccaaatgcgagtctgttcacagaggggctctcctggcaccttccccagcccagacgctgaggagggcagccagaagcccctgcatcaggtaggagtgctgagtcatgagattgggttgaatggcggctttagcacagctgtggcctgtgttagagagggtgagtttggaccattcctgagcagagggggacctcagaggacagtcggactggggaatccctggcccagagagggaaactggttttcccagagtcacacagctaggtgcccctttgatggttctctcagtgactcacgcctgtaatctcagcattttgggaggccaaggtgggaggattacttgagcctaggaggttgaggctgcagtgaaccatgatcataccactgcattccagcctggccaacagagcaagaccttgtctcaaaaagtaaataaaaaataaaacccattctcactctaacccatgctgtatctgatttttttcctgaggtaggcttgagatgggagggttgttattttttgtaaatgcattaggggcggagtggtgggagagtgattcccctgcagcccttctgaggtcactgccacaccatggcaagaaaagtatttctgactcctggagctccacggtgtgacaggtgggcaggagctgctgggggtgctgggcagacgtttaccgtccagcacccccatttctgctgctctgataacttggatcgactgaagaacctcggggctttcttggctgtttgtaggagcttccagaagcgacctttcgggatgcctcttacatagtcctgcctataccctctacacgtggcgtttcaggtctggagagtcatgtggtgtagctgtatttctgggaagtgtgtgacccgaagcctcctcctgtcagaaccaccggggagctcacaagctaaagtgcagattcctgggtcatcccagacctgctgaagccaaatctttagggtggggccaggaatctgcattttaaacaagctccggaggtggctctgaggccagccacagtttgggcacggcaaggctggggagccaggcttgtttcggatctccagtccttgtgtgggctgcgtgaccttggatgagttatttcccatctctgagccttggttctctggtctgttaagtggcaatcttgccccttctgttttaggcactgtcggggttgcctgccttctggtaagcgtttagtgccctgagccgactcagctggtgctcagggaggcctgatgattcggggcgcttggccgggtggtggggtgggacaccccagagggaagggcactggtcccagcttggtggggcaggccacctggaggaggggtggaccttgggagtgggttatattagggcctccaggcctcagtttgggaggagcttgcagtgaccttggagatggtagtgaccttgtcctcctgccctgcctgggtgcacaggctcccagcacgtgggtggcaaaggtcctagagagcacccagaggcgggtgtctgcctggggtcgagtgtgggagctgggcccagagcccccacttctgcctggcatccgggggtccctccgggaagctgaggttgttttcttgaacagtaaggactggccagagccctgagcaccgagaggtgagggtgaggccccccctactctttcccccaccctcctgggaatgactgccgacatcagggaagggaggggccccaaggccagtgacctggaatgcgatggccagggaggcaggagctggaggctgtgtggggcacgaggaggccgatcgggtgtcccgggggagactcctcgctgcttccctcgggatggtttccatgaacttccctccccggccctgacggcctcctctcctaagctcccgcctcctttttttttttttttggagacagtggctcactctgtcacccaggctggagtgcggtggtgcgatcatggctcactgtagcctcgacctcccccggctcaggtgatcctcccacctcagccttccaagtagctgggactacaggtgcatgcccccacaccagactaatttttgtatattttgtagagatgagttttgccatgttgcccaggctggtcttgaactcctgggctcaaacaatcctcctgcctcggcctcccagagtgctgggtttataggtgtgagtcactgcacctgaccatccctccccgcttttatgtccttttctccctctctgaggtagggggaccaagccctcctccccaagccctgtccactgtggggccttctacaatgtgagcttgtacatctctgtgatgtcacccaggtgccaccaggtgtgtgtgtcctgatgcctttggccaccagcctcaaaatctcccagagttccaggtgcttggtggaagggattcatgtacccctatccccatccctaaatgagagtgtccacaccacccgccctgagttctgaacttagccacctcatgtacggaaggagaaatggaggccgccagagaggtctaggcctccgaccctgaccttgctcctcttggatggtattgggtggcattccaggacagctgggatcttgatcatccagtgggtgccctcactgtgcacctgcctccaggtggtggcgcggtaattgcaagagcgtgagcccctcctctggggcatgttcttggaaataaatacacctcgtgtcatggagatgggcagacgaggtgccagctatttgaacggacagcccggagtctgtgcaggagttggaggtagagcgggtcgaaggcttgcggagggacaggtgggtctcccatggatggcttttcttggaggctgcagccaggagccattgtttctcttcccacctgaccttgggtggttccccttcagccctggcgttatgatgtcccgcccaacccccgaccgcacacctccctcccccttagctgcttcgaagccaaaggtgtggcaacagctaacaggtgcttggtggtccccgcccaccctccttcaggctccctacacccacctgagtgggcctttctgtgttcacttcagggatgaggcttggagaagagggtgtgtgagggggtgcgggtggccctccagactggacctaggcctgctgcattctgggttgaggtcctcttgctgcctctctgtgagcgagcctcgcctgctgggtgctgagcccacaccgcatgtcctcggcctcccattgagatcagctatacgtgatatagaccagggatgcacgcctcatgaggagacgctcactcccccagacacactgagtactctttcctcaagctcagtgcagttcgtccacgtttgcccagcagcacgcctcccgcagcgttgtcaatatttattcgtggttgccgctgcctccctcctggaccgcccattccctgggccctgtctggtggtggctggccttggagagctggcctctcagcacagcaccgggcaccagggctcaaggtcagtgggtgtgtctttgggtcccttaaggagcaaagtctcataatttgctttattttgttttattattattaattttttttgagacagttctcgctctgtcgcccaggctggagtgcagtggtgcgatctcgtctcactgcaacctctgcctcccgggttcaagcgattcttgtgcctcagcctcctgagtatctgggactacaggcacccgccaccacacccagctaatttttgtatttttggtagagacggggtttcaccatgttggccatgctggtctcgaactcctgacctcaggggatccacctgccttggcctcccaaagtgctgagattacaggcgtgagccaccacgcctggccccttaatttactttaaataaagatctggttctcccagatgaggttcacagacagatgttccaagagcacatctgtctggcatcaggagactcacccataccaagctcacagtgctggccatgatccgactcccgccctgcagctcaagcttggtctggagaccttctctggcacctgccccggctccccagccccgggcttcctgcattgtgtgcttccactcccgtcttctccactaggagctctgtggtacgggctttctgcaccttgacctctgggcctcccaccacagcacggtgaaggcaccaactatttcactgctagatccaaggatgctggggccgggggcagctctgagtgtgtctcatacagtgaccttgtttgaggaggctgtgtaggcccaggattttcctggggtgagggacgccaggttccttgatgtgttgggacaaagacgttggctgggcgaggaggctgcctgagatcccacagtgaggctggccctgcccttgctcgcccagctgatctgacaccctccagatggcccaagagagaccgggaggagcatctggtggaggacctgggtgttctgtctggagatttcccattgcttttccagtttattgtcatctgcttgggacttgagggtaacttcatctctcaaaataggctgagactttttacagttagatatttaatatacagatgacgggcggatggtagtgttgttttaaggggggattttgttgctgtcgttgttgttgttgttttgagacagagtcttgctctgtcacccaggctagagtgcgagctcgatcatagctcactgcaacctcaaactcccaggctcaagtgatcctcccacctcagcatcctgaatagctgggactacaggtgtgcgccaccacgcatggctaattttttgtagagatgggatgttgccatgttacccagactggtcttaaactcctgggctcaactaaaattttaatctccaattcatacatttcagaaagtataataatatgtaaagcaaaatcataatagcaacaacaatcactgtcatcccacgggttggtttagatgtaaattttatgcttccttgcaaaaatttgtcgaaagtgccagaaaagcccttgtcccatatcacagtcccatgacccacactcccatggaaagccttagaactgatgtcagtgtgagccctgtgctggagtggagggtgacagagcttcggacatgagcagcctctgctgctgcggccaccctcgccggccctggatccccacacagtgtggggtgttcaggattcctcatgtgacccttaccctgcctgccctgggactgtgtgcctgtgtgcttgcatgtgtgtatgtgcgtgtgtgcccatatgcgtgtgtaggtgtgtgcatatgtgtatataggtgtgtgcatgtgtgtatatacctgtgtaggtgtgtatgtgtgtacatgtgcattgtagatgtgtgtgcatatggtgacctcagttccaaagctttccatgtgtgtgtccatacacatgtgtaggtgtgtgcctgtgtgtgcatatgcgcatacacatgtataggtgtgtgcatgtgtgcacacgtgcatgtgtaggtgtgtgtgtgcattgtgtgtaggtttgtgcatgtgtgtgcatacgtgtgtgtaggggtgtgcgtgtgtacacatatgcatgtgtgtgtgtgcattgtgtgtaggtttgtgcatgtgtgtgcatacgtgtgtgtaggtgtgcatgtgtgtgcacatatgcacgtgtgggtgtgtgtgcagtgtgtgtaggtttgtgtgtgtgtgtgcatatgtgtgtgtaggtgtgtgtgcgtgtcagcatatgtgtgtctgcattcactcggccagagctccttgagggcagggtggttcccacctctctgttcccccagctcccagctccggcctggcttttaatcacagagtaagtcaagcctgctttgggagccttctgactcccccagacacactgagtactctttcctcgagctcagtgcagttcgtccacattttcccagcagcacgcctcctgcagcgttgtcaatatttatttgctgttgctgttgcctccctcctggaccgcccattccccaggccctgtctggtggtggccgcccttggggagctggcctctcagcacagcgccgggcaccggggctcaaggtcagtgggtgtgtgtttgggcttgaactgatgtgtgtgtttactgagctttctccgcagcctgctccggcagctccaaaatggcatttcaggaattgaattaccgacatttcagtacttgcggaatccaggaatagattatttgattgtatctgttggaagtcattgccgtaactggcttcgttttcttcaccaacatctaaaccgagtggggagggaccgcaggagaatgctgtggtgacttgattttcccaaaagcacatctcccaagctggcggcagccgatggcgttgccctgtgactgggggaagcctgaggactcacggtcgcctcaggctggccaccttcgcactggaacctgcccatcacatcaaggagccctctcaggctgaaaaccctgtgccggggtggctgcagcaacacaaggattcccctccagctctgtgatgtggggagcagagggccactgagtcctgccatgtgagtcacatgatgcccgtggcctgatttctgtgcccccatcttgcctcttagagtttgttgacctcagggctcacatatcccttgtaaggggttgtgatggcttccacggccatcatggctagttaggattttcctccagcccttgaggaattctctcgggattttttctggccttgcctgtctgcagaatccatagaggacctacaggaatgtctgcctctgagtccatagtacttgcaggcctgggaggctggatcaaggtggatgttgacacttggtggggccggagccctggcttcctggctgcctcatagctcaggcccgtttgacagcatttgtgagcacctgtcccaggcaggagcaagttcaacagcagcaagggctccaggcagagggaggtgggctctgatgggactcaggggcagcctaaatgtagcagagaactgagaggggatccctgaggccttcttggaggaggtggtggttaagccagctaactttgtccattggaaactgtcaccaggtccttattaatcaaataataatgaatatgccgtgttcggatccactagggaaagctgaaattgagctcaaaggaggcatagaagttcagcttgtaattttgaaaaaggaaaaggctctggcctcattaggctgcccccagtgtgtccttgagacctccttactccttgaaatgtgcttcttaacgttttggaaaaaacaactttctccttctatacttagcccttatctcaatgtgcaggcgcctacctggcccacttatcttcaagaaatgtgctgggttaggcctcaggagtggcaggcacatagatactgtatttggccttggccttctgcccaagtggagtctccgcattcctttgtatgggcccattgggcatgcctggctaatctgcgcaccctctttccactctccttcctgcatttctccttcccttcagtagtggctcccttcccattccccaaatcgcctctgcttttatcttcttccaatcgaattcccgtcagtcgtggagcaggtgggacacctgtgtatgttgcgggggcacagagaagcagcctgtgctcacccatgcctgcctgcaggtgcatgcttgggacttggcagtgggggaagattttggggttaggatttccaggctggcttgacactgacctgttttgttccaacccatacaagccctaaaccctcatgtgcagatcctgctggctctctggggaacacttagttggatgcaggtaggaagaggcttcaaggagcagaggaggggctggctgagggccagccactttgtctggtccccagagcggggtctaacatgtgggaactgagcagcaactgtgagctagccctcaggcaaggctgccccatgatgccagggcacatagggcagactccagatgatggggccactgctggcattggccttttgcagggcacaggagtctgccaggggtgtgttttggagccacccatacaggtgtaccagcttttggaaaatcccaaagatgtggtgccctgctcctgggggtcttgggggctcccaggtagcaacagcgttctgggaggacgtgggctcaaattccaacttttctaccaggttttggctatccttcatccccgtggggctcagtttcctcatctccaagctaagggggcccacctaaagttgtcacagaattggacgtgtgacggggcagcccccttcacctgtgggatccgaggcagagctggcacctccaggctgtgggtccagtgacccggcatggagccagcaaacagaggaggcacctccaggctgcagggtccagtgacctggcatggagcaaacagaggaggccagtgggcaggtgggtgttaccagggcctggagcagcaggggtggagccctggggccaggcagggcgggtttggggtggcatgtggtttgttgtggccctgtcatttgcagtttgggttagtgggtctggctggccaccggggttggaggggaatgccagtgggactatacattgtctccttggaggtgactgtgcccccagaactgagtggacaagccaggcttgtgtccacacctgcccccgtcttttaccctcttctggctctcctccaagaagagcttttcctaaatcattcgccctgttcacctgggctttgaggccccaggtgtaggcccagggggtggggtggggtggggggatggtctctgactggatagccccacctgggtaggaagcccccagtgtggccccaccttggctgtgacctgggggtcctgcagagtcctgtgtcctgttgcagtgaggggtcagtcagtgggaagagtggacaattaggagacaccatgtctgtctcctcgacgccagtcaacactgttgcctttgttcccagggcagccttccccttgccttccattccaaactcctcctcctccctctaagattccctattcacctcctagaggaggccacctgagtgtcagccaggcactggacctgggcctgcccggaaaggtccctgggcctggtgtgctccaagaacctcgctgtcaggggtcagcgtgccatggaggatagggagaggcatgtgcccttggggacgtctggctttgtccggggggttttctgctgctcactggcttcaggtcagggcttggctctgtgctgcagccttaagccagcgggcccaaccgcctcctccaggcccgccagcgcctcagatgtttctctccttcttagagggtgtttcacatcctttcttttgtttgccctgattatttttgcagatgaaggaatacacacaatggtcatctttgtcttatttgaaagccaaacacgttgcttacacgttgggtgcacagtgaatatgtatcagtccagcgcttttcaccatctggtctggttttagtgttgctttatttctggtcattcctcaatcggggctaaagatcagaaaaatcgcatctccaggtcctgagccatggcgaggaagctgggtggtgccctgtgctgtgtggctaaggtgggggacgagggttgtcggtgggggaagccccatgggggccccactggagtcataggagcgaatggagcacccactccatgccttctgtcaattacaaagcacctattatgtcccggatactgtgtccaacacagtggacacattgatgggtaaggcataatccccccccaggagctcccagttggattgaggaggcagacaggcgagcgtatggctgtgacacacccagcaactcccagttggatcggggaggcggacaggcgagcgtatggctgtgacacaggggggcaagtggcgtcaccaaggcagaacccagcagccggggcctgaagccccctcacccagctgcagccttcccgaaacagctgagatcagcctggagagctcttcctccctgcctgcccggagggtggcgtgggtcccatcgctctccgtcagccacggccagagcacacctgtgctgctcctcagaagggcatcacctgtggagacggtgacagctgttcctgttccctgccccaaggacaggatctggagcctgtgggtgtgtaaggagccaactccctgaccccaaaactgtggccagttctggagaaggtggccaggctctgggtcccgggactgtggcccccctcctgcctctaaagcccctcttctggcctccatgacttcagcccctcctgcccccagaaggagggatcagccctacaagggacccaagagagggagcctcacacacaggcgctgcctgactctcctccaagctggcctgagccctgggcagtgttctgaggctcagccacacggctgtgcagggcaggtgagagcggcagcctgagagctgcgagccggggccggggttttcctggagcagcaggagggatgagttgggtttctgtaactacaagggccaagaagagggagaggatgatctgggaaggagagtggctttgggccagcatttgggccagcaggactcagaggcgagggaggtggtaagatcccttgcttgggatgagaggcagatggggaaactgaggcttggagcagagggaggggcagggcctgggcccccagcaggtcccagttcatgatggcatgctgcttctgcatgagtgagacatgagggggtcacagacgcccggaagcatcggcatcatcagatcatccgactcgataatagaaaaattaaaatttaaagtcactgaaagtgacgagtgacagaaatgttcctagaaactggagattgggtgctcagcggatctcaggatagatgatatcagacacaatgtcccctgggctgaggtttttttttgttttttgtttttttatgtttcagaattctaaggcaaggatgaaagtcttctctattcttgaggtgctggggttcctcagcctccaccgtccagcctcgagcagctgccccctctcacctgctcctcagccttctggaacagacaggccccccacagcagcccagcccaggccaccagcaccacccccagaggtttatgccatcttcatgcagtgggaggctcagcccccacactgggacctgtccactttagccccaaggatcttaccaaggtcaaatctttggaactcagggtctttgggaacttctgggccagacaacccggccatcacaggggcttctgcggggttggctttatgatgcatttgggtcaggaggtctgtttttatcctttgggcctctgggaaagtccgtcctggccaagtcctctgtcccctagtctcatggctggctggccctggagctcgggtggcctggcccggcccgcctgcttccccacaggcagcggctcttgcttctgctgcctgcagtgctccagatgctgcaggctccttccttccttcagggcatcctaagtcccccgagtctcgaatccccagtctcagctgagtcctcgaggtcagtggggcagaacgccagagccctgggacaacgggctgcataaaacacttattttaattataagagtgatgtaagaacatatcagaaaattggcaaaatacagggcaaaaaaaaaaaatcactggtggtcgccttctcacacagtcacacacagtggtgtgcagccttctggcttttggttgctttgttgcagtattggcacctgcgttacaagattttgtgttgaccattcttgttcttgctgtggtctttaaggtttacagcgacagctgttcctcttcaggatgcaaggagaccgagcctgcctgccctcagggagctgacggtccagcaggaggcatcctgtctgcagggcccatgcgggggacagggcaagaggtgcggtggaaccagaccttgccctccagaaatgcagggagacagacacgggcgtatttaattcaactatagcatgtggttctgagaaggcttcttggaaagggcctggggttgagctgggcaccagcagggaggtctcagagtggaggcggcagttccaccctacggcgtagaggaggcgccctgatcactgcctttcagccgtggccctgcctgtaatcttatcctttttgttgattgttgttggctgatgttggctgttgctgtgtcctccaccagagtggagaactccctggggctggaccccttgtccttattcacccagagaataggtgccttaaaatactgactggacagaaggaggaagagatgggttggggggccgtgtcatggaagaattccttgggccagccgcagaggagtaggccttggcagagagctgggagcctggaggggagctgaagacctctcccatagtcagctgcctttagggaagaaatactagaaagtcacagaagagaaaagaggcggggaaggggaggaaagcatttccacccacagtcctgtcgggagaggtaacattttggagtacagtgtgccctgccccagcaggccctggctggatgcatattcctatagatataattctataagtgagatcattccatatctactattttacaacctgtttttgttttttgttttttccacttagcaacactttgttcttacctagaattcaccaggcaggacagggctgatgagggagcccctcccacctggacactcagtggcccctcccaggactcggggctttcctgggggcctcagctgcggagcaacagctccctgtgcatcagagccgtgggggaggggggccagggggcataggtacgaccaccactcccatttcgtgtcctttaggaagcttgaagaaaagtggttagccaagaacacaaattacggtgatgttgtttgcagtgtggcgtgttgggttaacataaactctgaagtcagaattgacatcaatttgagcccagatcatcctgttagcagctgtgtgacctgggacagggtgcttaccttccagactttagttccctcactgtacaacagggacagggatcatacctttctctgagagttgaaggaagaagtgaaaccaaacacagccccatgacagccccttatgcatggtaggcactcagcaggtgctggctcccttacggcccgaaggaatcgattgacaaactctcaaattaatgacataattcaagagagtagctgcggagacaataaataattatagtagctgatgtggtttggatgcgtgtcccctccaagtccatgttgaaatgtgatccccagcattgcaggaggggtctggtgggagttgattggatcaggggggcagattcctcatgaatggcttgggccatccccctggtgatgagtgagcaatttggtcgattaaaagagtgtgtcacctccctattcttttgttcccactcttgccatgtgacacattggctccccatcgcctcccaccatgatcgtaagctacaccagaagcagatgctggcaccacgcttcctgtacaggctgcagaactgtgagccaattaagacacttttctttataaattccccagtctcaggtactcctttgtaataatgcaaacagactaacacattagccatagccatttattaacataattttaaaagatttcagtcttgtgctgaaattgttatgttgatggttacacatttgtcaaaacttagtgacctgtacacctaaaaggatgaacttaattgtgtgtaaagtataccttaataaacttgactttacaaaaaaaatccctcttttttttttttgagattgggtctcactcacccaagctgcagtgcagtggcacaatctcggctcactgcaacttccacttcctgggttcaagcaatcctcctgcctcagcctcccaagtagctgggattacaggcgtgcatcaccacacctggttaatttttgtattttttagtagagatggggctttaccatgttagccagactggtcttgaactcctgatctcaagtgatctgcccgcctcggcttcccaaagtgctgggattacaggtgtgagccactgcccccagcctttatatctcttgactgtcacaaaatgcatattttatttaagtttgccataaacagaacatttttacatactgtattgtaacagtatataatacaatacataccgtattgtattgtgtgtagtacaatacatagcgtattgtattgtgtgtagtacaatacatagcgtattgtattgtgtgtagtacaatacataccgtattgtattgtgtgtagtacaatacataccgtattgtattgtgtgtagtacaatacataccgtattgtattgtgtgtagtacaatacatgtatgtaatacaatacatactgtattgtattaatcagatatgttgtcctgtgttattaaaatcatcccttgtggcccaaatttgaaggcagtactctgttcctgggtgtgcaccgttaacttctttaatgaacatcctgctgttcaatagtgaggctgcatccttctagaaagcgctgttgagaggtgtgaggaggctgccacgcaggccgcgccgccccgaatggcaggtggaaggcggctgagtggagccgcagcaaatgcaaccctgcccccgagccaggccccaggctgcacctttccactgcttcacaccagcagtgctttacctggaaaggtgtctgaacagtgcttgcaaaggtaactggcattctgccggctgctcaactctgtggacaccagtacagtcaacaactctcactcgccgcgggcacctgctgtgcccacctgctgccatctgagtgtcacgaccacacccccatccctgtcctttcacgcactgtctgcccgcacacactcttccaccctctgtcggcagggcccctgccacctctgaagccccctgccagctctcggcagccccctcctccccctggctcccgtgtcctgcccacctccccacactggcacctcctgagcagccctggctgagcatgcactctgagggcagaccctggccgggcaccaagatacaaaaggttatgagggtgttctcttgaggaactgagtccagtgtgaacagtgaacacagaaacataaagggacaccagaatccccatccccatccccagggtggtgagccaccgaggggggccaggcacgggggagggtattcaagggcggcaagccaccaaggggacggggcaggcacagggagggcatttcagagagtgcaaggaggcggcgaagatgctggttgagggcacgggtgaggcggggaggcgtttcgactttggactgaaggccttaattgaccaaggcggtaatttccagtcctgtgacctcacgacaggctggacattggaggatgggatgacactggctcttctggggtaacttgtctgggtttaaggttcttgatggggtttaggacatggcgggaccctaaggatggtgccagcatctgaattctctgccgtcttgcagagtcaggattctgcagctacttgcccaagaaaaagtagagaaaggtggtttcatgtttttttttttttttttttttttttactgctttgaagggaggtgtgggactcgtttgcacacacagttaatatttccaaggcttgtgcagggccagacagatttggttgcagctgttagttttacttcctgtcccgataaaggagggtgcttgcctcagctctcacctgctgccataacaaagctccatggaccgggccgcctaaatgcagacacatactcagctctggaggcgggaggtctagatcagggcgtccgcattgtcaggttctggggagggctcttcctgctttgcaggtggcttttttctctgtgtcctcctgtggaatgagagcaaactatagtctcttcctcttcttacaaggacactaataccatcatgggggcctcactctcctgacctcaccgcaacctaattactttccaaaggccccaccccctaccaccatcgccctcggggttagggcgcctgggtacacatttgaggagagggcacagccgttcagtccatgaccacattgcatgttccagggaggaactggagagaggctgctgtttgctgggcacctgagctggttatagatgttaaatcctcacggtagaaaatgtggaaaatacagaaacaattataatgcataatcctacaattcagagatcatcacagcagacatatgggtccatttcttctggtcagtattcatttacagcgaggcggacagactcatgctgtaattgagtcatgctatgtatttgtttcaggtcccgctttttctttccacttaagacaatatcattcatttcctgtatcattaaaaatatttgcggtcgggtgcggtcgctcctacctgtaatcccagcactttgtgaggccaagacgggcagatcacttgaggtcaggagttcgagaccagcctggccaacatggtgaaacccccatctctactaaaaatataaaaatttgtccacctgggccagtgcgtgattccgaagactacatttgaagtccagccttgcagctttccaaaaacccgtgcctccctctttctgcttgtaaatgtccctcacaactggtttcccagaaaaattgtgaggatgagcgaggtgttgcttgtggaagttactttggagggaaagtgtttgtgacaccccatgggtgtggcccatggggctcctgagggtggatggatgtgggagtggacaggcctggctccttttcttggtgggctgggctgggctatgagcaggagctatggccgtggctgacccttctgcaatgggagctgagcagtggtacagttagatagctgcgcagatggtccgatggcccggcctccaaggccttgagtgatgggatgaccatgaccactggatgtctctcaataggctttgccttaaccatgccagcagttcccccatctgctttatcagccctggtatgtacatcagattggctaagggtgcaaaactggaatgctattaaattccagaggctctggtcgcttgaaaagatgagctgaaaataagataaaatttcacagggttaaaggcaggctttgcactctggtttaagtatagagtcgtccattcatgagagtataggtttgggagacaatagcattgaagaggcttgagcgcacactcagaaccagtggctctttcttagtctgtccatgctggctatactgcagcccccctcaactggaatcagatgtggcccaaccatgaatactttggacaaagctcccccaagtcaggcatgccctcttgttagggaaggtggattcctgacctgagtccatctggaggtccaggcaggaattagaaccacttcagaaaagctctgcacagatttaattgcacgagtacctgcgtctcagagctgcagactgagtgtgttgtgcaattgttgggcggcttttcccttggccacagtagattcgcaattaagaaaaacaaatgcagctctcagtcagaagtgtgcaaggtttgcttggtctggagacagcagcttctgtgctctggggtagtgaggaagtgtgtgggcaggttggcaaataagccacatgtatgtcccctgggctcagcccccatcttagtgggcacaccagggcccacgagatctggggactatttatgtagggtctgctggggcaggggtgtgggtgggtgtgcgctgcttgtgttgttgaattgggatttttccagccagaccagtctgctgggacaagccttctggctctgggccaaaggcctccccagctgtgatccattcaggcctagaaagctgggggtgctgactgccatcacccactggcctccatggtgtgtccacagagggccaccttcctgcagggctgagctacttctgtctgggtgtagcttcttgtaaagtccctagcagggttgctccctacaacccacccctccccattttctctttctctctgcatgactattattcactcttcaagtctctgtttagatgtcacctcctctgggaagccttcccagattccaggtggggctggaggcccttctgcggactcccctggcatcctgcactcactcacctatggcacatatcattggccgcaaaatctcctgggcacttatcacactgcgggttccttgaaaacaggaatcattcttgttctctgctgcatcttaggatggtgactggcacatagtaggagtccaattaagaatgttttgaataagcgaaagagtgcctaaatgagacttctattccagcttgaagaccagcccaccaccctgataagaaagttcaagtgtgggaaccgctggggatcttgatggcctgggacctctggatcagtgcttgtgcaggacagaggcagccccggagttctcatgggggctggtgagcagagtggggccccaggatgcctgatggcccggtctgaggtgtgcaggtgcccctgaggtgggcaccacccaggagatgcatgtatctgtgaaataccagataggcccttagtctaagcaaggaggcatctaagctccttaaagattccacaaggatgttacgttgtgctttgaacaacagagacgtggctctgctgagccccagccaaagctctgcacagggaccttgactctcccttcccgctgtgtggctccagcaagtttcctcccacctcaggtctgggtttccaggcattaagtgacaaagtggatgcgacgctccttctggactgtaatgcgcactgcgtggagatgttcgtgttccagtgtagacagggcgttgtcacatcaggcaggactacagggacaatgtttgtcagcctgtcttctgggcaacttggggtatcctccctttatatcacctcctgcccaggtgctctgcgccgccagagcatcatgtcatttgggatccctgatggcaattttgagactttggttcacagtaaagattggtcctgtgtgatcttaaagtaatgtggcttaaaaacaaatggctgtcagggaattgtaaatcaaagcaaacaccgatgagaatggcccaaatccaggacactcagcaccaaatgcgagggaggatgtgaagccacaggaagcctcactcactgctggtgggaacgcaaaacagtacagccaccttggaagacagtttgacaaatccttagaaagctaaacacacttttaccctgtgatccaacaatcatgctccttgatatttacccagaggagttaaaaaaacttatgtccacacaaaaacctgcacatgggtgttcatagcgactttattcacgattattcataacagctggaacttggaggcagcgaaggtgtccttcagcaggtgaatggataaattagctgtggtgcatccagacaatggaatattattccacagcactaagaagaaatgagctagcaagccatgaaaagacatgggggaactcatctgcatatgagtaggtgagagaagccaatctgaaaaggctatgcctatggaggattgcaactctatgatatcctaggaaaggcaaagcgatggagataataaacagatcagtggttcctacgggttaggagggagggagggatgagcaggcagagcacagggcatttttaaggcagtgaaactgctctgtgtgatactgtagtgggggagccatgtcattgcacagttgtcaaaacccatagaatatacagcaccagcagtgagtcctaatgtaacctacggacttgggtgataatgacgtgtgaagagacaaggcgggttcatccgttgtaacaaacagccaccctggtagtagggagggcaggaggtatgtagagaactctgtgctttccacgcgattttgctgtgaactaaacagctctaaaaaataaagttcattaattaaaaaaaaaaaaaaaaaaaagggaaatgaccacatgcaaagcactgcgtggagggccacgcatcccaagcaagtcagctagagtagaggcaggaaccaaacagctctatgaggttctggatgagaagccgcatgcaccaccccctccctgctcccgtgtgggacccagtgaagacctcctgtgcccggctgcagctgctgagtgtgggagtgtgctctccacagcaaaccagccgtgaaggctgcacaccttcctgtttctgcccagccacaccacagggcactcagcccttttcctgagcacttgaagctgcgtttcctcgagctccttcctgtttaagaacaggaggggagtggcggctcgcttgtgcaccactctccagggcagtggtgtgcgggacaccctgcagcacctttgactcctcctctgggaatgaggcgtggtttaatctgcaaccccttaccattagagtctgcaactagtcaaaaggtgaatctggctgggcgcggcggctcatgcctgtcatcccagcactttgggaagctgaggcaggaggactgcttgagcccaggagtcctgaccagcctgggcaacatagtaagacctcctctctacaaaagtaaacaaaactagcctggcgtggtgtcatgtgcctgtggtcccagctactcaggaggctgaggtaggaggatcacttgagcccaagaggttgaggctgcagtgagccaagatcgcgccactgtgctccagcctgggtgacagagtgagacccaccccccttttttttcagaccgcatcttgctctgttgcccaggctggagtgcagtggcacgatctcggctcactgcaacctccacctcccaagtttaagcaattcttttgcctcagcctgccaagtagctgcgattacaggcacctgccaccacacccagctaatttttgtatttttagtagagactgggtttcactatgttggccaggctggtctcaaactcctggcctcaagtgatctgcccacttcagcctgccaaagtgctgggattacaagtgtgagccacccagccctgagtgagaccctttctcaaaaaaaaaagaaaagaaaagaaaaaaaaggtaaatctaagaggtgaccagtaggggaatatatttgtcgagtctcctcacctcagcactgttgccatttggagaagcataattctttggtgtgtgcggggaagggggggctgtcctgtgcattgtggggtattgagcagtatccttggccctacccataagatgctggtaggcatgtcccctcaactccccagttgtaataaccaaaaatatctccagacattgccaaatgtacccgggaaaatcactcaggttgaagtcactaaattatatgtgtgtacatataattacacatgcatatacatcgcgtacacacacacacccacacacacacacaccttttgctggtggctctggattggtaagctggctccatggcaagaatcagcatcctaatacttgccccaccctttaaaataaacttcccaatcctaggcagacaaaagaacaaccccagacctcctccctcagggtggggacaaggtgagggaggtggcggcccggcaggaaggtcatttctttcttcagtcacatcagatgagctgcttcccctcactaggagtggatggggctgccagtggtgttcttgcaaaataccccttgtgggaggagaggggtggagggagagaacaccctccacacatccccgtgggatgtctggagggaagggttttgggcacccaccctggggagagaggagagcccaggttaccatctgtggtgtcccctcgctcacactcactactgccctccacaaactgccatgcttgcttggtgcacggtgctgtgctgggcactggggcaaggccccctcccccatggggctacagatgctaatctgcaaatcccagaaaagtggaatctcggtggcagagtggatgaaggggaggtgctcagtgctatgaaagccagcagctgggagtttcaggggcttccctagggagggaccctgagctggggtctgaaggaagagcagttcactggggagttagggagtgttctaggcagagtaaacagtgcagtggcagccggggctggcacttttaaagaaagcctcaagacttctctttctgattgtgaagtgagctgagcagactgaaatcaaagatgtgaaaataaagatagaggcgacaggctgggtgcggtggctcatgcctgtaatcccaacgctttgggaggccgaggtgggtggatcacaaggtcaagagatggagaccatcctggccaacatggtgaaaccccgtctctactaaaaatacaaaaattagctgggcatggtggcacacgcctgtaatcccagctacttgggaggttgaggcaggagaatcacttgaacccgggaggtgaaggttgcagtgagccagcctggcgatagagcaagactccgtctcaaaaaaaaaaaaaaagatagaggtgacaggaagaccccaccatgagtggcctccactgagtgcgcatgtgagtgagcagctgtgcggtggtccttgccatcttcccatcagcccctcccagcccctgggcctggagaggctgagaatctgacctaaggctgcccagtggcgtgaggctggcctgccgagcttacgtccctgggggactccaggaccccagtgcttcctactggtggcttcagctcccggtcacttgtcgggaatgcagggctgaacccctggaggttgtgtgggacagggcccaggaatctgcattctagcaagcacctgctccaggcttgcttccctggcagggaggcttggtgatccaagttccttgggtgcagacacttgctgcttctctcggaggccgggctgggctgtgattttttcatccaatgtgctgggctgatttcacttgcggatgcagaatgagaagctgtagaggagatcacggcaagctgtctgcatggacgatggcagaatccggtgtctgcttggccgcgtggtgtcactaataggatttgccgagccttttggatgtttgtggcgcgacggctgctgtgggaacccagaggctgctcatttgcagggaatgaataatttatttctgttttcagatgacttattccttcatctgcagccgagcccccacatgttctgtaggctcctgattaagtgatttcagcaggagaatttggcttaatcccccactgccctggacgcctggttccaggctgctgatttgtcggcctcgtgtcggggggtgtccggagcctctcctctctgggggcttttcttcctgctctgcctgtttgggaagcctctggccactgagcatgtgctggccttgggttttacggctgtctggcaattagaatattaatgtcgataacacagcaggacttgcgtgtgacaagctgagccacataacgtcacagtcgctcttgaacatctcggactttcacatgggccagccacaccccagcctaggttgctccctcacctcctcagggcctccctgatgtcggtttagacatgtgccttccatcttgcctgggccaccatgttgatcctctgggtccattgctcaagagcccaccatggctccctgttgccaaatgcagcctgaattcagtattcaaagccctccgtgaatgggcttggtccttcctccctggcctctcttgcgtggctccatgctctgagctgcctactcgctgactcattcatttaatgtttattctttggttgttgtttcagcactgagtgggtctgtggaatcatttacatgtttattgagagtccccctggctgcagatgctgggcaggggctttgatgtggggagaaagacccccccccaggttacaggtaagccctcccaagtggcccagggccctgggagggggtgaggttgtgtgagatggcagtgtgggagagtctcaaatttttggcatctttaatctgcccactgggtgagattgaggactcaggtgggtgtcaggggctttgaatgccaaaccacaaaggtctgcaggctgggggagctgcaggaggttgtcatcagtggcaggggccttggagcttggtggaggagaccacgcttcagatggccagctggagcaccccccaccagccccgctgcctggaccccttccacctctccatggacccacctcaggccctacccaccctctgcaccgccttgcacggcattgcttaatttcactgcaatggctcactggggctgctttcctccctctcttattgctctctgggtgagagttggtctctggcctccacatgaggcagggacagtgcccagggagtggccagtgggagaagcggggcttgcaggccaggtgggcccaagtgtgattcctggtgcagtgctggtggctgtgtcgcccggggcaagtggctcagagcctgtttctcatctgcagatggggggatggtctgtacctgtccagcacccatgaggagcaggtggaacaggatgtggcagtcaagggctcctgaggggacccgtaagtgccacattcagccttctgtgttaaggaccatgagtccaaagagtagtcgcgtgtgaatccacctccttgtgccagcctcacggcctcctcaggaagggcatggaggagcagtgggatgcccacggtaccgtggaggaagcagtcctggaggaagggtgactggccgagggccatgcggtgacgcactggggactggctctagctgctgtggggcacgtccacgtggagaagcgcttggtgtattcccccaccctctcacccccacagcgttcctggtgctctgggtgcctgctgtttctgagccatctaggtgggcacagggacaacctcaccagggacagtgtggccccatgctggtaagcaggcgatactgaccctggttccaaactgcattcctgttggtcctttgtcttgctcttccggtatcattacgaacacaactttagaaagtttaacagtggtactcagagaggcttgtggccccaactcatgtgacagtgaccaacaggtgaaaggtgacttgtggtctgaacacctgcaagggacacttattccgatgcctgaatctttgcatctctgcccagcagatgacagcacctggagtgttagctggtcatacctggacctgcgagtgtaggtaagacccttcttctcagggcctgtttgctcaactgcacgatggaagggttgggcaagatggatctttcctttcttttcttttcttttctcctttgcagttgaacatttttcttgccactgaaatcacaggtggaggtctgtgtgttcggcaggtgaatggccatgcaggggtggagggaggcctggatgctttttcttccctgcactcgcaggccccccatgggaccctcagcccccagaggacaattggaggcttctggactagggttctaaggtctcctgagaaggtcagaggctcgttgtccggccaagacagacagcagacagttggcgtgtctcagggtaggaggctccccaaatagaaagtactggattgggagcggatttattgttccctgcctccccggggccgtcggcatttcccctgtggctgcctcactgttctgatgttggcaaaggtttgttttatcttcctccttccagaacaggaggtgcctcagtgcctcagatgctgcctgagaaggtcagtggcatctgggagccatggtgagggtggcagtgactgggctcgggaggttccagaattctgttagtgagcagtgagctgttttattttccttcctgcctatggaaggtcctgagtgaacaaacaagtttcagtctcaagacaacacatcgtgtttcgaggtgacctgtccccaccccacccctgtcactgggagaagactgcaggtctcacggtctcccgtctgtctctgctgcccccaggtccagggactcctgcgatttctctccctggtgcctggtatttttgtagcactctctggttttcaaagttttcctacaacaattgtgcttaaaatgaaatataaactccatccccagcccccaagtcccactccctgccgacctcgtctcttactgggaaggcccatctttgtcaccagcagcagctgtgagtgcctcgtcagtgtttaagagtccaggtcgctgcagcatcttggtgtgtactgtggacccattgtgtgtgtgcccccaaattcctgtgctgagaccctcactccgagtaggatgttattaggaggcggggcctttgggaggtaatttggtcattagtgcccttataggaagaggatgcgagccagacctgcctctgctgtctaccaggcaagtatataatgagaaggtgacgtaggaggcgggactcgactccagaggcaggactcagacaccagaccaaattgaggactagctacaacagggccagggtagaaacagctttccctaagacgtgcccaccagtgtgcatgtcagtttaccactgccatggtaatacccggaagttacggctcctttccgtggcaatcatctgacgacctggaaattaccacccttttcctagaaatttctgcataatccaccccctaatttgcatgtaattaaaagtgggaataaatctgattgcagtgccgcctctgagctgctgctctgggcacactgcctgtggggtagccctgccccgcaaggaacagtccctctgctgccgctgggcacagctgcttcagtaaaattgctaataccaccggctcacccttgaattctttcctgagtgaagccaagaaccctcctgggctaagtcccagtttgggggctcacctgccctgcaagatcaggagccatctgtacaccaggaagacagccctccccagaactcaactgtgctggcaccttgatcttggacttccagcccccagaactgtaagaggtaaatgtttgttattgaagccacccagtctatggtaatttgttagagtggcctggaggaagacacagtattaagtaaggcttcgtgtctgacttcactgaacactgcggttgtgagacgcatctgttgtgtggggcactgaggttcattctgattgctttatgggactctgttgtgactgtactccagtttctctgcccgtggaatgtacatggatgtttggatagtttccagggtggggctgggacaaattgtgcagctctgagtgttcctgcacatgctttgtcttggacatgtgtccttctttctgttggacatacatgaaggaggtcagctgctgcttcacggggcatgtgtgtggtcatctttagtaaatatgccagtttttcaaagtggtcatagacagtagattccttttattatgtgacaagagctcaaatgccctggtagtgggagtggcagcaggagctacagtaagacattgcacattctctggaagtcagggatccctgccagtcagttcccagtgccccaggaaccaggggtttggtgctgggcactagtcatgaccactcgcggctcaggtgttgggtggtctttccagaccttcacctgtgtgaagcttgcaacctggatggtctcatgtggacatcttggcttccaccctgtgctctgtgtctggtctcagaccacagcccaccctggtggtctcctcaggacacataggctcctctgtaactcagtttcttgaattgaacaatggaagaaaatgcctctatgaagagaggtcattgtgcaaaacgtctgtgtgacagtattcttggagcaactgtgcttatcacccggaggccacagtggaattagtcatttgaaaaccagtcacctccaaaatagtcataatccaaaaccatccatctttgacttcagactccattataattttttctccctaagggactttgctttgtaattatgttggatttcctaatatattaaaataatttgtcatctcttgagcacacatctgcctgctatgagcaagcaggagaggccacttccggttttctgcaggtcccagtgagcatgtgaagcctgcgcctgggcaagaggttggatactgggaggaagaagcttttccagtaccctttcccaaagaccagccagtgagggaaatgggcaccgaatgcaccccaccccccggcctgggactgggccaagaaggaggaactgaccccagaaatggccccggaaccataacctgcttacactgtgacctgcagtgcccatggtggcagcctgggctgtttctggagttgagcggagagttcctccagtctaaactccttagagaacatgaatattcctgagggcctggggtccggcaccaccttcagtggactggatcaccttcttgaaggcagagagatcttaagagcttatgtctgactgcctacccgatgcccagcactaatctgcatgcaccccactgggccatgggcttctcaaaggtggggacgctgtccctgtacctaacacacatggtgggcactcggcctaggtttgcagggcctgctggggagttctccaaggcagttttatagctcagctccagcaccttcctgggggcccagtcctggatttgaggctgccaggggggtttgcagtcagctaagttggtacccatccatcccttcccctctgtaaggggtgacaagcactaagacctgttatgtcccctggaagctctacactctgtccccttgctcttgtgactctgctctttgctctcctgtccactggcatataggagtaggaggatattgacttagattcctttttattatttttgtttaaatcagctttgtggaaatgtaattcacataccctaccatttacccatttaaagtatacaatgtaaagtatacaattcagtgatttttagcatattcacttgtatgtgcaattatcaccatggtcaattttagagtgctttcatcactccaaaaggaaacccgtaccctttacctgctagcccctctttccccatccgctcttctgccagccccaagaaactacgaatctactttctgtctctgttctggacattttatatagatggaatcataccacatttgtccttttgtgtctggcatctttcattatatttttggggtcttgttgctgtttttgtgacagagtctcgctctgttgcccaggctggagtgcagtggcacgatctcagcttactgcaacctctgcccctccaggtttaagcagttctctgcctcagcctccggagtagctgggattacaggcgcgtgccaccacacccggctaatgttttgtatttttagtagagacgggatttcaccatcttgtccaggctggtcttgaactcctgacctcgtgatccacccaccttggcctcccaaattgctgggattacaggcatgagccactatgccaggctgttgttgttttttaagacgtggtctcgatctatccctcgggcgggagtgcagtggcatgaccatagctcactgcagccttgaactcctgggctcaagtgatccttctgcctcagcctcctgagtagctgggactacccccatgcaccaccatgcctagcttgtttatttatttagtagcgatgaggtctcactatgttgcccaggctggtctcgcagtgctgggctcaagcgatcctcccaccttggcctcccttagggctgggattacaggtgcgagccaccacacctggccaagaattggtattccttaaatatttgtagaattcagtagtgaagctatttggccagggcttttctttgtggatagtgttttgattactaattcaatctcttcacgtgttataagtctttcaaattgtctctttcttgagacagttctggtagtttgtgtctttctacttggcttagattttgcaggcctcccctgctctttcagtcatagttgacatttattgagttctttctatgtaccaagcatttgttgtgcattagctcatttaatctttacaaaaacttgatgagctaggtagtactattgtcatctccattttacaaatgcgggagtggaagcagggagaggtgagataacaggtcaaggtcacactgttaggaaataggaaacagtccagctgggctttgattccagacagtccagccatgcagcccctggccttgccacctccctctgccattctccagagactcggagaggggcctaaggcctgacatgaacgaagggctgggggaggtggggtcggaagggccccaggaaaagcgtgtgtgtgaagggctcagactcccagttggggagttcggatgtccccttctggggctttcatcttctaacctcctctcccaagcgctcagccaaagggcagcacagagcaccctaccctaaggtgtgacgccccagctggcaggactttggagcagtagatctgtgcccagcaggtctgtatgaatcacccaggcctctgcattttgcttttctagaggaagaggcatggcaatttgtaagacaatcgccagacagaaatcgggagcaaccagacataactcaacataattatttctgcataatgacttctgctacttgattctgtctcgagcaatgactgtaatctctatctgtcactgggaagctggtggccagggagcccctgtggcttagagatagagccaggaggaaatttgcaattcgagttaatggagtgttcccaagcagcctgagcgccaattccttcaaggtctccggaacagcagacccccttcctgctaggaagcctggtgtcagagctggctgggcctcctctgcggagtccagctcatccactttgtcacagatggggaaactggaaatggcagaggtcacaggatgtgcccaaggcacaggccaacctggaaccagcacttcctctccaccctcccaccacccagcattttccccttcagctggcctggctgtggtgggacagaggaaagatgcctctgtggagctggtcactgagagtgctggccaggcagggctgcccccaggaagctggagacagtggggcctttgcaaccagatagcgagggacctcaatgtggagatagggtgtgcttgctgagcgtgccagcaggcttgtgctcacctgctccagctgggggcatgcagaggcccctcctaccccaggaggatgcttattcactgcattccatggccttttaaaaatcccctttaggcccgggcgtggtggctcacacctgtaatcccagtactgagggaggccaaggcaggcagatggcttgagcccaggaatttgagaccagcctgggcaatgcagtgagatctcatctctactaaaaatgaaaaaaaaaaaaaaaaagattggggtgcacctgtagtcccagttacttgggaggctgaggctggaggattgcttgagcctgggaggttgaggctgcagtgagctttgattgtgccactgcgctccagcctgggtgacagagcgagatcctgtctcctgaaaaacaaacaaacaaaaaaaaaaccttgtaactaaccagagcagctgaaaagaacagagcatgggtttggggatttgtgttttgggcgccccacaccccatttagccgagtgtcacctgagctggtgtcccggagtctctttccttctccataaacagttgagaatgagctctctgccaggccggtaggaaggggatgatgaaatgaggacctggtacattctgctgctggttccattgctgggtttctcctcgtggagagcccttgaccctgtccaggtcttgatttctcggagtgtcaaagcagtgcgcacggagctgtgagataaattggctgagatcatcgatttgaaaacgccgtgagaaaatatggggcaaggcagagagcacagaggggctttagggcagcgagcccgcgctatgtgatgctgtaatggtgggtgcgcatcggtacacgtttgtcaaagcccacggagtggcccacgccaagagggaaccctaacgtgagctgcggacctggggggtgatgatggtcagtgcaggtccctcagttgtaacaaatggcctgctctggcaggggatgtggatcgtggggaaggctgtggccgggagtggtgtaaggggtgtgtgggaactttctgctcaattttgttgggaagacctaaaaaataaaatcttttattttattttatttttttgagacaacatttcactgtcacccaggctggagtgcagtggtgtgatctcggctcactgcaacctcagccttctgggcccaggtgatcttcccacctcagcctcccaggtagctgggactacaggcacgcaccaccacgcatggctaattttttgtatttttagtagagatggcatttcatcatgttgcccagggtggtctcgaactcctggagtcaagcaatccacctgcctcagcttcccagagtgctgggattacaggcgtgaacaatggtgtccagcctaaaatctatctttaaaacacacacacacacacacacacacacacacacacacacacacacactgctatcttaaaagcatagggaccttgcagtgagaatttctggtgggaagatgtatgactttgtcaggtcttgaattctagcagtgagtttacattccataattggcctacaaaattctatatttgggaaacagtagaaatttaactctgagcaagatacaccctatttccaatcacacgtgatgcatctcgggggcattcatttgtcaaacattatttgttgagcacctgctgtgtccaggctctggacgcatagacgtgaaacggacgatttcctgaccttgtggcgctcacagtcaggggggtgggttggtgggtgggtggaaggaggggagaggtgcagcacccccattgtgcaggagcgaggggagccccgctggcacgccgcactgtgctgaggctgggtgttctagggtgaacaagccacttcgtctagtgggtgcttgtaaagcgggatcgttgctatgagagagagaaccttgcgttgggagaaagtaattagggagtgtgcggtagatgcggaagagaaacgggccgtcaggtgaagtgactgtcaggattccatcctggctcggccccttggaagacacatgatcttgcaggtaattagctcctgtaagcctccatttttccccgtctgtcaaatggggatgatgattgtgcctgcctcccagggctgctgtgtggattacgttggataatgagtacaaatgcatagacagcctttagcaaggagcctggttgtatagagctgtcggcctcaacactgttaatacacatatgtaccagaggctgcaggttcacggaggaggagtcaccaatccatgcccggggagcaggcagagaagagggaggcgggcccgtcccgagttcacgccacgtgaaaggtgcttggaacgcttgtgccagagctggcagtgagggttgagggtgggagtggccgagcacctagacacccgcaatgcaaattttccttctcagtctctggatggttttctgagctgagctgcgggctgaatgtcaggtgatgcgtcctgacctcttcctgagcacctagtgtgtgccctgtgctgggcccaggaggcatgctgggggcaatgtgggcctcaaggaggaggtcgggtgatgaggggccaacccaggtatgccagtcaagaaaccgtggaggctggagagaccctgaagggagcagggcacagtcgtgggtggcaggcctgggtgtgcctgattccactgaaccctcgtaacagccctgggtgcagagtgtagagtgctgggtgaggacggaggctgtgcgtctgtgatggccccaggtgacaatgctgttgggatttgaacctgagtttgtggaccacagaggtcccggccacacttagtttccatgccagttttgtagtaaccagcaacctcactcgaagggtggccagcatcttaccttggggcttctatcaacgttgtcctgggcttctcgcctgctggggtgcagcggccttgggcatgtgcccctgtccatggtggctggccggaggccgggagccagggctttctgtatgtagcatggcacttgcaaaaactgtgatcccccagcaggcaccacagaagcaaccagagggaggggcatgggctccgggccgggtcgtcacagcctgcgtgacctgtcgctcttctcttccaggggcatggtctagtggcccagtcaggacgcggaaacactccctggaggttctgacccactccctctcagcctccgcctggtctctggtaagtcactcccagaggccgactggctcagggtgggtgaggactgaggatggaagtgggtggctcctgctgtgccgtggggtcctgcccatgtgtggggactggacccagctcagcagaaagagcagggaagactgggcgtggggggcagcccagctagcacccctagacaggtcaggaaactgcggctcggaaatgcagagaaacagccccccaggccccacagccatctcagctctcgccctaagctggccaggtctttctgggtaaatcgcgtgaccttcggtgcttctgtttggcgatttgtcaggggaatgaggggcccagaactttgagaaggacgtgtgggtgagggcaaggagggcactgtcttagtgtccgggtttctttgtcttctatcccctgcagcccctgtacctggaagcttccttctcccaggctcctgtgcatggtcagggccactcagccctctggacccccacccacgccagataagctgtctgcgctgggagctgggcatgtggctctcccctcagagcagttaccgtaggctgccgggcccagggtctgtctgaatccgccaccctgcagccccccaggcccctgcctgctctgggtgcgaggaaggcttgagggagggcaaagtgcttacagcttgaatgcaccaccctggcctggccactggtcgcctctcccccagtgttagcctggcttaggggctttttccatccggaatccttcctggccctgcctgagctaactccgtgagctcgggagggctcctcatgaccctggtcatcctgccagctcccgagacaggaaggcctggccatgtcccggggctgccctcgggtctggagagcctgccagccatgctgtggggctgcccttccagcgttgagggtttggttttgtttgtaagcaaggaaccaggtatgcgatgctggagagtgtgtaattctggctgtgcctcttcacagccccttccaatctcgtgcatattaaggttgataaaaacaccctcttcagggtcaatgcgagatcagacctggagtgaagtgtccctgtggtatctggaccagcaggacctggctgccccacagctcctcctctctctccctcctccctctcatggtctcatgactattatggtgactcttgtcactcaccaccctgccccacctgctcctgcatactgtgagcatcagttggggccatggatgtagcaagggtcagctgtcataggctcccggggggacacctgggggagggacatttggggacagagccccatctggccatgcccagcccctgagagccctcatcaccgacttgcatctggtgagtttggcagggtcctgtataaggattaaagtcctccaagtcctcatacaaagtcgctttccaaaagtctggaattttcttggccctagacacgggagatgctctttataattttcatcttcccactcagaaggaaccacctttgaatactcagccaggctaaaatttggacccaaaacctgttaaagcatcactgtcttaatttcagtgttcatgatggggttctgggctgtgtgaggggtggagggcagataccagtggcaggtttcatctgtggccctggtagatgtgagtcccgcagccggtcagcccagggcccagggcagaccccgggcgtggctgctttcccgctgggcaccaacgcacgcacgtggtgtttccagggcaaagtgagctccccaccctctgcccgtcccctgccccgcccttagatctgcatcccgtgggtggggtgggttttcctgccttcctcttcctgagggaggcgatttctccttccgctttctccttgccacagtagctgctgggttgggaggagacatccaggctggggcctcagcctcagggtgccagttagcgtgtggttagctgagaaaaaagtatttttctcagcagaaaatagacacaactgcatgtgaaggggccacttccactccttcattctccatccaccagccttactggagctagagagtgggggaacatctgggtccgtgttacctggatgtcacctgcatacaaatgtcctggcccgaggccactgtcagcacgggtgcacaggggaggcgcctggcccggcaggtcgtgctgaggctgatacccgtgtcaagaagctggagcaggcgaagagatcagaagagggtagaggaggtggtccgaggtgtccattcccatccccagacccctggggcatttcagtgcacgcacagcaaataatatcactgcaccaccaccaccaccaccaccaccaccaccatcaccaccaccaccaccaccatcaccaccaccaccaccatcaccaccaccaccaccatcaccaccaccaccaccaccaccaccatcaccaccaccaccaccaccaccaccatcaccaccactaccatcatcaccaccaccaccaccaccaccaccatcaccaccaccaccaccaccaccaccatcaccaccaccaccaccatcaccatcaccaccaccaccaccatcaccatcatcaccaccatcaccgccaccatcaccatcaccaccaccgccgccaccaccgccactgccaccgccaccatcaccgccaccactaccgccaccgccaccaccaccgccaccgccaccgccaccaccaccaccacgagttgagggactctgggatcagaaggcactttccagcacattcacaccattggccgtggatgttgtgggtcaggtgatgggcactggaagggccttccgcttctctctgcccctggcccttggtcatgtacagcaggccgctccccgggcagtggagaagcagcacctgcatactaaggctcgagtcccagcctcccctaccagcctccctctccacgtccccagacactcatgcgttccttcccttgaggtgggttcatggagcacgtaccctgtgtcagacaagcttccaggctctgggcttctgatggagaacagaccagagtaaacctggccccaaggaccttgagctccactcaaggggagacagacagtgaactcaacaaaacagaaatgagagaaaggatcaagctggaaaggggataaagaatgagtgtcggttttggatagagtgcttggggaaggccttcctgagatgagacctgaccaaaggcctgcaggaggtcagggacgggcgtgcttctagctaaggagcagctggtgcaaagggcctgtggcagacgtgcacccgtggcaaggagggggcgagcaggcggctcagccaggtcggagtgggtcacacctgaggggcaggacgctggcaaccccgaccgctgaggaagacaggtgcgagcagcatctcggcacagccagacccccaccatacggcagccctctgtgtcccttaaataaggatgcctcctcccaggcttaagagatcattgttgctcatagtgatttgtgtagccaacaattcttctggaagaagttagatgaacagggccatggagatttggggccggaagagcaggaccccaggcttgcctcccctctagtgctggccaggccgtggatcccaggcgggcatctcagagagccatctgagcggcctttctggaagtgccctcctaggcagacgctggtcatgaggcagggcagcggggaagggacaatcctcctgtgttgtacattgagggttatatttagggtgacttgggatgacttggcagtatcacttcctgtggtcgtcccctccagccctcagccacggagggcagatcctgtctgacaagcattgtgggcagacacgtgcctgcacacacgtacacacccacatgcacacatacacacacgcacacacatacacacattgtgggcaggcacaacttggcattctcatctgccctggaattggtggagggctggggacattgtcctggcccttctgcaggaccgccaggtgcctggcgggggaatcctagccgtcagcatctccggagcatctgctccatgtcgggctctgtgtgaagggctgcatccagatcccacatgagcaagaccggcctagcctccccatctggttgggagatgccaggcagaggtggaaggaagggcggctgacctgccccttagtctgctcagccacacaggcagccacagccgaggctgcacaaggacactcccctgaccttgctgcctgctggccccgggtctccaggccaggtccgagccagccaggctcctccccacccatgtcaccggcctctctaggtggagtccacagtgatctttgctccccttccccaggcatccagcaccacaccaggcacagggcctggtatttctgggacagcccagattacacgttttctctcagttaccccctagaatattcttggacttctcagaccccatgtgcaaatttttagcttagaagtaatcactgggatcatagacgatgtttagcaaatatctgttcttttgggtgttcctaggcccccagagggtctccgggaaactggctcttttgctgaggctagagactatctgggctagaatgtgtctgatggggctctcggagggtgcacagacagtgccgcggtggccgaagatccactattccaaggccggatctgcagaggatttggaagttgtctgtaaggagcgcctagatcacccggaccttctctctccctccttgacttccttcctgcctctcgtcaaacaattactgtgtgcttcctgtgttctaggcgctgtgctaataattggttatgggattattcctagccacaccctgggtaaatggaacccagctctctgtccttgggaaaagggtcaggagagaactggggcccagctgggaagctggaggcttgaggctgctggtccatgttggaatgctgtctccctctgccatccagcacccaagcccggcgccaggctcagagcaggaactgaagcttttgctgttgttgttgtttttgttttttgagacagtctcgctgtgtctcccaggctggagtgcagtggtgtgatctcagctcactgcaagctccgcctcctgggttcaagcgattctctgcctcagcctcctgagtagctgggattacaggcgcgcaccaccacgcccggctaatttttgtattttgagtagagacggggtttcaccatcttggccaggctggtcttgaactcctgacctcaggtaatctgcccgcctcggcctcccaaagtgctgggattgcaggcatgagtcaccgcacccggccaggaactgaaccttggtaggagaaggaaagaaggagttcctgtcttgctttcccgaccagactggaagcgctctgagggcgttttacacttcggtgtcttcccagcacttagcattgtggcctgcatgtaaggggtgttccgtgactgcgtgttgattacactttgtgtgtatgggtgggtgcgttgccacaactctccctgcagaatctgtggcctctggtgctgtgatttaaagactaaagatggcaaagagtggcttttatgagctgccccactcctgattataaacacactctctatgagtcagaggcctgggtgatcatggataagtcacttgccaacagttaactccagactgtagctgctggggccaccgagggcggctggaacatcaccattctgtgcctagcgtttcagccgggctgaggccattttattaataatgatttattgtttttattgcttcccagagatattaaacatgaatcaaataatgcatgtgatgattcactggaggttcccttccaaatttaaaaaagaattaaagaaaaagtttttgacgggtgtgctggtgtggacaccaggcaggcacctgagagccctcccaccttgagctcagccgtgggcagcacagcacagggtggaccttgccctgcagacagagccatgcagcctgcgcaaaaccccagggaggacgcgcgtctcacaaacacctcttcagtctaacatttacaatggtatttcttacaaatggtttccacccgagatatattacaatgtggccaaaccccattcatttgggacacataaattcaaaatttggaaatagttcctttggggctcatgaactgatcaagtttagtcatttctcaagcagggacctggcagaaatgttgctttttaccatctactaagacaagagctaggcagctggttctgctgaacaaggtcccggggagagggacaccagtcctggctcagtgagcagctcctcaggtgctttggaagcctcctctggggatagactcaaagaagttttctatttatttatttatttttctttatttttaaatgtttttctcaaggatgttttttagagctagctcatacctcaggggccacactgtccaaacacatattggaccctgatgaggaaagtgagagccgtcagggtgtgtgacatagccactgtcacccaggcctccagctccattctgcagttgaaaatgatgccctcataacaaagagttcttttgtgtgtgtgtgtgtgtgtgtgtgtgtgtgtgtgtgtgtgtgtgtgtgtgacggagtcttgctctgtcacccaggctggagtgcagtagtgtgatcttgtctcgctgcaacctccgcctcccaggttcaaatgagtctcctgcctcagcctcctgagtagctggattacaggtgcctgccatcatgcctggctaatttttgtatttttagtagtgatggggttttaccatgttggccaggctggtcttgaactcctgacttcaggtgatccgcccacctcaccctcccaaagtgctgggattacaggtgtgagccaccgagtccggccaacaaagagttcttatccgttcattacaaacgcccactctttccagtccttacctgatcaagaattcagaggcaatttttcaggtatttttttgactcggactttacaaatttgaactaccattcaagtaattggtctgaattcctaagtttcgatggtatttttctcttccttcttctggctgcctctcctccccataccctgcatttgttaatgtacccatttgttccatattctgtttgttctttattgctctatacactgctccataatgttctctatcatttgtccattcattacccatgaaggtacatgcagaggtcaccagcccagaggtttgtagcagggacaagttacttgctggtggtggtctccccaaaagtttgggcctgcgagtcattgacacctacacactttgaaaacaccccaggatgaagtctgggactggaaggagctcccaccttagccagactctggcctcctccccagctgtgtccccgccagcccttctccagccatgcccttttgcctcccagcacactgaggattcctcctggaatgcccctcaccccgtctttgctgggtgagtgtttccccagccccgctgagctcaggtatcagccccagcgctctgggtaagtctgggaccatctcctacattgtctgcaaaatcctgcagaaagcctggcctgtgctggtcagcaggatgctgcgtttccttttaaacagacccaaagcagtcagcagccacagactccccagagacggagatgagaggagggacctcatgccctgaggcagccccagcctcactcccatgccctgcaggcgctgagcagcccccagatcccgggctcctttgctgccccagggtcgggcagttcttgcatcttggaccgagtgggctctgccctgctgtggcatgactgggcttcttctgtcctttttctttattttctctttgaagaacaggagttggaatttcactcaccctgccccagctggatgtgtctaggccaccgtggtcccaggctctctgcccagctgggcctcaggaccaggttttaatgccgctgcttgggtgtgccgagcgagaagggctcgccaggcagtgcagagattccaccgagcccaggccgcagcccccacctcccgccgggctgtgctcagtgtcaggaatcggctcccaagatggccgcctttcttgtaaagctgtgccaataccccaggcatctgactggtgctttccagctggcactccttttacagattccatttccctttatcctcacaactgctcagtagaacctgcaggcagggacccttattcccattttacagtcaaggaaaataaggcccagagaagttgagacagccaggaccatatggctggagacggggcaggctgggcagagcccccagcagggcccctgggtctgcgggctgctcccagcagcacccctcatatacacaccctcatcctgactgcaggcccctgaagctggcattctggttcaattttacagaggagcaaacaggctgggtctggagcgttgacactggcaactctagcccagccttgcctgactccagggcatggctccaagaccctggaagagctgcctgtccctccatggcccctccagggcgtgctgggtgctggcagggcaggctgaggcactcgacagcagagttggccccgtagtctcagttttgctcccgctagggtgaaacacggttccctggggaagggctgttgctcacctcttggcctggaacatcagggtggaatttgcagacggaattctgccatctgacgcgtagatcttccccccaggcatgggtcagtgcttgagtcattctgcagctggcacaaagagccaggaagaatgcgctccaagatgcctgggagctggcatgccaaatcaccaggcgtcatcagcacagccaagccagggtgggggcctcgggcaggagcagcgccctgccagctctggctgactgcacgaggggccacatctagagggactgatgaaggggcgtctaaagcctcagtatctccagcctgctgtgccctcttacattttctcccaaagagcagtcagcttgcagtatgcgccaagtccccgcaaatgggacgttgggtgattcacatggttgtttcagcttttgagtttttgttgtgtgattgaatagtaatagaattattcttggtgttctatggagcattaccgggtagtggggaggtgggcacactgagcctctactgtttctccccttcacccctccttgctgtcatcaacatgcgttctcctacagtcatgctccgcgctaattcctttagtcattccttccagcattactgaaactggaagagtcttttgtggcatgtggggattcctcgtcgtgcagggcttgagtgccacaggacccagtgctcgctgtccccatgccctggcacacactgttccctttgtcccagctggagaactcctggaacctttaagccctggctcagccctcagctctgtcccatcccagctgacctctgtgctctgcgcccgagctcctgagcccacgtaagtctcttcatgcccatcactgctgtttcatgggcgtgtgtggggggtcacttcaaggagccccaggaagggtctgtgtcttgtccatccacgtgtgactacacccagcatggaacaggactcgggaaccactgaggtgtgggtgaaggaaccagtccagagactccactctcacttcagcctgatgtttctggggtctgtcactgaaaaccccaacttcgccttcaaagcgagatcctgggtgggggcagaggaagtcccaggctctgtggccaggactccacacccagatttccaccgggctcgctctagcctggccctggcacgggtgctgcgtggctctgctccccgcctggcatccggcacccttcacctctgtagaaacacggaactgtcacagggacagacgtacatgggtcgggggttgctttcagaaagtctatggtctcattttggtcctgcctttgagcttccttttcctgctgggttagggttccggacggaaggggagcattctcttgggcgtttcccttttcctgtctccctgttctctccccagaggctcatgtatgtccgtttcactcacctccctttctctgcttgggaggcagctcaaagagctcctctccaaagactcaagctggagtgatgttcgctctatgatgacgccgcactggtccagggaatgatctcactggagagtagcaggaagtcccccatcctgtcccccaccccactggctgaggaccatatagctgggatgtgttcacctgggaaggagattggcaccagtttgataaatggacacccccaagtctggcatggccccaaaactctactctgctgcagctgtttccatgccagaaaacagagatttccagaataccgagtctgaatgtgccttcttggagcagcttcaaatctgagcaggagagcacttgaccatcctaacccctgaccttcctccagcaattcctaaaactggaagagtcacagaatgttagaataagagggatcctagaaaaagaaccactcactcattgctttgttcatttgctcaggcactgtgctaggcgcttggaatacacaaccattcattcaaacatatttattgactgaattgtgtgccaggccctgttttgggccctgtgggggtacagtggtgaacaaaaggaggcagacagtcaagagattttgtaaatatagtgccaggtggcaggaaatgctgagaaaggggtcagggtgagggaccagagggtgagggtggatgctctttgaggtgggtccttggaggaggtttccccacgactgttgagcaagaacatgaacttggagggagtgagccttgcagacactgaggggaaggaagagcagacaggtggagggaactgcaggtgcgaaggccctgaggctggaacacgctgagcagcttctctgactgggacaaatgaaggattctccttcccccaggagctcccagtctaatgaaggaaaaagacaaagaagtgacgcgttcaaagctgagttcatactagaaaaacgctgttagaattcaaagggaagagcagttgtaggggctgggaaaggcaagcctgaggagtgacctttgcattgggctttggtggatgagtaggggttggcagggtggctgaggcgagcgtgccacacgggtgaactcatatctgcagaggcacaaggtgtgcagggacagccacccacacattcctcttcctgtcgcagtagcagcttctgcaagagaaagtacagctcttggggatttcccttttcctttctccacctcttccttctcaccagcttcatttagggcatttcagccttgagagggtggaaaagaaggagagattggtagaggaaggggatttctgtgccctgctgggtctctctctctctctcttctcatatgttatgtttttcttgtaaggttttggggagttgtggggagtttaagaggctggggatgggtaagaagtcaagaaggtttcggttggatttctcaacaacaggtcattggcctggagcccctccagtgggtaaaatgccgtgatgcaacagctttcaggaaggcctccagaaatgagctctaggtcagtgggttgggtttaggtgcaggcacgccctggaactgtcactctagaggtgttactaacctcctctttccccggatctgactcagcagggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtaattatgaaatacaaacgccatgatctttcactcaagggcactaaggagtgaataaataaaggataccacagggtgctaatgagcttgaagagtccctgtttggtagccccagatccagggtccctggtatcacccactgaatgctacttctacccagcactgcccacgggaaataaagtgggagacacatacctatgtgattgtaactttttctatagccgcattgaaaagtaaaaaagatgaaatttaaaacttgtttgatttaaaccgttagatcccaaatggtatcatttaccatttcacatgtaatcaagaaagagaaagtattaatgagatattttatgttgttttttttcatatgaagtcgtcaaaatccggcgtgtattttacactaagggcacatatatgagttcagactggcgacggtttatgtgctcagtagccacgtgtggctggttgtgaccatagtggacaaagcagccctagcttataggtggagacacggaggcacctgagaggggcggggtctcagctcaggccctgggagcctgttcaacagctccctctagcgtcggcccagccacacttcagcctggatggtcccagatgcatcggctcctccctgcacctgggtcctggcagccggcacagcctccccgcaatcacccaggggcaaaacgggcccctccttggagaactaccgggaagctaaggctgcaggcagcttgactgtcacttgcttatttggaggaaagaaggacacaggcccgagttgttttgaaaaatgcaatcagccctaggagaggggcttagctgcaggggccgtgtgggtccagcggtcaccgggagaaagaactgggttgggtgctggataagaaagagcacaaacctgtttgtcttccaccggccccttctgccttccaccttcctgttccaccccaggaagaacaagctctcatctcaaatggcctgagccctctgattccttgaagttcaaattcacaacaaacgcctctccagcctcttcctgagcctcagtcttttttttttttttttttttttttttttttgagacagagtctcgctctgttgcccaggctggagtgcagtggcaccacctcagctcactgcaacctccaccctccgggttcaagcaattctcccgtctcaacctcccgagtagctgggactaccaggtgcgtgccaccgcacccagctaattttttatatttttagtagggacggtttcaccatgttgctcaggctggtcttgaactcctgagctcagacaatccactgccttggcctcctgaagtgctgggatgacaggtgtgagccacggcgccccggccagcctgggtctctcataagcatttggtgtttcccacctctctggtcgccttccctcaaagcatctcagagtctggttggcctggcaagcttcggggatctgactgatgaaagcattttggagcaatgggatgagatgccaaccaatgccgtcagccggcactgaggtgggattaacaggacaatcaagccctcggttcccaggagcctcactgagcagctgctagaactgtgccactaaacaggctttaatttacaggcaataccgactctgggttaactatttctcacagggctccccagctgcatgtttacatttctttccttgttcctctttttcttcttcttctttttttttttttttttttttttttacaattcagcagattaagaacaatagcagggtaactgagaaccacagaggtggctgtaagtgactcattaactccctctcccatgtttccatcaccgtgaattacaacgtcatctctgatgccctcagacagctgttactagtttgatccgagccttgcttgaatatgaatctttttaagccgagcaggagatggttctgctctcaaatagactgccctcccctgggcctcccatttcttaccccaccatcctccttggagatgaaagacttcctgagaaatgaaggctgggtttgcctaattactggagcaaggtggctgttctgctgggaaacgtgagtggtggctttctgtctctgcagaaaggcttgcttttgctcggtcgtcttactagacagccaagcaccaataaggttggctcctttgcttaatgaatgacagaggggtcacagcagcatgcagcattccccccgccccccgtttcttgtgaggcagcctgcgtcgggcccgacagcctccaggagagagctaaaatgaggtccttcagattacatatttcatctgggcccttgttaataagcaaatgctggctgtcccagtgagtgactgggagtgtgtgtgtggccgtcaccttcatttggcattcatgggctccatttaccagtttcataaaagttccagtggggaggccatcttgcaaagctgtcctggcgagcacaagcagagtgctggacaccagccaggagcaccctgggtggcctccacggctgcttatggtcttggcatggaaagggcccagaggaggttacaggacaatgggaaggaggtgggctctccactcagacctcctgggtccacagcccaccaccccaccgaagcctcggtcccttgtccctaaggtggagctgacattgcctcctctcggcctagccaggagtgaccccactttcccagctcctagaatcttcactgtgtcctcccctggatgtggcctacagggactgggcctcctgcagcctttgaaatcctccttgtcattcagttgtgattccaaatgccgttgtcctaggcaagccgccgagtgccccgggaatgagcgactcccctggaccccactttattcactttttatgccccttcctgggcatgcctacaccataactcaagccccccagggagctggtgactggggaccggcatcccagtgctcagcctgggattcggcactcagagggcccgacagcctggaatacactgagcaccccgctggcaccaggccccaaggacaggctgatgtttccacttccctggagaaagatcctccagtcccctgctcggaggctgatcccggctggctgcccgcttgctcagggcaaggaggtaggctggagagggcagacttccctcaactcacccatcttctgtgggttcctcaccagccttcctctgggcctgttgttctcctgtccagtgtctttccagagaagattcctcccccaagctttggagatggggctggggtgggggtggttacctgaccgctgagtcgcagtacagggttccatgttggtcaggggtggctaattgctgtaagaagcaagtgccaacctttgcttggcccagtgaagtggtgtttcctgatgtgttgcagtgggatgtcaccgcaggagacgaaggctctattccacgcagtcacgcaaggacttaagtttcttctttttagaaggtctttcgtctcacagcctttctcagccggggttccaggagggaatcaaggactcacagcaaaggcatcatggtgtgcagggaacgactttcctcctgcatacctggaatgaaaccagttacacaccatccttaggtacatgactggttggggaaatgggcacaccagtcattgactgcaggctgtggttcagatgagaaagcctggttgagaaatgctttagggtctatgccctctggggcctccaagtcctcccctggatagtctgcttccaggtgcccagcaagaaagggcaggaaagggcgtgtgcagcaagggctgccctgacagttatggaggctcaggccagaagtgtggtcatcactctggccacatcccattggccagagtgtagtcacatggtaccacctagctgcaagggaggctgggaaatgtagtccggctgtgtgccctggaagaaaaggcaatagagtaagaagagcacatggtctcggcacaggctctattcttgcacattccttcagactctgcctcccacacctcctgaggctctggggataccctatccctgagccttctggaattttggggccccagttgccctgtttctccttcctggcccccctccctgttcagctgtttgccatctccctgcccacttcccactgatatgtgttggggcttgtggatgtgatcaaggtcataggcacagtctttcttttctttttcttgttctccttgttggggtggggattttttcaaaaggaagcggcaaaggtattgtactatttttgggtccctacactcttctgcctccacattcttctgttgtgtttatgctgctagacctggaaccttaggatgagcaggtcttggcatcagactttgtttgcatcagcagaatcctttctttgaaagagaacagatgcagaaacagatcagagggttgctgctctggtctgtgctgggcctggaggcccagagtccttcctcctcccctgcccatcctgtggacccccaaagccttaggaaggtccctggggctcctgggacacagctcagaggctcctggctggtgtcactcctctctgtgaggcttgaattctctcccttgcattccgaaagtgggtcacactggaataccagctttgtccaaacctccctgcctctggagttagccaaaccttaaagcaggttcttgtgcatgtgtgtatacacagcaactgcaaccacagcaagagtgtccattcacccaacacagacacccaccttgtgccaggcccagctgggtcacctgggagagggtgaagggtaggaagcccttccagaggaggtgctgagtgaggcaggaggccgcaggcgcacacgtctgccctctggcacacgcaggaaggtgctgggaatgcagggagcttctccccagcagaccatgatgcactccgcctgttaccttctagcggtgtgctcactgggtttggcactgcccctaatctggtacctccctttctatacgcatctgtgatttcaggcagataagtgttatgagtttggcattccaatgggatcggtaagaacataaatcaccgatccatcctgggataaatttctcccttcgttctgagaggtgatttggttttcactgaggtgagtggattcttaaggcagtgatcctcaactcccagggcctagaacttcacagaaggtggctcattttgataatgaaaaatgcaggggtgcaaatcaggcagaaagggcctgccactagccaacaatgtgtccatcaccatgtcgcccttgcctgggccagcctcccctctgctgcccatgcaaggcctggggaggaggccagaccgcctgggtccaagccctggctttgcctctcagaggttccggggctctcccagggttggtttacttgtggtgaagcgtgactaataggtaaagtatctgacaaaatgggccccacaggccatggttgctgcttctggctgtccctgctgagagcaggtgtaacgtacctggcatcactcctgccccagagacaccgataacacatgtttgtcagctgtaggtcagttccccaagggtggctgctgtgctactgtaacacgggactgcagactgggcacttaaactacagaactctgttttctcacggtctggaggccagaagtccaaggtgttggcagggttgggtgttggcagggttgggtgttggcagggttgtttcctccagaggcccctctcctagaattgcagatggctgtcattttgctgtgccttcacacggtttcccctgtgtgtctgtgtcctcatctcctcttcttataaggacaccagtcatattggattagggcccaccctggtgacctcattttaacctaatgacctctttaaagactgtgtttccaagtacagtcccattctgagggacctggggttaggactttaacatgggaatttgggggaagcacagttgaggccatagcagcagctgtctcattctgctcacagctggttctctctggccacgtgccagagaggagtacgatgccatccccttaaaccacacacggacatgctgccaggaggaacgtcatcacctttcagctgaaaggagtgaggaatgaggacaagcaggtgcagaacacagccttctcacgtactggtccattctgcacgtgcgctgctgctgttacagcggcagacgggaggctgaactagagacacctaagacaaaccctgctttcccctccagatgctggctgcaagaacgccacagtttgagaggagtgtggacaatagaaagccttgagagcagctgagctgacgaagggatgggaaaatgggcccttttgaagcctaggaatgaccaagtggagatgtgcagggtttgggggtgccccagcttgagtctcagtgctctgagggacatagcgcagagtgggacagcccggtgggtcaacccctgcctggttctgcagacttggagaggtgggacttctgccccaggccgcatggagggccggccctgggctgggtgtgcctcacgctgcctgggagcctcaggcaacctgctgcagctgcttgttttgccactcactggcctgactgcgggagctggaggggctgggaggtcattccctactccacagcttagctcaacctcccaggtgccccgcacccccatccctcccttcccataaaaccagttattcctcatcctcataagcgctcctaggacacttgccatgttctatcagtttgggggttctctggggcagccatccacagatccatgccccgcctatgagccatctcccctctccttctcacccccgtgctccccgtgtggtgtcggcccccgaggcaaggaccgtatgggttttgttcactgcccacactccctctgacacacaggaagttctggaaaagcttccgcatggtgaaggagccacatgcggtttggtcgggtgccccaggcctcctcttgatcatcacgaccaccctgccatccctgttattcggggggagtccagagctccaggaagttgaccacctccccaaggtcccccgagcaggggtgggtggaactggctctgagcccacactcaatgcctttcccctgtgccccggagcctggcttggtgccacccaggacttgtttgtggaagtgacatgtgaacacctagcgagctccatgggctctgcgtgtgtacgtctttgctgactcagtggccccacacagcaacccgagggccagggcagaaagcacaggaggagccaccacgggtgctgcagggcctcaggctgggcatccatcctctacctgtccttctgccgtccatctgtgggttctccctcaggtgccacgcaaggctggtccttcacaatggcccaggccctcaaactcagtggtcaggagggttcccaccacctcagggcttagcggcagtcaaggtaacctcaggtcctcaggctacctttgcaaataggtccttgcaaagaccctaattcacattcacagatactgggagttaggacttcaacatcttttaggcgggccatgattcaacccatgcatctgggcctaggaagtggaactgccccagtgagcgatgccctgggcactgtgcagttctgggggacacagccctgacagccggaggggggctttctgggcacagagctgtctgggatccgccaaggcaacacaggaaggagtccagagctcacctgggtgagacccgagagctgtcagtgacagcagaatccagagggagcccacatctccaagccaggtccagagctcttccaacaggatagcagtcttgtcaggcactctgggaggccaaagtgggaggatcactttggggccaggagttcgagcaacctgggcaacatagcaagatccctatctctacaaacaaaccaaaaacctcagtagcatctttgttgttttttctcttctgtcaggtattttggtagtagtgatcttctgattttacattccctttttttttttttccatgtagaaatctctatggccatttcctcttgtgaattaattgagtttctaaagtgaactagctgcatgttagaaccaggacttttttgagccctttagagcatgctggcaggcgtcatccccaagccccagggtgggtcatatttctggatgatggaggcagggggtgcaggggtcccctatctgcacattgttctgagtctgatgtgattcctcaactcctccatgaaacaggggccatgcttgtcctcgtctggggcaaactgcagttggagaggctggcctcctgtggctgcatatccagagctgggcttaactggccaggaggagagaagaatcctctctcttaataaaaagtccccaggggctgggcacagtggctcacacctgtaatcccagcacattgggaggctgaggcaggtggatcacctgaagtcaggagttcgagaccaggttggccaacatggtgaaaccccatctctactaaaaatacaaaaattagctgggcatggtggtgcatacctgtaattccagctacttgggaggctgaggcacaagaatcgcttgaacccaggaggcggaggttgcagtgagctgagatcgctccattgcactccaacctgggtgacaagagcgaaactccctctcaaaaaaaaacaaaaaaaaaagtccccagggcccatgtccacccagccgtctctctccctcccggccaatgttattctttcctcataagcccttccagagcacaaacacacaagcacgtatgtttgtcttcttttctcataaatggtaacaagctctgcttgctgttgtgcagcttctcttttcacataaaaatacaccttgaagattatttcttatgagtacgtaagatgggcacctgagtagtttgctgttacagaccacgtaggcaatggccacctgcacagattatttgcacaggtgggagtatcattagatgtttctggaagtgggatggctgggtcaaggtgaatgtgtgtttggaattttgaaagataaagtcataaagataagtaaaaacacctggcatcttggctcacggctgtagtcccaacacattgggaggtcaaggtgggaggactgcttgaagctaggagcttgagactggcctgggcaaaatagtgaggccctgtttctacaaaaaaaaaaaaaattaactgggtgtggtggtgtgtgcccatagtctcagctactcaggagactgaggtgggaggatcacttgagcaccggaggtcaaggcttcagtgagtcatgatcacacactgcagcctgggtgacagagtgagagcctgtctcaaaaaataaataaataaaaaatagatagatagattgattgattgatatagagaggataagtaaaaacaaaaacatgtatgtactataaaacctgggatgggctgggcgtggtggcttatgcctatactcctaacactttgagaggccaaggcaggcgaatcacttgaggtcaggagtttgagaccaacctggccaacatagtgtgaaaccctgtctctactaaaaatacataaataaataaataaataaatagccaggtgtggtggtgcatgcctataatcctagctactcaggaggctgagttgggaggattgcttgaacccaggaggtggaggttgcagtgagccgagatcacaccactgcacactcctcataagtgcctggaagggcaacacagtgagactccatctcaaaaaaaaaaaaaaaaaaaaaaaaacaaccctgggatagaggcagagaagaaaggaagtggtgggcagtgtgggtggtctgtcttacctttcataatggagagctggtgcctactgtttagaattcacaaacacagagttcaaagtggttgccactgtggctagggtaggagacatctttttatttctcattcttccatgtacttcaaaaattatcacgccctgtatatcagttaactgttaatgtaagaaaataacatgaggtggtgcagtggcagccgtgtgaatgccggttgatcagtcttgcattcaggacttgtggagaaccgccctgggggatggttttgagcagagcagttcctcgttcccacaggtgcctcatttttccctggttccattcagaacatcatttactgcctagagctaattccagatcctcctcccacccggggcagtttatcaaaggcaaaataaagagggtgggccggggacagtggctcacacctgtaatcccagcaccttgggaggccgaggcaggtggatcacctgaggtctggagttcgagaccagcctggccaacatggtgaaaccctgtctctactaaaaatacaaaaaattagctgggcgcggtggtgcatgcctgtaatcccagctactcaggaggctgaggcaggagaattgcttgaacctgggaggcggaggttacagtgagctgtgatcctgctactgcactgcagcctgggcgacaagagcaaaactccatctcaaaagaaacaaacaaataaacaaataaagaaggtgggtgggggtgactccctgaaagtttctagacgcctcttctaaagataaaaacataatgtgatgcctgaaagagggaagaactgccccaaagagtctgggatgtggctgaggtggccactttgccaggagctgatgagggggatgaaagtaagaactgattttaatcttcgcctctcgtacaacccctggtgggcaccggatgatgccctgttccactgattttaagttgcattttcccccccgcatttccacattctccaagtgagaacgtgtcccgcagtgtgagggtgagctgtcgtgatataattagagtctcttggccttcttggtggtccataagatagcggcatgccttccgatgggggacccgggagttgctgagtcgcagcgcttgcacagcgatgggcttatttggtctctccggcacatggctcagccctgctccgtggccgtgggtggcgtccccggctgaccccctgtcttgcaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggtaccggcgcccgaggccccgggtctcaccgcgggcccaggtcccctcccagctcccagcccccagcccagggcttttttttttttttttttttttaagacaggaatcttgctctagtgactggagtgcagtggcactatctcagctcactgcaacctctgcctcctgggctcaggtgatttttccgcttcagcctcttgagcacctccatgccctgttaatttttttggtatttttgatggtagagagagggttttgccacattatccaggctggtcttgaactcctaggctcaagcgatctgcccgcctcagcctcccagagtgctagaatgacaggtgtgagccaccgtgcctggcctccctgtgttctttatgttcactcgacattgggtctttcttggccaggttgctacctggtgcactttggaaagtgagcagttgtcacctgattgggcagacccttgcaaagggcaatggtaaaagccaatgtttattgatcacttgctatacatcagggccgggtggagcactttgatccgttttcatcttcataacccaacaacgtgggtcattctctgcattttacaaagtctgagactcaaatagatgaatttctaaaaattatattttatatatatttggagatggagtctcactttgtcgcccaggctggagtgcagtggcatgatctcggctcactgcaacctccacctcctgggttcaagagattctcctgtctcagcctcccatgtagctgggattacaggtatgtgccaccgcagccagctaatttttgtatttttagtagagacgaggtttcaccatgttggccaggctagtcttaaactcctcacctcagttgatctgccttcagcctcccaaagtgctaggattacaggcatgggccaccgtgcctggccaagaattgtatgattgctgggctccttggcacttgcaagaggtacctgccaagacctggggaaagccctggatttgagaactcaacagatagcttgtgatgtccccaggaatgcgcagtcatcaagtaaaactgaagcattaacgatcacgagaatcagctcagcacgggaaagacgtcactttaggaggcatctcttcaccttcatgcctatcaacagctctagcagaaaggccatgtttcagaaggaaaccaagttttgttcacttggccaggtgcctaggtatgcgagagagagtagagagcagagctgcccctccctggcattcccctgagtgcctccctgagcccaggagcatccaattctagaactcatggccaggcctgtaatcccaacactttgggtggccgaggctggaggatcgcgtgagcccgggagtttgagaccagcctgggcaatatagtgagactccatctctataaaaaattaaaagagtagcagggcatagtggcatgcacctgtagtcccagctacttgggaggctgagatgggaggattgcttgagcccaggagttcaaggtgacagtgagctgtgattgcactgctgcattccagcctgggtgacagagtgagaccctgcctccaaaaagaccaaaagcaaaataagaaaaaaatggaactcttcagaaggggtggtcccatggtagggaacttcaggggtgggcctccagtagcgggtatcaaatccgtgaacttctgcagcagcagtggcccgcctcaggaatgagcgacccatttcccacgtagatggttttcacactgtcagagtaaattaacatgggctcggggaactctggtactgtcgtcactttctggctcttagcttcatgcagtggcggaagtaagaattctattccccaggaatcacccgtcctgtcctgtgtgttaacccttaccctttgcaaataggtgtgcctgtcactggccgtgcagaggcttggtcagaacatcaaggcactggtagaactgttccaagcagtgaggagcagccacttctgtccaaacgggacagcccccaaaccaagtccccaaaccctgaaagccttcccccgacgccatcgatggctccctggccggctgggtggtgtttctcatgggacacttggttgctacctctttctcacaatgagaaaatggtctgttgtcaggaatgagaatatcaagccaccttcacgtggagtgctcagaaaatcccacagcagtgccaccactccccacgcatgtcactctgctcagtggccactcaccagtcccatcaccgtctcctctgtacacccaccagcagcacagagtcacatgccccaggctgggccactcaggcagagacacgcagagagaccagtggctagactgagccctcggctgacagtgccctaaacaggccatggagaccccagtgctgctgcttcctgtcctgtcggggctggtgatggggcttgccctgtgagtttcagggactcagtctcttttaaactgaggggtaacagccatggagtaaaatgcacacagctcagcaggcagtgtggggaatttcacacatctgtgaccaccactctccctcagcattcccagcccccgacagggacacttaggcaccttcctggcactacccacccccaggcagagataccagcaccctcaccaccctcccagtagaacccttctgccagctctgctcttgaacttcacatagacacccgtgaggttcactagggaacattctccccactggggaagggtcccgaaggccaccgggagcccctgacctctccgagccttgttgtgggctgggcggaagcccacccttgctgcacccgcccaagcccccgggcctctgagcacagtgtcattgcccccatccgcaggccatctacaagatggtgtcgtctgtgatgaagatgccggaggatgagtccaccccggagaagcgcacagacaagatcttcaggcagatggacaccaacaatgacggtagtgcggggtgggggcggggctgcatgtgtacgccacggtaggggcaaaaccatgtggtttggggcaccccctcccctctgcagcttcttggtctcctgagggccacccccgcccgccacctgcctggcgcctgccatgcccagggaagagcgggatgcagtcagggacacccgtgctgtatcctggctcctctgtgcagctttgtgatgctgggcatgttgtggcctctctgagccactgtctccccacttatagaatcgggcatacccatattcccgtgggtacaatgtttaggggcagggaggcaagcatgctggtggccctgaacctggaggggttgagatcaaaggatcccagatgttggggtcctggggtgctggccatgcctctcttgctgccatcctgagagaagaagctgcccagatggccccagtgtccaaggggaactgtcaggatgtacgctgccaccttgtccacctacagcagctctgtggagactcagccccactgcagaagtgcaagtctcacgatggtgggtggcagcagtggtgacagggctgtgcctcgagtgccctcctctgcattggctgtgaggtgagggcggctgtgcggccctcccattctgctcttcttgccggctttgtcaagagcagccacagcaccaggtttgctttgcttttgagcaataaagaaacacgaccttaagaagagaaaatacaggctgggcgcagtggctcacgcctgtaatcccagcactttgggaggccgaggtgggcagatcacgaggtcaggagatcgagaccatcctggctaacacggtgaaaccccgtctctgctaaaaatacaaaaaaattagccaggcgtggtggcgggcgcctgtagtcccagctactcgggaggctgaggcaggagaatggtgtgaacccgggaggcagagcttgcagtgagccgagatcgcaccactgcactccagcctgggcgatagagtgagactccatctcaaaaaaataaagaggaaatactccctgggttgtgctggggattaaacgataagctaatgcccaagaagctgctctgcgaagtctggagtgcagccctcgggtgagttaagcatggccccagcgggagacgggatgtgggggagctgtaagcagcaaagagcattccaggcagccaggtcacagtttcaaaacacacacacacagaaaacaaggctgcctggtgcctggcgttgcctttgggctgatgggaaatgtgtgttccaccctccagcctagcagggcacctgctgccgctctcctgaggctgtccgctcctcgtggggatggtgaatccggtcccatggggttgtgaggtttcagcgagatgatgccttaaagcttttagcagggcttgcactccacaaataatggctgttgttcccaacttcacagtgtccctggggaagccacccatggtcactcgctgcccgaatctgcctcctggcttggccctgcccacctcttcagagggcatcttctaggttggttgggaatttggatggcatggtcgttgctaatgtgcctgctgggatggagcacttcctcctgtgagcccaggggacccgcctgtccctggagcttggggcaaggagggaagagtgataccaggaaggtggggctgcagccaggggccagagtcagttcagggagtggtcctcggccctcaaagctcctccggggactgctcaggagtgatggtgccctggagtttgccccaacttccctggccaccctggaaggtgcctggctgctccaggcctctaggctgggctgatgggtttctccaggacacaagtatcattaaagccaccctctcctcagcttgtcaggccgcacatgtgggacaggctgtgctcagcaaccccctcgcctgccctgccctccatcaggaggagccagtggaaccttcggaagctcccagcatctcagcagccctcagagtcgtcctggggcagctctggttctcctgactggaggtccatctgggctggcctgctctctctcggcctgagacaggagggcctggggtcaggaactggaagtggggaggctggggccgtggactctgaggccccacacctagccaaggagatgaccacacagctggctgccctgagtggtcagaggtggagggtggggagccactctctccattggcagaggttcctggggactgtctgctgagggcctggctgtccctccctctccctacccaccccttagcccgggcattgtttgggctctcttggggccagcaggctgcccaggccccagaggcatcaagttcgtgccctggaagaagccagcctgcccaagcctgggccagagtcccatgaggacaggtgtccctgcctgccagtgggctggaggggctgaattcccagcagggccctactgtgcaggggcatcctccgtcctggtgctggtctgagtcctcaaatgcatcctcccaggtgcctttgagatgggtgttcccattatcccaccttcgagacgaagatcctgagacctggaaacgttggtggcttgccatgcgccagagccgagagcccctcctgcatgccttcccctgtgctgggcctggctgcatgcgtctgtgttgcctgcacagacattttgcagggtgccctagtgattccagctgacagcacagagcctcaaacagacacatggaggggctgccccaggaccaggccgccaggacgcagccaacctcaaacctcatccttccccaccagctggagccagagggaccgcctcctgcccttgaggccatgtctgaacgggcagaatccttacagcctatcctgcttgtggactagcagagccagggctatagtgaccacagtgtgagctcattgacagcggttatgggatggggagcggagggtcagaaaacctcaccccacccagctcagccgatcagccttacggagccctgccctaggccacgagcctccagaggccactcagcccagtgtggagtcaccgagtctgtgtcctgggagagggaatatgttgtcaccagcattggatgcggaggatgagggggcagctgattccttagcacgaccaatctttttctaggttttcctctcaccgcatggggccaaaacagtacagagcatgagtttggtaccccaagcctgagcagcgggtctacgctgatgccagggaggatccggaccgtgcttccgggggcccccaaccagcatggccttctcagcctggattctgtatgggttagaggcaaatgcttcatttttctgcacagtgtacacgttccttaataagcgaagtgtggggtgatttctaaaaggatttaaatggccctcatcagccacgtcctgctgagcttgctgggtaagccctttgaggtacctgatgtattgcagggagcagggaaaggaaaaaggattttttttcagaaatgcctgtaaagtgaatggagactagacaccgtccagcttcaagaaggctcaggactttcaacaaagggagcatacctgacctgagagctgtccccatcctctctggaagcataaagaacagtgagcactggctaatcccattgtctctggtcccctgcaggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctga

SEQ ID NO: 1751 - DNA, 97455 bp, Homo sapiens
tatgctgtgttcggggctgtctgtcggcgccacagggaatgggggctggtgagtcgtgctcagaaggtcccagtctagatgcttctgacatggacaaaaggagaattcctgactttttggtggatgtttgcaattcccagaatgcttattcttatttagtcctcataggagagtggcgaagggcagcagctttggagcaagggccaccctgcccctccccaccaagccctgagtcgtctaaccttcccggtgtattagtcagctctggctgctggaaacggggtcatagtctgggtgccttaaacaacaggaattcttttttttttacagtattggaggctgatgtctgagacagggtggcggcagggttggtgtcacccgaggcctctctcctcggctccgtgtagccctttctccctctgttctcacacggccatccctccgagtgtgtctgagtcccagtctccttgtgaggacaccagccctagatcaggagccacgcagtgacctcattttaccttcatgacctcttcaaagtccctgtgtccaaatacagtcacatctggaggtagtaaggattggggcttccacataggggttttgtgggggacacactcagtccacgttaactcacttcctgcccacggcaggggctctctgtcagtgtgtctccgactgcggaccccgatcatctttgtgagaatgcaggttcccaggcccacaccgtgctggttgagtcagagcttctgggtgcagcctgggggtgcagcaagcccacccctgcattcggagagccttagcgggaagcctgttgcttgtgcctcctttgcagccccggcctctccagttctctgtgtcttgccatcttggcttcttcctcatcccgcctctcgctccatctcgtggcctcccatctgctctcccggctgcaggagcggtttctctaagccttgcaagtgaccgcaccctcttactgcatgcgggccttgccaagagcctgcagagggcggggcgggctctggggacagcctggactctcctgcctgcccccaggtgcccccggcccagccacagggtgctggctgcctgttactcagcacgtccgcctctcctgcctcctgagcccacaggcgcccttcctgtcacccgagcgccctctccttcctcacctcgccacctacgcatcgtcacccctcctcctgcgtttcctcctgtctccccggggagctcggagttctgcaggcacggggctggctcctttcttcatgtcccttgtcccacaggacaccgtttctgaacccaggagacactcaggaaaccttgctggtggaacggatgcagcagcgaggttttccggggcaggaacaccctcccaggagcttttccacggccaagcgctggctggtggtggagctgcgctgaagtcagtgtgtgctttgggcccagctgcactgtgcccggggtccagggatgggtgtgaggctgtctgccccccactgcacgcccggctgtcagaggcatctgtctcttcccccgcatgcatctttctccccgtctggcatggtgtttctagtcttttgtggatggggacataaacaagccgccatcaactgcttggtgacattggccaatcctgtggtggccccagctgggcttgctgcctgtgtgtggtgagggtgcccttcttgtcacccgttgtcatttacgagacagccctgtgtcacctgttgattcagagggagctctcctcatcacctgttgtcatttatgagccccgtgtcacctgttgttgcttcacagggagcactccttgtcacctattgtcatttatgagccccgtgtcacctgttgttgcttcacagggagcactccttgtcacccattgtcatttatgagccctgtgtcacttgttgcttcagagggagcgctccttgtcacccgttgtcaggtgtactcactttgcttctcccttcctgcttttggggacgatcacaggacagtggcttcagaggggaagtacctcgacctggctgaggtcatgcccagagcctgactgctctctccacccacccatgatcccgtcagcttcttccccctccttctccatctgatctgagcatttaccatttccttccatttaagcttcatttgagttgcatcatgatgttctccttttttcaaagttccatctgcccacaggtttccattttctctagaaccctcctccttcctctctagcccctggcccgcccctctgcggttctcaggaagcccctcggtgccccctgccccttatctagaacagcttctgcctagggtgggcaaggcagggtgggaggtggggggtagccgtgcagggaaggggtgaagcgggcccctgtactccctagctgggctgcaggcttggaggaaaataagagtcagacgcttgttaaaacagtgaggacagctttattcgaggaaaatgcagtcggggttgaccttatcagcaggggagagatcagcccaactcctaatacagcaaggaagggacagagctgggaagtggagtgggctgggtgagtggaaagtagctgcgagaagacatcacaggtagggggattcttgccaaaggcagggggggactttgatgtcaaaggtggggatgaggactgattggatctcaagggtggtcagatgtgaagggcgtgagaggctcactaaactgactaagcaggattcttgctgagactgggccaggcaggctgaagacaggaggcagaaagagggctcagaggagcctgagtgaagtttgatcttggggtgaggggtgcaggggggaggggcagggtgggtctttgttggggctctgtgggagatttcagggctcactggatgtgtggggcacagtgggccctgcctgagccccatgacgcctggacgctgccaccaggggcctgacctgctgacgatctctgcactgggtctttaatcagcctcttgggcattgtaaatgctagacaaagattcttctctttttaaagtttactaatttccctacgataaaactaatgcattttcacaggagagactcgggaaattaccaaggagcgtgaatcaggtggtcacagtgaattgtggatgtttgtgtctgtcttggggaactggtgtaacgtttctccatctgacccctgctgtctgttggaggtcaaggagccagcctggcctcacaacttcctcctttcagcaaagtcaggaggccattccctccagggatgggtgggctgcagcctcttggcacctctcgggatcctgctggcagatgtatcaccgtagcccaagccagcctaagccagcctcctgtggcccagcaccttctcttcccacgtgggcagctgtgttcccaggcaaaccttcctggaattgctctgtgctctcagagctggtgtgctttggtgttcagctgtggccattttggctttgagtttgatttgatttttgaagaaagtttttatttctttacccaaatattctatgtctctttggtaagactggaaaacacagaaaaacagagaaaaaaattcccccataactaccctgcccacctccatataacttttattagcattctgagctatacccctccagactcatttctgcctctccagaagtgtgcataaagtctagaaacataggtgaagagacctaatgccatcaagaacatcaacctgtaaaggaataaaataatgtcatctgtgtccagattttacagatgctttgtagatatgtgtaacagaaatgtgggtatgttttagcaaaaataagaccatatttttgttttattttgattgattgtactataaattccagtagagcattacagagccagcccaagcccatctctcctcttctctactcttttctttccccagtgaccaatagccactctgcggagggaagtagggatcatatttgtgcgcgttttacgctcttgctacacatgtgcgtaaccttaaacaaaacattagtttttatgtgttagaaatactcataaatggtggcccaggcatggtggctcacgcctgtaatcccagctcttcgggaggctgaggcaggaggaggcttgaggcctggaattcaagaccagcctgggcaacatagcaagaccctgttttgttttgttttgttttttaaacaaacaaaaaaaccaacaacagttaggtgggtgcagcatcatgtacctgtagtcccagctcttcaggaggctgaggtgggaggctctcctgagcccaggagtttggggtgatagtgagctgtggtcacaccactgtactccagcctggatgatggagtggagtgagaccttgtctttaaaaaaaaagaaaagaaaacagaaagaaatactcataaatggtatatatatatatcactttgtaatttgttcttgactactttgtcaacaatttttaagctgtatccatgttgatacatagatgtggttcatggtcttcttttttctcctttttgttaactgctgtatacaattccattgacttttttttgaggcagggtctcgctctgttacccaggctggagtgcagtggcacgatctcggctcattgcaacttccacctcccaggctcaagcaatcttcccacctcagcctcccaagtagctaggactacaggtacatgcctggctaatttttgtattttttatagagtcagggttttgccaagttgcccagcctggtcttgaactcctgagcgcaagtgagccacctgccttggcctcccaaattgctgggattacaggcgtgagccactgtgccagcccccattgtctaaataagccatcgtttctctagtcatatacagttaggtcacttccattttttcattagtataaagagtgccatatgaatattgatcctccttgagtgctgtggaaggaagcctctaagatgccgccactggtccccacatcctggtcttcacacccttgtgtaatcccttccctcgggtgttggctggacttaactgacttgattctaacaaatagaacacagcaggaggaatgggacatcacttctgacatcaggttataaaaagactgcagctgccagcttgggtgttctctgttgccctcttggattgccagccctggagggagccagatgccatgtctcaaggcagtcctgtggagaggcaggcctaggtgacaagggaccaaggcctgccaacagccatgtgagtgagcttggaagcagatctccatccgctccccactcccagctgagccttcggatgagactgctgccctgaaaacagcaaaggggaacctcatgagagaccttgagccagattcccagcccagagaaattgtgagataatgtttgttgttttcggctgctgacttttggagggtcatttgttacacggtaacagataaccaatacgagcacaccctgagaattccttagaggtctagaatatttagcagtggaattgccaggtgctatggtattctcacgctcaacagtactgtttattactaaattcatctccaaggcatttgtggcagtttcactcccctctacaagggtcagtgagctccttttcctcatacctctccggcacttgtgttgtcagactttaacatctgaacactctgatgggtgtaaaatagtatctcatgattatttgaatttgtacttccctaagttctagtgaagttggacatattttcgatacattattgtcctttctgctttcctctgctgtaaattaattgcatgttcgtatcctctgctgtaaattaattgcatgttcatatcctctgctgtaaattaattgcatgttcgtatcctctggtgtaaattaattgcatgttcatatcctctgctgtaaattaattgcatgtgcgtatcctctgctgtaaattaattgcatgtgcgtatcttctgctgtaaattaattgcatgttcgtatcctctgctgtaaattaattgcatgttcgtatcctctgctgtaaattaattgcatgtgcgtatcctctgctgtaaattaattgcatgtgcgtatcctctgctgtaaattaattgcatgttcatatcctttgtccagtctccttttgggtggattatctttttcttagtgatttgtagattttctttttttcactctagagactaatcctttgtcagttcatgctattttatactctgcttttttcagttagcagcgtattgagaatgttcttctatgccaatgtatacatcattttattgacattccattgtggagatgggtcatttatttatttaggtggacgtgtaggttgtttgcacttttgcattagtaggaacatgactgtgtgtcggtcagctgggctatgctctggtactaatgaccctccaaatcttagtggtttgcagcaatgaagaattctttgtccctcaagtgacatgaccatcacctgttggttgtggctctgctctatgacgttgtccctcagggagccaggctttcagagcagccccatctgagacattgctggtctcatggcagagggaaaaaagatggtggaacaacataattctatttctgtttttcctctttagagacaggatattgctgtggcacccaggctgcagtgctctggtgctatcatagctcactgcagccccggaatcatgggcacaagtggtcctcctgcctcagcttcccaagtagctgagactataggtatgcaccaccacacctgggtaatttttactttttatatttttcgtagagatgggggccttgttatgttgcccaggctggtcttgaactcctggcctcaagtgttcttcccaccgcagcctcccaaagtgctgggattacaggtgtgagccactggacccggcaggaacaatatacctcttaaagcttctgctcagacgtgggaatggctatgtggtgcgtgtcagttcccctcacattgcattggctgaagcaaaccctggggcccaaccagtgttggcggggttagaagtagacccctcccatagggaggccagggagggaggattttgagccaagaccactcaccacgtgctgtgatgagcagttgcctccccctcctttcgtgtcttcgtgcctcctcacgtattcttacaagtagaattgctacattaggaatatgcatatttgtaaagtatttactatttattatgtcagctaggttttaactgtcactgcatttgctgtgaattataggtaattattcatcctgatgaccatttaaaaaagaagaacaatattattaggtagaaatagtccctggctccccggttgcccaccgtgactataacagcatatctagcttggtagttttcaaattatttccacgttttatttacttctcacagcctccctgtggggttgcaggtgcttctccactcctccactgacaaggtgcctgaggctcagagaggctgagaaatgtgctctgggctgcacagctggggatgaggcgtagaccctggccctgctctgttctgggctctttctcctccactctggcctttggaggctgtggctaagatcttcccccagccccttccttcccaccttcccttcctgctcttgtgccccgtttttcacagtcctcagtggctggtttctcagtcccccaggaggtgcaggctggttcttaggaatggtctctgtcaatgttcccggcagtacctccgagcctgccctctgaggatgggtcggccatggctgcgccggcttagtctgtatttaggtatcactgactatcactggacttggggaggggatttactatttttagagaaagtcaggggagctccataaatcctgttagtcaacagaactgcagagaggtggctgtttatgaaggagagtgacttttttagaagtggcgcatttagaagaccacatattctatcattctgtgtacatgagcggtgcagaataggcaattctaaagagacagaaaatagattcgtgattgcagggagtggggaggagggatgggaagcgactcctaaggggcacggggtttcttctgggggtaatgaaaagcgttctggaattagatagtggtggtggctgtaggacctggtgaataataaactgaaaatcactgaatcgtaccccttaaaaacacacaaagcaaattgacaaattattgggaggcaacataagagaatggggtgtgaactttggatcagtgcggcctggatatcagctgtgtggtgttcaaatagattgcataacctcgttgagtctcagtcttcccatctgtgaagtagggatcattcctacttcgtagggttggcatgagactccgtgagatgaagttggtgggtcacttggctggggcaggtgtcacggagcgggacctgtgattgttcagccacctactctgtgcccagtgctgtgttggtgaccaggtatgtatgaagtcagtaagccacagtcctgagttatggtgcagaccccacatgcacccagagtcagcttggcaagaccccttgacaccacgtgcgtggagggtgcaggtcggagagctcacctccatggattccgtagagctttgaggcgtatccacaaagtgtccaggagaggtggcgtcgcctccacttgatagaggaaaaagcagagatggaggcagccagaagcatggtgcagtggtggggtttggtcattaatttgataatcacatggaatacaagctaatgtttattgagtacttactgcctgcctgctactgtaactaagtgctttactcctgttatctcatttaattctcaaagcagccctgtggcactgaggtggctggagatggagggatgtgtggctgccatgtgtttgccaggaagcagcaggatgggagtgagggcacagacagacacacatgccaggacttgtttgcacgaagctgaggaatgggtgcccatcattcattatactcatctctctgttttatgtatatttgaaaaaaaaattttttttgagatagggtctcgctgtgtcacccagactggagggcagtggcatgatctcggctcactgcaacctccacctcccgggttcaagtgattctcctgcctcagcctctggagtagctgggattacaggtgggcgccaccatgcccacctaatttttttttttttttgagacctgtcacccaggctggagtgcagtggtgcgatctcggctcactgcaacctccgcctcccgggtttaagcaattctctgcctcagcctccccagtagctgggattacaggcacatgccaccatgcccggctaatttttgtatttttagtagagacgggatttcatgcctgattaatttttttgtatttttagtagagacagagtttcactatgttggccaggctggtcttcaactcctgacctcaagtcatctgcctgccttggcctcccaaagtgttgggattacaggcgtgagccaccgcgcccagccatatttgaactcttttacagtaaaaagtttaaaaaacaacaatcctatgaggtaggtcctcttatttgtgctttacagatggggaaattgaggctcagagcatgtaagattacacagcaagattcggagatagctcgccatgttcatgcccggcaggacgtagcaacagggctggcgaaacggaggccccaggcttgtgggcctcctggggttcctgtgcgttgaggcctgagcccctgcgtgcgcccagcggagccagcactctccctgtggtcctactgggcatcacaggtgtgtatgtgaggggtatggggaggggattcttggttagtctgggcttcatgacattgggatgagttctttcacttggttttgttgatctggtaaaatctgtggtcctgtgatatcaccttgcttctcatagtatgagccttcaacatttggcctcagtggtggggtgtgcctgcaccgccttcccccatccctgcctcggctcctccccacaacaaagcggaaggaagacatagacccaagggtgcacttcagcccctcaaccagctgtgtggctttggagaagcggcttaacatctctgatcccagttacctttcttgaacgggaaagatatcaatgcttccttcactgattactggagcttcttggtgtgcagtgtctaggctgctttctaaccatgtaaggtgtagccacagtattgtaggacctgttgctaagaactgtgccactatcttgataaacatgttttccagggactggtggtggaatgttctagttattaatgtgcctttaacgttggatgactcagaatatccctcagatagtaggaataggtagctttgagaggtcatctgtaggagggcgcaggaacatcccaggagggggtgtcatacctgttggcaccatggggatgcaggctcagaggggactgaactttccagggccacgcagtctgtaagcggcagagctgggacgcaaccccaagcttgctgctctcaaagctttgctttcaaactctcacttcagacatcagggcttcctttcagactgagtcttatccctaagcactgttggagaagaaagtctccaggctgcagggccccgcagttcccccatatccctgcccttccagccagcccacgcctggggcctgtcctcccctgttcctgaatccctgtcctgttactgccctccgggtaagacagcactcttataatcatgcttcatgccgagttcatgaaattaactctcaaactcctcttctctgggttaaattatttcacttttttcccttcctcatagaatatcattataaattctagatactatattggatatgtaataaaatcagaataaattacatgtgatggccactgaactaacctcccttcatgtgtctggaggcaggttttctgtggagttatgctttaaattggctgtccttcgcgatttttcttaaagcctaggttgactactcaagggtctagatttatgatagaaactgtgggctggggtgcagtgctggggtgctggggtgcctgtaatcctagcactttgggaggctgaggtgggcggatcatttgagcccaggagtacaaaaccatcctgggcaacacggtgaaaccccatctctacaaaaaaatacaaaaattagccagacacggtggtgcatgcctgtactcgggagactgaagcgggaggatcacctgagcccaggaagtcgaggctgcagtgagtcatgattgcgccactgcactccagcctgggcaacagagcaagaccttatcttaaaagcaacaacaacaacaacaaattgtggcacaaatgtatgcatggaggtactgagggccttctttatagtaggctcaggaatgaccaatgggtgggggctttgggggaagagacgggggtctttaagcagaaactctcccctcaacacaagaaagctgctgaaggacttcagaaacctaaacacgagccgtgggcctttctaaagtggggagggattccctcctgcctaggttatgttgcaaggctgcccgagagagggtggaagggggcaggagagtgggcattggctgggtccaacgcttcccaagagatgtgactgtcttaaaagcaataccttcctgattaccacgggaaaaattcaaatgttttgaaaagatctacaagtttggggttgaagaagtcctttatttcaaagtttctctgggctgggcgtgctggctcacacgtgtaatcccagcactttaggaggctaaagtgggaggatcacttgaggattgctttgaggccagcctgggcaacatagtgagactctgtctctagataaagttttttttttttttttaaattagccagatgtggtggtggtgtgctcctgtagtcccagctacttgggaggctaagttggaaggatgacttgagcccaggaggttgaggctacagtgagctctgattgtgccgctgtgctccagcctggtgacagagtggaccttgtctgtaaaaataataataataataataaagctttgctccccgtttcatttagatggagcgtttgtgggatttaagacagatttttccttgctgagtggttatcattaacctgttgaataagcaacaggccgaggtggggaccctgcctcgcccgcctccaggggcacactgcattctttgtggaagtgtccctggaatgccacagccctgcttctgtgcgaggccagtcagtctgggtcctgggatatagccacatgtgcagtccgtgcctccagcgcgcagcctgaaagggaggcgtgcagaaacaacgtagctccaaggaggactgatcagcccagcctgggggagggtgggaggggactcccagggagcggggcttgtgctggactttgcaggatgccagacttttggcaggggaggaaattgaggtgaaagcattccaggcctagggaacagcatgtgcagaggtgctggctggaggaaccccgtgtgtttgcactgtgctctgagctccctctcatgactctcattctttctcgttgagttttgttttgtcacccagccggactcctgggcaaagagaggcacaatctgttcccggttgggccagctgccctccagtagctacgcaggatgctctggccggcctctgaggattctcttcttctgtccatctcatggctgaagaccaaggctatggcctgtgggtggcagttggtacctctccccgctgccttcccccggcccctttttggacaggatgttgctccctggggcctggctttggagatggccagtgctggtttgaagcttctgtcttctgtgtgggatatcagtgccctgccagctgttgcaagttttaaactcaatgtgcctctggatgtgtgtgtagagtaggggtccttccccagctccaggccctgtgtgtttccaagtgggcccgcagctctgatgtgcagtgggtatgcactggcaagccgtgcactgtcacaatattaaaataacttccatggtagttggtaaatagccccatcacccctctcctgggaccctggacctctagcacaccatggaggcctgccccgtccccataaaacacaccacattcaaattacttatctcctcttcccctgccactctgctgagaaggctgatctcaatcctcggagtaatgactctcttctaggagcaagatgatgctaattctcactagcatgtgaaggactgatagcaccatatctccctccaggactcccgggtgggaggtgggtgtttgcataggcaggcaggtgagccagcctagtttgtccacagacttccatgcaagtgattcctgctgttccctgggtcttcctttcttttgcttctgaacttggaggtttcttgaagtctggaggatttttagggtgggcatggctttaggtgggacctccactatatgggtttgcaagctgccactgctttgactgcagacactggattgaccgtggccaatgccaagtccaagagatcaggctgaaaccaggctaaattttaagagcagaaacaaaactcatccttgcgaagggacttttagatcagtggcagatggcatagaaagtctttctgctgttctcttgtgctgggcgtggctcagggctgaggggagagaggagagatgagggcagaaagagaagagggggcaggcctcagggatgaacacatggcccatggctgtgcgcttcccaagcaagcagttctggagtgaggcttgggcctccatgcctcctgggaggctgcacctcttgggatatagagaacgctggcttcagacccggcaggagtaccggcggctgtgtggtgcatcctgcacagagctgttgctttctaactgggttactgagctgtcgaaggagcagggatgaagactcccttattaaaaactaaacaaaacacaacacgaaaaagccagaacaaaacaagcagacggttgaggactgcagtgaactcattaaccctacagctttgatctcgaagtctcggccgctcctggctcagaggaccctggggacgtggtctttgatgcttgctttccccataggcatcacttcgaccagcgtctgtgtggggtgtgcagcagccctgagccaaggattaattacgtaacaagcccagatcccatccctgcctgagcaggccatgtgccagcaaggggggccccgaagtgccgctaggtgcctcacgattagcataaggcccgtttatccaggaagccagaaccagtgcacatctgttaagcgcatgcaccaagcggcgattccatagttgtatagtgattgtctttatggaactccagaatagcttcttagatatcactcttcaggccctgaaatggagccctgtgcaaagaaatgaagaaaagctatcggggcatctgcagccactattataccatctggcagctcagaaatattttataatcaaatgagtaagacgggcgtcccacactccacagtactctgctcccccttcccttcctcccaggacttgctctgtctctgtctctttctctgtgtctgtctgtctgtctctatgtgtctgtttctctctccctctttctgtgtgtgtctctctctgtgcctgactttctgtctctttctgcttctctctctgtgtctgtctctgtctctctctttctgtgtgtgtctctctctgtgcctttcagtctctttctgcctctctctatgtgtccgtttctctttctctctgtgtgtctctctctctgtgcctttcagtctctttctgcctctctctatgtgtccatctctctctctttttctgtgtgtctctctctctgtgcctttcagtctctttctgcctctctctatgtgtctgtttctctctctctctctttctgtctctctctgtgcctgtcttgcagtctctttctgcctctctctgtgtgtctgtctctgtctctgtatgtgtctgtctctgtttctgtctgtcttgctctctctgtttcaatctctctatctctgtgcctgcctgtctgtctgtctctttctttctgtctctctgtgtgtgtctctctctccgtctttgggacagactagaggaacctttttcccaggagtgataatactgtactctgcgtttttgccacttgctagctgggtgaccttgggcggctttcaagttcccttatcctgggtttcttcatttgtaaaatggaagcactacttcacagtgctgttgtgtgggtcaagatgagatgaatgtgacctactgtggtactatttattatttgtcctagaaaaacttttttttttttttgagacagggtcttgctgtcacccaggctggagtggtggcacaatcttggcctactgcaaccttgacttcccaggcccaagcgattctcccacctcagcctcccaagaagctgggactacaggtgtgagccaccacacccagctaatttttgtattttttgtagagacagggtcttgctatgctgcctgggctggtctcgaactcttgggcttaagcgatcctctcacttcagcctcccaaagtgctaggattataggcataagccactgcacccatccagaaaaacttttaaaaattttgtgttttaactttttctgaatataaaagtgatacatgcatgttcactgtaaaatagaaaatataaagaaactagaaaactatttatgacgcccctcccccaccacaaaaggggcaaggactgcgaacttttgccgtattttggaagatttcctaagtcacacaagcacacagatggtctgttgatccaaaccaggaagaacaattgtgggaataagtggaagtgtgagtgtgtgggtgtgtctgagtgtgtgccctgggggtgtgtgtgtctgtgtatgtgtgagagagccaggctgtgtgtgtgtgtgtatgcatgcaaacacttatgtgcaatgccttggggtcctcagaccccccttggtccatcaggggctggtggcctcccagtaggacactagcacagctgcactcatgtccttctttgagggggggtgacggggagaaagttggggagcagcagtgactgctgatgttgtgggggccatggggagcctcctggtattctgtctcgaggctctggggatatggtgggagaagccctcatgccagaattgggaggggatggaatgggactgaccccatcacagcccacgtgcctcattcagggcttggctgtggagtcttgggggaggtgctccctcatcctcaaatgttaactttgtctgcctggccccagtcccctctgtggcttttttcctctttcaattgggaggcagttctgtcttaaagagatgtttaaccctctaggtctccgtgcaggcatttttgttgtgagccagtcaggctataaatggtccattaaaagcactgtccagttgacataaccggtctaccaggctgagacccacagacccgggactggcatttatttatggatatgatgtgcaaggagagtgttttccagtagcaggcgttggcatcatcaaacagaatgaagtgtactgtgttttcaccatgatagtacaaaaacgagactgtgagagcttctcacttctctccccttcctccccttccttctccatgtctttgtgctcctccactgctccctccccagcacagacaggccctggctccctccccccaccctcttccttctctctccttctaactggggtcaggaccaccctggaggatgttagattttaaacatttgttcctcttgtcatccccaccaccccacccacccacccagattagtttctaagggatttatatttgtttgcagagtggtgcgaactgttttcatcctcagaggagcagagtgctcatagatgagtttgacattactgggattcactttcagaagtctctagagagccccgcaccgcccccgccccccgcaggtgctggagttcagcctgacacacaggccggcctcagtgagagggagtgtctgcctccctggcatccgtgacccatacggtgggcgcctgttctttagaacaacttgctccttccgtcgttggcttggtcacccagcccccggcccacccttttctgagcctgtcatccacaccaggcagagccctgtctcagagtctcatggggagcagggccttcagggaaggcccatgtgctgggactgacttggctcacaggaatttcctgatggtataaaatgtgccccccagcgcctgataatggtcacttcgcctaagttccagccccagatgtggaccacggtggggcaaaggtgggcgtggggaggaggaaagaggtttaaaatggccacacccactacttctcctttggaagtgcctcctgccaccctggggtcccaggagctgatctgtgggtgtctgtcctcagcacccaccctgcttttccttcaggccccgctctggctgtctgggcctttctggtgctgttcctcacaggtttaaacactccagcagcagcctttcccatggcactgtgtctgcggggcggggttgggcattttctgaggcttcctgtgtttcacggggatccagtatgaagcctggcacggagtatgggccaaatcggtttaatgtttagctccccaaacccttcacttctgtgtcctcattaattcagacaaggttgggtttagcaaactgtgtctcaaacataagaaaatgcagcgtgggaatgggggaggggaggagtgctgtagaaggaccatttcagaagccctggtttacaggagaaagattggtatcttcataagtcactcttaagcttgcatttgttcatgctttaacacagtgattagatacctactgtaagcctagcatggtggggatataaaagcaagatcaagttcaagggggcagggatttagggtcagtgagacggacctcttaatcacttattttgtacacatcagagcagtgacattgtgtttctttaaaaatactaggggccagcccgggcacagtggctcatgcctgtaatcccagcactttgggaggccaaggtgggcagttcacctaagatcaggagttcaagaccagcctgccaacatggtgaaacctcatctctactaaaaatacaaaaattagctgggcatggtggtacacacctgtaatcccagctactcgggaggctgaggcaggagaatcacttgaactcaagaggcggaggttgcagtgagccgagatcgctccactgcactccagcctgcacgacagagcaagactccatctcaaaaaacaaaaaacaacaacagaaaaaactctgggccagctgtggtggttcacacctgtaatcccagtgctttgggagaccaaggtggggggatcgcttgagcccaggagtatttgcccagcctgggtagcatagcaagatcctgtctctacaaaaaaaaaaaaatatatatatatataaattagccaggcagggtgatgtgcatctacagtcccagctacttgggaggctgaggtgggaagatcacttgagcccaggagtctgaggctgcaatgggctctgatcccaccactgcactccagcctgagcgacagagtgagactctgtctcaagaaacaaaacaaaactctggattctggccttctcctgggaaatccagatttgtctggtatgatgttcgttgaacccatttagtccagcagcctggctttccaaaagtatgtctgcctctcacggtgcccagtagctttaaccaaagagctcaggaaagggcctgtctgaattcaatcacattcagcatctatttcagcgttttactagctttcaattaaagtagccacgcatttgagcctgatggtcttattgttttatgttgttccttttgcacatttcctgcttgtttatctttgtggcacaggggcatgttcttggctgcagttaacaatgctggccacggcagtgcagcgtttccaaatttcttccctttattaacaggcggtaatggaatctgaatcttcaaaaataaattttacatacttgttctctaccataaaagtcatccatacttattagaacgtctcaaacatactaagaggtaagaaggagacaaaaaataatattttgtcacccctgcccaggtagccactcttctatttgagtgcttgtaagaagcctgcttttccagtattatctgacctggcagggagttgggtaattgaaaaagattattaaagaggggatcataaaaatgatatagacgccgggcacggtggctcacacctgtaatcgcagcactttgggaggctgaggcgggtggatcatgaggtcaggagagaccatcctggctaacacggtgaaaccctgtctctactaaatatacaaaaaattagctgggcgtggtggcgggcacctgtagtcccagctactcaggaggctgaggcaggagaatggcgtgaacctgggaggcggagcttgcagtgatccgagatcatgccactgcactccagcctgggtgacagagcaagactctgtctcaaaaaaaaaaaaaaaaaaaaaaaaaaaaaaaaaaaaagatatagacatattgagcatttcgttttgacataaaacgtttcattttcatataaaaatgcatttattccccatctcttgatacagggccaagacctctcttggattatgggtccactggcttctgtcctgatatgtcttttttgcactatccacactgttaatgcattttctgagattctcagtttctgtttctgtcaagtaatgtaggaactagcaccaaatccttgccgatttcatataccactgatattatacagttattttgttcatgcctaattgaacagccatcttcccccaaacattcaactctgtttcataaaaccaactccttttaattcctcttctgagggtttgcataaaatttaattaactttggtaattacataagtactactggtataagcaggtttggaaacaaacgtaactgagtcttggtgggctcagagtgcacctgcccgaaggttcccacatgctctatgcacccagaaggggacagagcatgccccatagtccaggggcaattaggggaagcagctaatgaagtctgctttcttctggccttttaaaaatctatgtccttttttttttttttttttgaggcagggtcttgctctgttgcccaggctggagtgcagtggcatgatcatggcttactgcttcttgggctcaagcaatccccccacctcagcctcctgagtaggtgggactattaggtgcatgccaccatgcctggctaatttttgtattttttgtagagacaggatctcaccatattgccttggctggtctcgaactcctgggctcaagcgatccatctgcctcagcctcccaagtgctagtaagccaccacacccagccaaaatttaaaacacctgtgcctcaaagaataccgtcaagaaagtgaagagacagctcacagaataggagaaaatatttgcgaattgtatagattctagacttgcatctagaatatataaagaactcttacaactcaataatacaagacaacccagttaaaaaatgggcaagggacttgaatagacgtttctccaaagatatacaagtggccaagaagcacatgacaagatgctcaacatcattagtcacgagggaaatgcacatgaaaacaacagcgatatatccagtaagactgctagaatcaaaaagtcctataaactccagcggagatgaggaaatggagaaggtggaaccctcatacgctgttggtaggatgaaaatggtgcagcctcttcagaaaacagcctggcagttcctcaaaagcttaaatctagagttaccatatgacctagcagttgtactcctaggcatataagaatgaaagagaaatgaaaacttacacataaatgtttacagcagcattattcacagcagccagaaagtgaaaatgaccaaaatgtccatcaactgatgaatggataaacaaaatgtagtctatccatacaatggaatatcactgagcagtaaaaggaatgaagttgagattcatgctacaacatggaccaaccttgaaaagatatgctaagtgaatgaagccagtcacaaaagaccacatataatacgattccatctatgtgaaatgtccagaataggcaaatctgtagagacagaaagcagattagttgttgcctggggctgggactgggaggctgaggggaaatggggagtggcagtgaatgggtacatggtttcttttggggaagataaaaatgttctggtcaggtgccatggctcatgccaataatcattgcactttgggaggctgagtcaggaggactgcttgagctcaggagttccagatcagcctgggcaacatggcgagacctctgtctctactaaaaagaaaaaaattagccaggtgtggtggtgtgtgcctgtggtcccagctacttgggaggctgaggtgggaagattgtttgagcccaggaggttgaggttgcagtgagccatgatcgtgccactgcactccagcctgggtgacagagcaacaccctgtctcaaatataaaacaaacaaacaaataaagggcaaaattctccctgtctgaaaaagggggcagtgattctttacaaaattgatcatggtgataagcgatggttgcacagttgtgtcaccattgagttccttccttccttccttctttctttctttctttttttttttttgacggagtctcactcttgcccaggctggagtgcagtggcgcgatctcagctcactgcaacctccacctcctgggttcaagagattctcatgcctcaacctcccaagtagctgggattacaggtgcgtaccaccacacctggctaatttttgtatttttagtagagaaggagttttgccttattggccaggctggtcgcaaactcctgacctcaagtgatccatctgcctcagtctcccaaagtgctgggattacacagccaaccattgaatttaaatatgtgaattgtatggtgtgtgaaccgcaagtgttctgcctatccatatacctcccactcaccttccctctccccatctcactgttctggtgagggaggttcttgctttcctttcgcctgtttgggacctcacttcctttttcccttccccatccctttgtagccccttctcaagagagagaagacaccttgattcccacctacgctctgctaaaacttttccgttctagtcttaaatctctctctcttaagaactgatttcccagtagggtttatgtttggagctaaattagtcctcctggaagcagttgacttcatcctccagcagctgtgccatcagcagaggccatgcatgctggggcaagatccaggcctatctcttcctctgcagtcccctggggacgtctgggatctggttccttggttgggccacgcttagctctccttcgcatgggtgtctcaatgccagggtgtcaggagagctacagtagccagctcaggcccccccagggagagctggggagggagctgagggcctggtgccccccatcaggagggacctttggagtctttcttggctctgcccaggccttctgagcacacagagatcactccagccctctgccctctctgtagccaaatgaaaagactcttctagtctttctggccaactagtaagctctttgaaggtgggtaccattcttgacattagaaaaaactcagagccgtttggatactgaatatttttgacatgctctggtcactgaacgagaagactcttcatgaaaatgatgctttgtcagctctgtagagaaaggcgattggaattttggttgaccaggttagggtaagggaagaatgaatccccagtgtcctaagctggcaggcagtcgtgccgatgcagttctcatttctgctgtcaatttgccaggagactcagaaaaaggccgctatgcctttctgcacctcagtttcctcatctgtcaaatgggcagtgttttgggcgtgctgggcacaggtttgtctgagaaccagctgaggcctgtgttgcgcatgggacctactattattctttataatattaataccaaggacatttaacacctgcaacaacaagaacaagcacagtctcagaaggaaagcccgtcctctaaaagagtgtctgtagagcagagaagcccccagtgccatccttctctttctgccaagctcctgtgccagtgctgtcgtggggggccctgcctgcaggtgtggggatactggttcagggccagtggcccctggcaactggtttgtcttttagagaaggcaggactgaaatgatcagctttccatgtagggccagactctgggcaggtttctttttaaattttttaaatttttttgagacaggatcttgctctctcacccaggctggagtgcagtgacatgatcagggctcactgcagccttgacttcccaggctcaagcaatcctcctgcctcagcctccccaggtagctgggattataggcgtgtgccgctatgcccggctaatttttttgagttttagtagacgaggtctcactatgttgcccagattggtcttgaactcttggacaatcttcccacctcagcctcccaaagttctgggattacaggcgtgagccaccacacctggtctcaaataaaattttattggaacagctacactcatttgctttatgtcattgtgtccggctgccctcatgcagcaggcagagatctgctgacccctggtctagaatgtggaatgctggatccctgggttgagggactattttaatggtaagtacccatatttagatcttttttactgtggttttgtgatgtgatctgtcatctcctctgggcttgcatttctccagtgacaaggcgctcactcctcccacggcgatgcattccagccgtcgaattatgtagttctactgcttaatccttccttaacttgctcttcctgaagcctcaactcactcatcttctttctcaacccctcaggcccagcagaagtcctctctgtcttctccaggcgcagcccttcagccatgcaatcctgcgtgtcctcgttcttcattccacaaatacgttctaagggcctcctgcatttcaggcacttcagaggaccttctggaagcttcccagggcctgctatcttccctgtactgtaaggggacactttgctcaactgttcacttgaacagagtcttcaatgtcttctagtgaattctgggctgaaaccaatgtcgacttggccaaattaaggccacggtcttggtcagccaccttccaggttgacttgccagggtgtcctgggttggtttgttttacagaagcagagctcccagggctcatcgcacagccatggccgaggtgtcgggactcaaattccgggcccttggctgtgcttctcacattctttccattgtccgacgcactgaggcagagacaggaattttaactactcaaaaactactgtttacgtattttactttgacttctttctgggttcttgcataggcttcaaggagggaggatatggatgtgagcttattgtacaaatgccctgggttttccaaacgtgtctgatcttaaatacacagccctgcgtgctgaccttgtgttagaacttaatgatgcgacgtttgctttgcaaactgtggtcccctcctcatagatccttcaattcaacaattgaattcaacaagcccctgggcacccaccgtgcaccaggcactgtgttaggtgctgcagagatgaagatgaggaggatgatggcctgtgcccaggcaggtaacagactagcagaaggacaggaagcaaagtgggcatgtgtaccatgtgtttaaagcctgagggaacagctggtaggatcctcctggggctaggtggtggcagcagcaaagagaggggacatttgaattgggctttgaagggtgcataagagtttaacggggccgggcgcggtggctcacgcctgtaatcccagcactttgggaggccgaggcgggcggatcacgaggtcaggagatcgagaccatcctggctaaaacggggaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaagagtttaacgggacagccacaccactgatcactcagaagtaggtgggttgtgaatcttcagcattctggaaaatgtaaaaagttgttcagtgggcagcagtaaagagggtttcgttttcctggagacactgttgctactttgctggcttatacagggacacccagagagcggctgggaaaatcaagaactgtgtcacctcctccgttcttgcccactgtccagggctcaaggagattggggagcagtttgcaaaggcatttgaagattaggctccacagagatggacactttttttttttcctaaatagatacagagtagccttgtgaaggtttcttttgggtctgagtaggggacgcacagggcatggctatgagggtctcagaaactggtacctactttcctcttatttggcaccgggagcccctgccggaggacatgttctagtgacagccctgggctcaggcttggagagtgcattctcttccccaggaacgctagtcacagctcagtaattcaccccagggaccgcacagagcaggtgggatggtattgatttgtgggccttttggcaaaacatactcattcctaactggcgagggaaccgccagttcatttattcatttactcttctgagtccagcaacaaccttaagaggcaggtgttacctctggtttctgtttaaactgatggccagcaaggtagggcaatttgcctaaggacacgcagctcctaagctactaaacctcccgctcgcctggaagagaagacaggacgggcctatagtgaatcatgagtgcagcatgagagtgttaaaggtcacaggacgcctcttagtgccaagggagttcatagtggagaccccttttgcctgagggactggggaggtggtagttttgaactgggacttgaaggacagactggggtaaaagcaagaggagaagcttgagggaggacggtgtgtgccaggacggtgggactcagagggtggtggggggcacatccactgtccccttccatcctgcagccactccctgaggtggcatttccttgaatgacaggagaggagcctgaggcacgggaagattaagtaaccggtcctacgtataaggtggcatttgaacccaggtctacctggctccatagccaggccccgtgccccacacaccacaccacctggcgcttggccaacaggaaatcacgtcccccagtgtgtaagtcagggaggcagaggtgctgagatgctctcacctgtgggctcccgggcccagccatgctcttggtgttccctcaggccctggcttcccccctccctccaggtggacccatgcttgtgcccctgtgcattctcccacagactcctccctgcggggccacccatctccaaatcccagctgcatatccacaactgtagagtgttttaaaatagtgatggtagcctaggcaacatagcaagaccccattacccccaaaaatacaaaattagctaggcgtggtggcacatgcctgtagtcccagctacttgggaggctgaggtgggaggataccttgagcccaggaggttgaggctgcagtgagctatgattgcaccactgcactccagcctgggtgacacagcgagactctgtgtctaaaaaaaaagatggtgatgctgtccaggcttgacgtaggagccttccgttcctcctcagggcctgtgctctccttttgaggaacagcctccttttagtaaatgtgagggtggctgaggtgggacatgagaggcttgcagtacccaccaagccaggccagccacatggccttctcaactcctggcccagcccaggttgtcagctctctcaggttttgctctttctcctgcgtgctttccccgtgttcttctgcactgttatctttcctcttcatctgaggccatgtctttaccttatgtggtgctgatgtgggccagggaagctgtggcaggggcccgggaaccaccccagggggatgcagagggagtggaccctgtggggctcggccatggcagaattctgctctgattggctttagatcgtcgcctgtgacagcgtttcctccgcggagtgtgttaggaagagcagaaatgcctcctgcatctttattagatccctccaaatggaaatccagcagaaagccgatgttcttgtaaatatcacgacctccctccccatgaggtgtttgtagaacagttatttactcgttttgttttccccacctgcagtttacagaagaaaatcaagaaagcgtgtttttcctccatgcataatcccatccccgactgtaacaacaacaaaaccgtcctcctgttaggaagcagcagtgacttctttaggcaggaaaaaaaaaaaagcgtgctatgccagaaagcaggagcagctgggaagggagagggagggggccacacctggcctacccccagtcaccttttacccagggatcccctgaggaaaacaagctgtgaccttgagccggcaccagccccagggctgaaaccccagccctgtctgaagggttcctttcccgtgtccaccacggccccgtgctgtatagcagccccggtggaaagcctctttctcctgtacctggaggagttgctggaagaaggagaaggctcagcaccagcttctggctaaaatcgtggccgatggctggatgattccggccccactttaataaacaggatagatgtgcggtaacatcaggttgtcaggccctattttgtgatagaaaggatgaggagggaaacaagcacaaatcagtagtgtcacaatctcaaccacttcttccattttcgttaatagaatcggagtctcactatgttgtccagactggtcctgaactcccagctgatacggaagtggggcagggaagtgctgggaggagaagggcgggtccctgtcgagggctccacccctgggcccatgcccacagccctaggtgaggacagacactcctgcctttacacccaaatgctgcatttcccaagaccaccctggcccaccacactcccatcctgtgcctataaaaaccgcgagagcctagcaggcacacacagaagcggctggacattgagaggaacacgtgggtggaagaagacacacgtggctggatatcaagaggacgtcgggggaacatgccctggggaagagcacacaacagatgccggcacgctggcaggccactgaccagcagaatgccccggagtttggctggggcggtcggagaagagtcaggaaaaccatctcccttctggctcccccatctgctgggtgagctcaataaaaccttgcactcattctccaagcccacgtgtgatcttctggtacaccaaggcaggaaccagggatacagaaagtcctctgtccttatgataaggcaggggtataattgagctgactaacacaagctgcctacggatggcaaactaaaagagcaccctgaatgcccaccggggcttcagctgtaaacattcactcctagacactaccatggggttggagccccacagcctgcccgtctgcatgctccccttgaggtttgacccgtctgcatgctcccctcgaggtttgacccgtctgcatgctcccctagaggtttgagcagcgggacactgacgaagcgagccatacccccatcacatgccctttgagggggaaaagggaacctttcccgtttcacagccacagtttcctgctgttttctgaaattcctggtggccactcccttggtgtccatgggtgtctggtgtgtgcctatgtttgctgcgggctggctcggcgagggggaggtgggcagctgggggctctctggaccctgcggctggcatgggttagtggctccgtgtcacctggttcctctcacctctgttttcccttctagcccctgcaggcaggagacttcaacgcagagattaagaagttgagatgtctttgttcccagaggaaagtccctgcaggccccggcctcatggcctctgtgacagcagcaggattagaggcagagttggcccagagggaacatttctcccaccctctgtccctcggggaccccacttcccaggtggcctggaggatgaagtcagggctctggcctcattgagggcctggaactctttagagcccatcaggaccaagctctggtggccttccaggcccactcagtggctggcggtcccacctccaaatgcaggcagaccacactccctgaagggcagtggcaaggccaggccagcacctctccactctgaggaaggggccttacccagatccccgtgtcccccacagcggtggcggttttattgatgtattgtgaaggcacagggagggccctttccagagcaggctgcatctcccctcagcttccacactctgaacctgcctcctgcctccttccacagtgcccgccgggtccacagcgcccgccgggtccacagcgcccgccgggtccacagcgcccaccaggtttgatgtgggctgagcacaccgtcactaactcattccttcattcattcttcactgtgtggggtgtcgggacccagcacgggctcctggcgcagcaggcctcagaccctggggagagctttgctggaggaagtgcagtgccaaggacccatgtcctcattccccctgggtagagcgtgtcgggtgactctgctgcggtctccaggagctggcaagggaggggtgcaccaccagggaagggaattccaggcagcaggcaccaggagcctcatccaagagaaagagaagttccctagactcccaggcagggtgagccgaagggccttggagagtccctgaggtcccgtttcatgggagacttctctcacaaagcgaatgagctcaaatacggaagatggagaaatggaaaacagaaacagaacagaacctccacctgctgggtagatgttaactgaatcttttttttttttgagatggaatcttgctctgtcacccaggctggagtgcagtggcacgatctctgttcactgtaacctctgccttacgggttcaagcgattctcatgcctcagcctccccagtagccaggattccaggcacccgccaccacacctggcaaaatttttgtatttttagtagagacaggatttcaccattctggccaggctggtctgaaactcctgacctcgggtgatccgcccacctgggcctcccaaagtgctggcttgagccaccatgccgcccggccttacctgaatcttatcacacattcctttggaaaatgaatctcctgtgatgggaaaccagccattttcctggtgaggcctcagccctgtagccattccagcatagttaacctgggactctcttctcctctcttgtctctcctcttcctcctatctggcctgcttgctccatcctcccctgctttctgtctctctcctcaccacgtgcctttggatgttctgaatatgcttttgtttgcctgtccagcagtattctctccacggtctcctcctgggtgtctggcgtgtgccttgcgtgtgctgcgggctgggatctgtgggaatgacatagtcggacatggtcctgagcctgttggcctggggactccttttctgtcatactagatgagacaggcgagactgccctggaaagcccggcgtgtctggcctccccagtgctggacggtggccagtgtggttttccaggcgagtccgtgggctcctgggtgggtggtcgggctcgtggggagatcccaagcaatggttgtagagggatgggagggaatgggtggatcccagagagagagagagagagagagcaggctggttccactgtggcctcgttgtctaatgaggagagtgtacagataagtcatgctttgttttgctctgtctctggaattttaatcagttgccctaattgccttcaaattattggaagggaaaaacgccagcagagggtcctgacagatcccagctgtctagctgaggacttatcttctcattgttcttgggaaaccagtcaggtttagggacttgaggtggatgattcattaattcttttaaactgatttcctcagccatgtacacaggtgtgaaagcccttcttatgttatcagtattaccctaatatatcagagggctaggatttctcataaggcgactgttatcttttgataatcacataaataacgtttccatagttctcgaaagcttgccagatgctttcatgtacattagctaacttcttaaatttttttttttttttttgagatagggtctcactcttgtcaaccaggatggagtgcagtggcatgatctctgctcactgcaacctctgcctcccaggttcaagcaattttcctgcttcggcttcctgagtagctgggattataggcgcccgccaccatgcctgcctaatttttgtatttttaatagagatggtgtttcatcatgttggcctcagactcctgacctcaagtgatccatctgcctcagcctcccaaagtgttgggattacaggcatgagctgccatgtgtggctgacattagctaatttaattcttacaataatcttatgaattgggattctcatctcttttaaaatgaggaaactgaggctcagagaggttaagtcatgtgcccaagatcacttagctagtaagtgatgggcagggctgtggagctggttcacttgactctgctgccattgcatccagtttgctctgccagcgagtcaattgagcatttggagcatttgctgtgtgccagcctcatggaggcaaacggagcttcggaacccaggtgtcgagaatgagctgttggcactcagtcctggagtggcagcatggggggcgggggcaggagcatgggggacaacagtccagggagggccacatgacagcaagcagagcctcgaatgcctgagtcctggctccagagagaggccagcctgagctcctccatgtcctactcctgtggatagaccccccggaatgcagggggccgggctgagcaagaggaggagaggacagggaaggaacatgtctgcttctttccttcaggaaaggaaaggtgagctgggcgatggggaaggcctccacggtgttctgttgtaatgttctgccacttggcagcctcaccagggacatatcagccccaggctgattatctgcagaccgggatcccatttctgctgctttgggagagaagggagggtagccctgaggccatcccaaatgcgagtctgttcacagaggggctctcctggcaccttccccagcccagacgctgaggagggcagccagaagcccctgcatcaggtaggagtgctgagtcatgagattgggttgaatggcggctttagcacagctgtggcctgtgttagagagggtgagtttggaccattcctgagcagagggggacctcagaggacagtcggactggggaatccctggcccagagagggaaactggttttcccagagtcacacagctaggtgcccctttgatggttctctcagtgactcacgcctgtaatctcagcattttgggaggccaaggtgggaggattacttgagcctaggaggttgaggctgcagtgaaccatgatcataccactgcattccagcctggccaacagagcaagaccttgtctcaaaaagtaaataaaaaataaaacccattctcactctaacccatgctgtatctgatttttttcctgaggtaggcttgagatgggagggttgttattttttgtaaatgcattaggggcggagtggtgggagagtgattcccctgcagcccttctgaggtcactgccacaccatggcaagaaaagtatttctgactcctggagctccacggtgtgacaggtgggcaggagctgctgggggtgctgggcagacgtttaccgtccagcacccccatttctgctgctctgataacttggatcgactgaagaacctcggggctttcttggctgtttgtaggagcttccagaagcgacctttcgggatgcctcttacatagtcctgcctataccctctacacgtggcgtttcaggtctggagagtcatgtggtgtagctgtatttctgggaagtgtgtgacccgaagcctcctcctgtcagaaccaccggggagctcacaagctaaagtgcagattcctgggtcatcccagacctgctgaagccaaatctttagggtggggccaggaatctgcattttaaacaagctccggaggtggctctgaggccagccacagtttgggcacggcaaggctggggagccaggcttgtttcggatctccagtccttgtgtgggctgcgtgaccttggatgagttatttcccatctctgagccttggttctctggtctgttaagtggcaatcttgccccttctgttttaggcactgtcggggttgcctgccttctggtaagcgtttagtgccctgagccgactcagctggtgctcagggaggcctgatgattcggggcgcttggccgggtggtggggtgggacaccccagagggaagggcactggtcccagcttggtggggcaggccacctggaggaggggtggaccttgggagtgggttatattagggcctccaggcctcagtttgggaggagcttgcagtgaccttggagatggtagtgaccttgtcctcctgccctgcctgggtgcacaggctcccagcacgtgggtggcaaaggtcctagagagcacccagaggcgggtgtctgcctggggtcgagtgtgggagctgggcccagagcccccacttctgcctggcatccgggggtccctccgggaagctgaggttgttttcttgaacagtaaggactggccagagccctgagcaccgagaggtgagggtgaggccccccctactctttcccccaccctcctgggaatgactgccgacatcagggaagggaggggccccaaggccagtgacctggaatgcgatggccagggaggcaggagctggaggctgtgtggggcacgaggaggccgatcgggtgtcccgggggagactcctcgctgcttccctcgggatggtttccatgaacttccctccccggccctgacggcctcctctcctaagctcccgcctcctttttttttttttttggagacagtggctcactctgtcacccaggctggagtgcggtggtgcgatcatggctcactgtagcctcgacctcccccggctcaggtgatcctcccacctcagccttccaagtagctgggactacaggtgcatgcccccacaccagactaatttttgtatattttgtagagatgagttttgccatgttgcccaggctggtcttgaactcctgggctcaaacaatcctcctgcctcggcctcccagagtgctgggtttataggtgtgagtcactgcacctgaccatccctccccgcttttatgtccttttctccctctctgaggtagggggaccaagccctcctccccaagccctgtccactgtggggccttctacaatgtgagcttgtacatctctgtgatgtcacccaggtgccaccaggtgtgtgtgtcctgatgcctttggccaccagcctcaaaatctcccagagttccaggtgcttggtggaagggattcatgtacccctatccccatccctaaatgagagtgtccacaccacccgccctgagttctgaacttagccacctcatgtacggaaggagaaatggaggccgccagagaggtctaggcctccgaccctgaccttgctcctcttggatggtattgggtggcattccaggacagctgggatcttgatcatccagtgggtgccctcactgtgcacctgcctccaggtggtggcgcggtaattgcaagagcgtgagcccctcctctggggcatgttcttggaaataaatacacctcgtgtcatggagatgggcagacgaggtgccagctatttgaacggacagcccggagtctgtgcaggagttggaggtagagcgggtcgaaggcttgcggagggacaggtgggtctcccatggatggcttttcttggaggctgcagccaggagccattgtttctcttcccacctgaccttgggtggttccccttcagccctggcgttatgatgtcccgcccaacccccgaccgcacacctccctcccccttagctgcttcgaagccaaaggtgtggcaacagctaacaggtgcttggtggtccccgcccaccctccttcaggctccctacacccacctgagtgggcctttctgtgttcacttcagggatgaggcttggagaagagggtgtgtgagggggtgcgggtggccctccagactggacctaggcctgctgcattctgggttgaggtcctcttgctgcctctctgtgagcgagcctcgcctgctgggtgctgagcccacaccgcatgtcctcggcctcccattgagatcagctatacgtgatatagaccagggatgcacgcctcatgaggagacgctcactcccccagacacactgagtactctttcctcaagctcagtgcagttcgtccacgtttgcccagcagcacgcctcccgcagcgttgtcaatatttattcgtggttgccgctgcctccctcctggaccgcccattccctgggccctgtctggtggtggctggccttggagagctggcctctcagcacagcaccgggcaccagggctcaaggtcagtgggtgtgtctttgggtcccttaaggagcaaagtctcataatttgctttattttgttttattattattaattttttttgagacagttctcgctctgtcgcccaggctggagtgcagtggtgcgatctcgtctcactgcaacctctgcctcccgggttcaagcgattcttgtgcctcagcctcctgagtatctgggactacaggcacccgccaccacacccagctaatttttgtatttttggtagagacggggtttcaccatgttggccatgctggtctcgaactcctgacctcaggggatccacctgccttggcctcccaaagtgctgagattacaggcgtgagccaccacgcctggccccttaatttactttaaataaagatctggttctcccagatgaggttcacagacagatgttccaagagcacatctgtctggcatcaggagactcacccataccaagctcacagtgctggccatgatccgactcccgccctgcagctcaagcttggtctggagaccttctctggcacctgccccggctccccagccccgggcttcctgcattgtgtgcttccactcccgtcttctccactaggagctctgtggtacgggctttctgcaccttgacctctgggcctcccaccacagcacggtgaaggcaccaactatttcactgctagatccaaggatgctggggccgggggcagctctgagtgtgtctcatacagtgaccttgtttgaggaggctgtgtaggcccaggattttcctggggtgagggacgccaggttccttgatgtgttgggacaaagacgttggctgggcgaggaggctgcctgagatcccacagtgaggctggccctgcccttgctcgcccagctgatctgacaccctccagatggcccaagagagaccgggaggagcatctggtggaggacctgggtgttctgtctggagatttcccattgcttttccagtttattgtcatctgcttgggacttgagggtaacttcatctctcaaaataggctgagactttttacagttagatatttaatatacagatgacgggcggatggtagtgttgttttaaggggggattttgttgctgtcgttgttgttgttgttttgagacagagtcttgctctgtcacccaggctagagtgcgagctcgatcatagctcactgcaacctcaaactcccaggctcaagtgatcctcccacctcagcatcctgaatagctgggactacaggtgtgcgccaccacgcatggctaattttttgtagagatgggatgttgccatgttacccagactggtcttaaactcctgggctcaactaaaattttaatctccaattcatacatttcagaaagtataataatatgtaaagcaaaatcataatagcaacaacaatcactgtcatcccacgggttggtttagatgtaaattttatgcttccttgcaaaaatttgtcgaaagtgccagaaaagcccttgtcccatatcacagtcccatgacccacactcccatggaaagccttagaactgatgtcagtgtgagccctgtgctggagtggagggtgacagagcttcggacatgagcagcctctgctgctgcggccaccctcgccggccctggatccccacacagtgtggggtgttcaggattcctcatgtgacccttaccctgcctgccctgggactgtgtgcctgtgtgcttgcatgtgtgtatgtgcgtgtgtgcccatatgcgtgtgtaggtgtgtgcatatgtgtatataggtgtgtgcatgtgtgtatatacctgtgtaggtgtgtatgtgtgtacatgtgcattgtagatgtgtgtgcatatggtgacctcagttccaaagctttccatgtgtgtgtccatacacatgtgtaggtgtgtgcctgtgtgtgcatatgcgcatacacatgtataggtgtgtgcatgtgtgcacacgtgcatgtgtaggtgtgtgtgtgcattgtgtgtaggtttgtgcatgtgtgtgcatacgtgtgtgtaggggtgtgcgtgtgtacacatatgcatgtgtgtgtgtgcattgtgtgtaggtttgtgcatgtgtgtgcatacgtgtgtgtaggtgtgcatgtgtgtgcacatatgcacgtgtgggtgtgtgtgcagtgtgtgtaggtttgtgtgtgtgtgtgcatatgtgtgtgtaggtgtgtgtgcgtgtcagcatatgtgtgtctgcattcactcggccagagctccttgagggcagggtggttcccacctctctgttcccccagctcccagctccggcctggcttttaatcacagagtaagtcaagcctgctttgggagccttctgactcccccagacacactgagtactctttcctcgagctcagtgcagttcgtccacattttcccagcagcacgcctcctgcagcgttgtcaatatttatttgctgttgctgttgcctccctcctggaccgcccattccccaggccctgtctggtggtggccgcccttggggagctggcctctcagcacagcgccgggcaccggggctcaaggtcagtgggtgtgtgtttgggcttgaactgatgtgtgtgtttactgagctttctccgcagcctgctccggcagctccaaaatggcatttcaggaattgaattaccgacatttcagtacttgcggaatccaggaatagattatttgattgtatctgttggaagtcattgccgtaactggcttcgttttcttcaccaacatctaaaccgagtggggagggaccgcaggagaatgctgtggtgacttgattttcccaaaagcacatctcccaagctggcggcagccgatggcgttgccctgtgactgggggaagcctgaggactcacggtcgcctcaggctggccaccttcgcactggaacctgcccatcacatcaaggagccctctcaggctgaaaaccctgtgccggggtggctgcagcaacacaaggattcccctccagctctgtgatgtggggagcagagggccactgagtcctgccatgtgagtcacatgatgcccgtggcctgatttctgtgcccccatcttgcctcttagagtttgttgacctcagggctcacatatcccttgtaaggggttgtgatggcttccacggccatcatggctagttaggattttcctccagcccttgaggaattctctcgggattttttctggccttgcctgtctgcagaatccatagaggacctacaggaatgtctgcctctgagtccatagtacttgcaggcctgggaggctggatcaaggtggatgttgacacttggtggggccggagccctggcttcctggctgcctcatagctcaggcccgtttgacagcatttgtgagcacctgtcccaggcaggagcaagttcaacagcagcaagggctccaggcagagggaggtgggctctgatgggactcaggggcagcctaaatgtagcagagaactgagaggggatccctgaggccttcttggaggaggtggtggttaagccagctaactttgtccattggaaactgtcaccaggtccttattaatcaaataataatgaatatgccgtgttcggatccactagggaaagctgaaattgagctcaaaggaggcatagaagttcagcttgtaattttgaaaaaggaaaaggctctggcctcattaggctgcccccagtgtgtccttgagacctccttactccttgaaatgtgcttcttaacgttttggaaaaaacaactttctccttctatacttagcccttatctcaatgtgcaggcgcctacctggcccacttatcttcaagaaatgtgctgggttaggcctcaggagtggcaggcacatagatactgtatttggccttggccttctgcccaagtggagtctccgcattcctttgtatgggcccattgggcatgcctggctaatctgcgcaccctctttccactctccttcctgcatttctccttcccttcagtagtggctcccttcccattccccaaatcgcctctgcttttatcttcttccaatcgaattcccgtcagtcgtggagcaggtgggacacctgtgtatgttgcgggggcacagagaagcagcctgtgctcacccatgcctgcctgcaggtgcatgcttgggacttggcagtgggggaagattttggggttaggatttccaggctggcttgacactgacctgttttgttccaacccatacaagccctaaaccctcatgtgcagatcctgctggctctctggggaacacttagttggatgcaggtaggaagaggcttcaaggagcagaggaggggctggctgagggccagccactttgtctggtccccagagcggggtctaacatgtgggaactgagcagcaactgtgagctagccctcaggcaaggctgccccatgatgccagggcacatagggcagactccagatgatggggccactgctggcattggccttttgcagggcacaggagtctgccaggggtgtgttttggagccacccatacaggtgtaccagcttttggaaaatcccaaagatgtggtgccctgctcctgggggtcttgggggctcccaggtagcaacagcgttctgggaggacgtgggctcaaattccaacttttctaccaggttttggctatccttcatccccgtggggctcagtttcctcatctccaagctaagggggcccacctaaagttgtcacagaattggacgtgtgacggggcagcccccttcacctgtgggatccgaggcagagctggcacctccaggctgtgggtccagtgacccggcatggagccagcaaacagaggaggcacctccaggctgcagggtccagtgacctggcatggagcaaacagaggaggccagtgggcaggtgggtgttaccagggcctggagcagcaggggtggagccctggggccaggcagggcgggtttggggtggcatgtggtttgttgtggccctgtcatttgcagtttgggttagtgggtctggctggccaccggggttggaggggaatgccagtgggactatacattgtctccttggaggtgactgtgcccccagaactgagtggacaagccaggcttgtgtccacacctgcccccgtcttttaccctcttctggctctcctccaagaagagcttttcctaaatcattcgccctgttcacctgggctttgaggccccaggtgtaggcccagggggtggggtggggtggggggatggtctctgactggatagccccacctgggtaggaagcccccagtgtggccccaccttggctgtgacctgggggtcctgcagagtcctgtgtcctgttgcagtgaggggtcagtcagtgggaagagtggacaattaggagacaccatgtctgtctcctcgacgccagtcaacactgttgcctttgttcccagggcagccttccccttgccttccattccaaactcctcctcctccctctaagattccctattcacctcctagaggaggccacctgagtgtcagccaggcactggacctgggcctgcccggaaaggtccctgggcctggtgtgctccaagaacctcgctgtcaggggtcagcgtgccatggaggatagggagaggcatgtgcccttggggacgtctggctttgtccggggggttttctgctgctcactggcttcaggtcagggcttggctctgtgctgcagccttaagccagcgggcccaaccgcctcctccaggcccgccagcgcctcagatgtttctctccttcttagagggtgtttcacatcctttcttttgtttgccctgattatttttgcagatgaaggaatacacacaatggtcatctttgtcttatttgaaagccaaacacgttgcttacacgttgggtgcacagtgaatatgtatcagtccagcgcttttcaccatctggtctggttttagtgttgctttatttctggtcattcctcaatcggggctaaagatcagaaaaatcgcatctccaggtcctgagccatggcgaggaagctgggtggtgccctgtgctgtgtggctaaggtgggggacgagggttgtcggtgggggaagccccatgggggccccactggagtcataggagcgaatggagcacccactccatgccttctgtcaattacaaagcacctattatgtcccggatactgtgtccaacacagtggacacattgatgggtaaggcataatccccccccaggagctcccagttggattgaggaggcagacaggcgagcgtatggctgtgacacacccagcaactcccagttggatcggggaggcggacaggcgagcgtatggctgtgacacaggggggcaagtggcgtcaccaaggcagaacccagcagccggggcctgaagccccctcacccagctgcagccttcccgaaacagctgagatcagcctggagagctcttcctccctgcctgcccggagggtggcgtgggtcccatcgctctccgtcagccacggccagagcacacctgtgctgctcctcagaagggcatcacctgtggagacggtgacagctgttcctgttccctgccccaaggacaggatctggagcctgtgggtgtgtaaggagccaactccctgaccccaaaactgtggccagttctggagaaggtggccaggctctgggtcccgggactgtggcccccctcctgcctctaaagcccctcttctggcctccatgacttcagcccctcctgcccccagaaggagggatcagccctacaagggacccaagagagggagcctcacacacaggcgctgcctgactctcctccaagctggcctgagccctgggcagtgttctgaggctcagccacacggctgtgcagggcaggtgagagcggcagcctgagagctgcgagccggggccggggttttcctggagcagcaggagggatgagttgggtttctgtaactacaagggccaagaagagggagaggatgatctgggaaggagagtggctttgggccagcatttgggccagcaggactcagaggcgagggaggtggtaagatcccttgcttgggatgagaggcagatggggaaactgaggcttggagcagagggaggggcagggcctgggcccccagcaggtcccagttcatgatggcatgctgcttctgcatgagtgagacatgagggggtcacagacgcccggaagcatcggcatcatcagatcatccgactcgataatagaaaaattaaaatttaaagtcactgaaagtgacgagtgacagaaatgttcctagaaactggagattgggtgctcagcggatctcaggatagatgatatcagacacaatgtcccctgggctgaggtttttttttgttttttgtttttttatgtttcagaattctaaggcaaggatgaaagtcttctctattcttgaggtgctggggttcctcagcctccaccgtccagcctcgagcagctgccccctctcacctgctcctcagccttctggaacagacaggccccccacagcagcccagcccaggccaccagcaccacccccagaggtttatgccatcttcatgcagtgggaggctcagcccccacactgggacctgtccactttagccccaaggatcttaccaaggtcaaatctttggaactcagggtctttgggaacttctgggccagacaacccggccatcacaggggcttctgcggggttggctttatgatgcatttgggtcaggaggtctgtttttatcctttgggcctctgggaaagtccgtcctggccaagtcctctgtcccctagtctcatggctggctggccctggagctcgggtggcctggcccggcccgcctgcttccccacaggcagcggctcttgcttctgctgcctgcagtgctccagatgctgcaggctccttccttccttcagggcatcctaagtcccccgagtctcgaatccccagtctcagctgagtcctcgaggtcagtggggcagaacgccagagccctgggacaacgggctgcataaaacacttattttaattataagagtgatgtaagaacatatcagaaaattggcaaaatacagggcaaaaaaaaaaaatcactggtggtcgccttctcacacagtcacacacagtggtgtgcagccttctggcttttggttgctttgttgcagtattggcacctgcgttacaagattttgtgttgaccattcttgttcttgctgtggtctttaaggtttacagcgacagctgttcctcttcaggatgcaaggagaccgagcctgcctgccctcagggagctgacggtccagcaggaggcatcctgtctgcagggcccatgcgggggacagggcaagaggtgcggtggaaccagaccttgccctccagaaatgcagggagacagacacgggcgtatttaattcaactatagcatgtggttctgagaaggcttcttggaaagggcctggggttgagctgggcaccagcagggaggtctcagagtggaggcggcagttccaccctacggcgtagaggaggcgccctgatcactgcctttcagccgtggccctgcctgtaatcttatcctttttgttgattgttgttggctgatgttggctgttgctgtgtcctccaccagagtggagaactccctggggctggaccccttgtccttattcacccagagaataggtgccttaaaatactgactggacagaaggaggaagagatgggttggggggccgtgtcatggaagaattccttgggccagccgcagaggagtaggccttggcagagagctgggagcctggaggggagctgaagacctctcccatagtcagctgcctttagggaagaaatactagaaagtcacagaagagaaaagaggcggggaaggggaggaaagcatttccacccacagtcctgtcgggagaggtaacattttggagtacagtgtgccctgccccagcaggccctggctggatgcatattcctatagatataattctataagtgagatcattccatatctactattttacaacctgtttttgttttttgttttttccacttagcaacactttgttcttacctagaattcaccaggcaggacagggctgatgagggagcccctcccacctggacactcagtggcccctcccaggactcggggctttcctgggggcctcagctgcggagcaacagctccctgtgcatcagagccgtgggggaggggggccagggggcataggtacgaccaccactcccatttcgtgtcctttaggaagcttgaagaaaagtggttagccaagaacacaaattacggtgatgttgtttgcagtgtggcgtgttgggttaacataaactctgaagtcagaattgacatcaatttgagcccagatcatcctgttagcagctgtgtgacctgggacagggtgcttaccttccagactttagttccctcactgtacaacagggacagggatcatacctttctctgagagttgaaggaagaagtgaaaccaaacacagccccatgacagccccttatgcatggtaggcactcagcaggtgctggctcccttacggcccgaaggaatcgattgacaaactctcaaattaatgacataattcaagagagtagctgcggagacaataaataattatagtagctgatgtggtttggatgcgtgtcccctccaagtccatgttgaaatgtgatccccagcattgcaggaggggtctggtgggagttgattggatcaggggggcagattcctcatgaatggcttgggccatccccctggtgatgagtgagcaatttggtcgattaaaagagtgtgtcacctccctattcttttgttcccactcttgccatgtgacacattggctccccatcgcctcccaccatgatcgtaagctacaccagaagcagatgctggcaccacgcttcctgtacaggctgcagaactgtgagccaattaagacacttttctttataaattccccagtctcaggtactcctttgtaataatgcaaacagactaacacattagccatagccatttattaacataattttaaaagatttcagtcttgtgctgaaattgttatgttgatggttacacatttgtcaaaacttagtgacctgtacacctaaaaggatgaacttaattgtgtgtaaagtataccttaataaacttgactttacaaaaaaaatccctcttttttttttttgagattgggtctcactcacccaagctgcagtgcagtggcacaatctcggctcactgcaacttccacttcctgggttcaagcaatcctcctgcctcagcctcccaagtagctgggattacaggcgtgcatcaccacacctggttaatttttgtattttttagtagagatggggctttaccatgttagccagactggtcttgaactcctgatctcaagtgatctgcccgcctcggcttcccaaagtgctgggattacaggtgtgagccactgcccccagcctttatatctcttgactgtcacaaaatgcatattttatttaagtttgccataaacagaacatttttacatactgtattgtaacagtatataatacaatacataccgtattgtattgtgtgtagtacaatacatagcgtattgtattgtgtgtagtacaatacatagcgtattgtattgtgtgtagtacaatacataccgtattgtattgtgtgtagtacaatacataccgtattgtattgtgtgtagtacaatacataccgtattgtattgtgtgtagtacaatacatgtatgtaatacaatacatactgtattgtattaatcagatatgttgtcctgtgttattaaaatcatcccttgtggcccaaatttgaaggcagtactctgttcctgggtgtgcaccgttaacttctttaatgaacatcctgctgttcaatagtgaggctgcatccttctagaaagcgctgttgagaggtgtgaggaggctgccacgcaggccgcgccgccccgaatggcaggtggaaggcggctgagtggagccgcagcaaatgcaaccctgcccccgagccaggccccaggctgcacctttccactgcttcacaccagcagtgctttacctggaaaggtgtctgaacagtgcttgcaaaggtaactggcattctgccggctgctcaactctgtggacaccagtacagtcaacaactctcactcgccgcgggcacctgctgtgcccacctgctgccatctgagtgtcacgaccacacccccatccctgtcctttcacgcactgtctgcccgcacacactcttccaccctctgtcggcagggcccctgccacctctgaagccccctgccagctctcggcagccccctcctccccctggctcccgtgtcctgcccacctccccacactggcacctcctgagcagccctggctgagcatgcactctgagggcagaccctggccgggcaccaagatacaaaaggttatgagggtgttctcttgaggaactgagtccagtgtgaacagtgaacacagaaacataaagggacaccagaatccccatccccatccccagggtggtgagccaccgaggggggccaggcacgggggagggtattcaagggcggcaagccaccaaggggacggggcaggcacagggagggcatttcagagagtgcaaggaggcggcgaagatgctggttgagggcacgggtgaggcggggaggcgtttcgactttggactgaaggccttaattgaccaaggcggtaatttccagtcctgtgacctcacgacaggctggacattggaggatgggatgacactggctcttctggggtaacttgtctgggtttaaggttcttgatggggtttaggacatggcgggaccctaaggatggtgccagcatctgaattctctgccgtcttgcagagtcaggattctgcagctacttgcccaagaaaaagtagagaaaggtggtttcatgtttttttttttttttttttttttttactgctttgaagggaggtgtgggactcgtttgcacacacagttaatatttccaaggcttgtgcagggccagacagatttggttgcagctgttagttttacttcctgtcccgataaaggagggtgcttgcctcagctctcacctgctgccataacaaagctccatggaccgggccgcctaaatgcagacacatactcagctctggaggcgggaggtctagatcagggcgtccgcattgtcaggttctggggagggctcttcctgctttgcaggtggcttttttctctgtgtcctcctgtggaatgagagcaaactatagtctcttcctcttcttacaaggacactaataccatcatgggggcctcactctcctgacctcaccgcaacctaattactttccaaaggccccaccccctaccaccatcgccctcggggttagggcgcctgggtacacatttgaggagagggcacagccgttcagtccatgaccacattgcatgttccagggaggaactggagagaggctgctgtttgctgggcacctgagctggttatagatgttaaatcctcacggtagaaaatgtggaaaatacagaaacaattataatgcataatcctacaattcagagatcatcacagcagacatatgggtccatttcttctggtcagtattcatttacagcgaggcggacagactcatgctgtaattgagtcatgctatgtatttgtttcaggtcccgctttttctttccacttaagacaatatcattcatttcctgtatcattaaaaatatttgcggtcgggtgcggtcgctcctacctgtaatcccagcactttgtgaggccaagacgggcagatcacttgaggtcaggagttcgagaccagcctggccaacatggtgaaacccccatctctactaaaaatataaaaatttgtccacctgggccagtgcgtgattccgaagactacatttgaagtccagccttgcagctttccaaaaacccgtgcctccctctttctgcttgtaaatgtccctcacaactggtttcccagaaaaattgtgaggatgagcgaggtgttgcttgtggaagttactttggagggaaagtgtttgtgacaccccatgggtgtggcccatggggctcctgagggtggatggatgtgggagtggacaggcctggctccttttcttggtgggctgggctgggctatgagcaggagctatggccgtggctgacccttctgcaatgggagctgagcagtggtacagttagatagctgcgcagatggtccgatggcccggcctccaaggccttgagtgatgggatgaccatgaccactggatgtctctcaataggctttgccttaaccatgccagcagttcccccatctgctttatcagccctggtatgtacatcagattggctaagggtgcaaaactggaatgctattaaattccagaggctctggtcgcttgaaaagatgagctgaaaataagataaaatttcacagggttaaaggcaggctttgcactctggtttaagtatagagtcgtccattcatgagagtataggtttgggagacaatagcattgaagaggcttgagcgcacactcagaaccagtggctctttcttagtctgtccatgctggctatactgcagcccccctcaactggaatcagatgtggcccaaccatgaatactttggacaaagctcccccaagtcaggcatgccctcttgttagggaaggtggattcctgacctgagtccatctggaggtccaggcaggaattagaaccacttcagaaaagctctgcacagatttaattgcacgagtacctgcgtctcagagctgcagactgagtgtgttgtgcaattgttgggcggcttttcccttggccacagtagattcgcaattaagaaaaacaaatgcagctctcagtcagaagtgtgcaaggtttgcttggtctggagacagcagcttctgtgctctggggtagtgaggaagtgtgtgggcaggttggcaaataagccacatgtatgtcccctgggctcagcccccatcttagtgggcacaccagggcccacgagatctggggactatttatgtagggtctgctggggcaggggtgtgggtgggtgtgcgctgcttgtgttgttgaattgggatttttccagccagaccagtctgctgggacaagccttctggctctgggccaaaggcctccccagctgtgatccattcaggcctagaaagctgggggtgctgactgccatcacccactggcctccatggtgtgtccacagagggccaccttcctgcagggctgagctacttctgtctgggtgtagcttcttgtaaagtccctagcagggttgctccctacaacccacccctccccattttctctttctctctgcatgactattattcactcttcaagtctctgtttagatgtcacctcctctgggaagccttcccagattccaggtggggctggaggcccttctgcggactcccctggcatcctgcactcactcacctatggcacatatcattggccgcaaaatctcctgggcacttatcacactgcgggttccttgaaaacaggaatcattcttgttctctgctgcatcttaggatggtgactggcacatagtaggagtccaattaagaatgttttgaataagcgaaagagtgcctaaatgagacttctattccagcttgaagaccagcccaccaccctgataagaaagttcaagtgtgggaaccgctggggatcttgatggcctgggacctctggatcagtgcttgtgcaggacagaggcagccccggagttctcatgggggctggtgagcagagtggggccccaggatgcctgatggcccggtctgaggtgtgcaggtgcccctgaggtgggcaccacccaggagatgcatgtatctgtgaaataccagataggcccttagtctaagcaaggaggcatctaagctccttaaagattccacaaggatgttacgttgtgctttgaacaacagagacgtggctctgctgagccccagccaaagctctgcacagggaccttgactctcccttcccgctgtgtggctccagcaagtttcctcccacctcaggtctgggtttccaggcattaagtgacaaagtggatgcgacgctccttctggactgtaatgcgcactgcgtggagatgttcgtgttccagtgtagacagggcgttgtcacatcaggcaggactacagggacaatgtttgtcagcctgtcttctgggcaacttggggtatcctccctttatatcacctcctgcccaggtgctctgcgccgccagagcatcatgtcatttgggatccctgatggcaattttgagactttggttcacagtaaagattggtcctgtgtgatcttaaagtaatgtggcttaaaaacaaatggctgtcagggaattgtaaatcaaagcaaacaccgatgagaatggcccaaatccaggacactcagcaccaaatgcgagggaggatgtgaagccacaggaagcctcactcactgctggtgggaacgcaaaacagtacagccaccttggaagacagtttgacaaatccttagaaagctaaacacacttttaccctgtgatccaacaatcatgctccttgatatttacccagaggagttaaaaaaacttatgtccacacaaaaacctgcacatgggtgttcatagcgactttattcacgattattcataacagctggaacttggaggcagcgaaggtgtccttcagcaggtgaatggataaattagctgtggtgcatccagacaatggaatattattccacagcactaagaagaaatgagctagcaagccatgaaaagacatgggggaactcatctgcatatgagtaggtgagagaagccaatctgaaaaggctatgcctatggaggattgcaactctatgatatcctaggaaaggcaaagcgatggagataataaacagatcagtggttcctacgggttaggagggagggagggatgagcaggcagagcacagggcatttttaaggcagtgaaactgctctgtgtgatactgtagtgggggagccatgtcattgcacagttgtcaaaacccatagaatatacagcaccagcagtgagtcctaatgtaacctacggacttgggtgataatgacgtgtgaagagacaaggcgggttcatccgttgtaacaaacagccaccctggtagtagggagggcaggaggtatgtagagaactctgtgctttccacgcgattttgctgtgaactaaacagctctaaaaaataaagttcattaattaaaaaaaaaaaaaaaaaaaagggaaatgaccacatgcaaagcactgcgtggagggccacgcatcccaagcaagtcagctagagtagaggcaggaaccaaacagctctatgaggttctggatgagaagccgcatgcaccaccccctccctgctcccgtgtgggacccagtgaagacctcctgtgcccggctgcagctgctgagtgtgggagtgtgctctccacagcaaaccagccgtgaaggctgcacaccttcctgtttctgcccagccacaccacagggcactcagcccttttcctgagcacttgaagctgcgtttcctcgagctccttcctgtttaagaacaggaggggagtggcggctcgcttgtgcaccactctccagggcagtggtgtgcgggacaccctgcagcacctttgactcctcctctgggaatgaggcgtggtttaatctgcaaccccttaccattagagtctgcaactagtcaaaaggtgaatctggctgggcgcggcggctcatgcctgtcatcccagcactttgggaagctgaggcaggaggactgcttgagcccaggagtcctgaccagcctgggcaacatagtaagacctcctctctacaaaagtaaacaaaactagcctggcgtggtgtcatgtgcctgtggtcccagctactcaggaggctgaggtaggaggatcacttgagcccaagaggttgaggctgcagtgagccaagatcgcgccactgtgctccagcctgggtgacagagtgagacccaccccccttttttttcagaccgcatcttgctctgttgcccaggctggagtgcagtggcacgatctcggctcactgcaacctccacctcccaagtttaagcaattcttttgcctcagcctgccaagtagctgcgattacaggcacctgccaccacacccagctaatttttgtatttttagtagagactgggtttcactatgttggccaggctggtctcaaactcctggcctcaagtgatctgcccacttcagcctgccaaagtgctgggattacaagtgtgagccacccagccctgagtgagaccctttctcaaaaaaaaaagaaaagaaaagaaaaaaaaggtaaatctaagaggtgaccagtaggggaatatatttgtcgagtctcctcacctcagcactgttgccatttggagaagcataattctttggtgtgtgcggggaagggggggctgtcctgtgcattgtggggtattgagcagtatccttggccctacccataagatgctggtaggcatgtcccctcaactccccagttgtaataaccaaaaatatctccagacattgccaaatgtacccgggaaaatcactcaggttgaagtcactaaattatatgtgtgtacatataattacacatgcatatacatcgcgtacacacacacacccacacacacacacaccttttgctggtggctctggattggtaagctggctccatggcaagaatcagcatcctaatacttgccccaccctttaaaataaacttcccaatcctaggcagacaaaagaacaaccccagacctcctccctcagggtggggacaaggtgagggaggtggcggcccggcaggaaggtcatttctttcttcagtcacatcagatgagctgcttcccctcactaggagtggatggggctgccagtggtgttcttgcaaaataccccttgtgggaggagaggggtggagggagagaacaccctccacacatccccgtgggatgtctggagggaagggttttgggcacccaccctggggagagaggagagcccaggttaccatctgtggtgtcccctcgctcacactcactactgccctccacaaactgccatgcttgcttggtgcacggtgctgtgctgggcactggggcaaggccccctcccccatggggctacagatgctaatctgcaaatcccagaaaagtggaatctcggtggcagagtggatgaaggggaggtgctcagtgctatgaaagccagcagctgggagtttcaggggcttccctagggagggaccctgagctggggtctgaaggaagagcagttcactggggagttagggagtgttctaggcagagtaaacagtgcagtggcagccggggctggcacttttaaagaaagcctcaagacttctctttctgattgtgaagtgagctgagcagactgaaatcaaagatgtgaaaataaagatagaggcgacaggctgggtgcggtggctcatgcctgtaatcccaacgctttgggaggccgaggtgggtggatcacaaggtcaagagatggagaccatcctggccaacatggtgaaaccccgtctctactaaaaatacaaaaattagctgggcatggtggcacacgcctgtaatcccagctacttgggaggttgaggcaggagaatcacttgaacccgggaggtgaaggttgcagtgagccagcctggcgatagagcaagactccgtctcaaaaaaaaaaaaaaagatagaggtgacaggaagaccccaccatgagtggcctccactgagtgcgcatgtgagtgagcagctgtgcggtggtccttgccatcttcccatcagcccctcccagcccctgggcctggagaggctgagaatctgacctaaggctgcccagtggcgtgaggctggcctgccgagcttacgtccctgggggactccaggaccccagtgcttcctactggtggcttcagctcccggtcacttgtcgggaatgcagggctgaacccctggaggttgtgtgggacagggcccaggaatctgcattctagcaagcacctgctccaggcttgcttccctggcagggaggcttggtgatccaagttccttgggtgcagacacttgctgcttctctcggaggccgggctgggctgtgattttttcatccaatgtgctgggctgatttcacttgcggatgcagaatgagaagctgtagaggagatcacggcaagctgtctgcatggacgatggcagaatccggtgtctgcttggccgcgtggtgtcactaataggatttgccgagccttttggatgtttgtggcgcgacggctgctgtgggaacccagaggctgctcatttgcagggaatgaataatttatttctgttttcagatgacttattccttcatctgcagccgagcccccacatgttctgtaggctcctgattaagtgatttcagcaggagaatttggcttaatcccccactgccctggacgcctggttccaggctgctgatttgtcggcctcgtgtcggggggtgtccggagcctctcctctctgggggcttttcttcctgctctgcctgtttgggaagcctctggccactgagcatgtgctggccttgggttttacggctgtctggcaattagaatattaatgtcgataacacagcaggacttgcgtgtgacaagctgagccacataacgtcacagtcgctcttgaacatctcggactttcacatgggccagccacaccccagcctaggttgctccctcacctcctcagggcctccctgatgtcggtttagacatgtgccttccatcttgcctgggccaccatgttgatcctctgggtccattgctcaagagcccaccatggctccctgttgccaaatgcagcctgaattcagtattcaaagccctccgtgaatgggcttggtccttcctccctggcctctcttgcgtggctccatgctctgagctgcctactcgctgactcattcatttaatgtttattctttggttgttgtttcagcactgagtgggtctgtggaatcatttacatgtttattgagagtccccctggctgcagatgctgggcaggggctttgatgtggggagaaagacccccccccaggttacaggtaagccctcccaagtggcccagggccctgggagggggtgaggttgtgtgagatggcagtgtgggagagtctcaaatttttggcatctttaatctgcccactgggtgagattgaggactcaggtgggtgtcaggggctttgaatgccaaaccacaaaggtctgcaggctgggggagctgcaggaggttgtcatcagtggcaggggccttggagcttggtggaggagaccacgcttcagatggccagctggagcaccccccaccagccccgctgcctggaccccttccacctctccatggacccacctcaggccctacccaccctctgcaccgccttgcacggcattgcttaatttcactgcaatggctcactggggctgctttcctccctctcttattgctctctgggtgagagttggtctctggcctccacatgaggcagggacagtgcccagggagtggccagtgggagaagcggggcttgcaggccaggtgggcccaagtgtgattcctggtgcagtgctggtggctgtgtcgcccggggcaagtggctcagagcctgtttctcatctgcagatggggggatggtctgtacctgtccagcacccatgaggagcaggtggaacaggatgtggcagtcaagggctcctgaggggacccgtaagtgccacattcagccttctgtgttaaggaccatgagtccaaagagtagtcgcgtgtgaatccacctccttgtgccagcctcacggcctcctcaggaagggcatggaggagcagtgggatgcccacggtaccgtggaggaagcagtcctggaggaagggtgactggccgagggccatgcggtgacgcactggggactggctctagctgctgtggggcacgtccacgtggagaagcgcttggtgtattcccccaccctctcacccccacagcgttcctggtgctctgggtgcctgctgtttctgagccatctaggtgggcacagggacaacctcaccagggacagtgtggccccatgctggtaagcaggcgatactgaccctggttccaaactgcattcctgttggtcctttgtcttgctcttccggtatcattacgaacacaactttagaaagtttaacagtggtactcagagaggcttgtggccccaactcatgtgacagtgaccaacaggtgaaaggtgacttgtggtctgaacacctgcaagggacacttattccgatgcctgaatctttgcatctctgcccagcagatgacagcacctggagtgttagctggtcatacctggacctgcgagtgtaggtaagacccttcttctcagggcctgtttgctcaactgcacgatggaagggttgggcaagatggatctttcctttcttttcttttcttttctcctttgcagttgaacatttttcttgccactgaaatcacaggtggaggtctgtgtgttcggcaggtgaatggccatgcaggggtggagggaggcctggatgctttttcttccctgcactcgcaggccccccatgggaccctcagcccccagaggacaattggaggcttctggactagggttctaaggtctcctgagaaggtcagaggctcgttgtccggccaagacagacagcagacagttggcgtgtctcagggtaggaggctccccaaatagaaagtactggattgggagcggatttattgttccctgcctccccggggccgtcggcatttcccctgtggctgcctcactgttctgatgttggcaaaggtttgttttatcttcctccttccagaacaggaggtgcctcagtgcctcagatgctgcctgagaaggtcagtggcatctgggagccatggtgagggtggcagtgactgggctcgggaggttccagaattctgttagtgagcagtgagctgttttattttccttcctgcctatggaaggtcctgagtgaacaaacaagtttcagtctcaagacaacacatcgtgtttcgaggtgacctgtccccaccccacccctgtcactgggagaagactgcaggtctcacggtctcccgtctgtctctgctgcccccaggtccagggactcctgcgatttctctccctggtgcctggtatttttgtagcactctctggttttcaaagttttcctacaacaattgtgcttaaaatgaaatataaactccatccccagcccccaagtcccactccctgccgacctcgtctcttactgggaaggcccatctttgtcaccagcagcagctgtgagtgcctcgtcagtgtttaagagtccaggtcgctgcagcatcttggtgtgtactgtggacccattgtgtgtgtgcccccaaattcctgtgctgagaccctcactccgagtaggatgttattaggaggcggggcctttgggaggtaatttggtcattagtgcccttataggaagaggatgcgagccagacctgcctctgctgtctaccaggcaagtatataatgagaaggtgacgtaggaggcgggactcgactccagaggcaggactcagacaccagaccaaattgaggactagctacaacagggccagggtagaaacagctttccctaagacgtgcccaccagtgtgcatgtcagtttaccactgccatggtaatacccggaagttacggctcctttccgtggcaatcatctgacgacctggaaattaccacccttttcctagaaatttctgcataatccaccccctaatttgcatgtaattaaaagtgggaataaatctgattgcagtgccgcctctgagctgctgctctgggcacactgcctgtggggtagccctgccccgcaaggaacagtccctctgctgccgctgggcacagctgcttcagtaaaattgctaataccaccggctcacccttgaattctttcctgagtgaagccaagaaccctcctgggctaagtcccagtttgggggctcacctgccctgcaagatcaggagccatctgtacaccaggaagacagccctccccagaactcaactgtgctggcaccttgatcttggacttccagcccccagaactgtaagaggtaaatgtttgttattgaagccacccagtctatggtaatttgttagagtggcctggaggaagacacagtattaagtaaggcttcgtgtctgacttcactgaacactgcggttgtgagacgcatctgttgtgtggggcactgaggttcattctgattgctttatgggactctgttgtgactgtactccagtttctctgcccgtggaatgtacatggatgtttggatagtttccagggtggggctgggacaaattgtgcagctctgagtgttcctgcacatgctttgtcttggacatgtgtccttctttctgttggacatacatgaaggaggtcagctgctgcttcacggggcatgtgtgtggtcatctttagtaaatatgccagtttttcaaagtggtcatagacagtagattccttttattatgtgacaagagctcaaatgccctggtagtgggagtggcagcaggagctacagtaagacattgcacattctctggaagtcagggatccctgccagtcagttcccagtgccccaggaaccaggggtttggtgctgggcactagtcatgaccactcgcggctcaggtgttgggtggtctttccagaccttcacctgtgtgaagcttgcaacctggatggtctcatgtggacatcttggcttccaccctgtgctctgtgtctggtctcagaccacagcccaccctggtggtctcctcaggacacataggctcctctgtaactcagtttcttgaattgaacaatggaagaaaatgcctctatgaagagaggtcattgtgcaaaacgtctgtgtgacagtattcttggagcaactgtgcttatcacccggaggccacagtggaattagtcatttgaaaaccagtcacctccaaaatagtcataatccaaaaccatccatctttgacttcagactccattataattttttctccctaagggactttgctttgtaattatgttggatttcctaatatattaaaataatttgtcatctcttgagcacacatctgcctgctatgagcaagcaggagaggccacttccggttttctgcaggtcccagtgagcatgtgaagcctgcgcctgggcaagaggttggatactgggaggaagaagcttttccagtaccctttcccaaagaccagccagtgagggaaatgggcaccgaatgcaccccaccccccggcctgggactgggccaagaaggaggaactgaccccagaaatggccccggaaccataacctgcttacactgtgacctgcagtgcccatggtggcagcctgggctgtttctggagttgagcggagagttcctccagtctaaactccttagagaacatgaatattcctgagggcctggggtccggcaccaccttcagtggactggatcaccttcttgaaggcagagagatcttaagagcttatgtctgactgcctacccgatgcccagcactaatctgcatgcaccccactgggccatgggcttctcaaaggtggggacgctgtccctgtacctaacacacatggtgggcactcggcctaggtttgcagggcctgctggggagttctccaaggcagttttatagctcagctccagcaccttcctgggggcccagtcctggatttgaggctgccaggggggtttgcagtcagctaagttggtacccatccatcccttcccctctgtaaggggtgacaagcactaagacctgttatgtcccctggaagctctacactctgtccccttgctcttgtgactctgctctttgctctcctgtccactggcatataggagtaggaggatattgacttagattcctttttattatttttgtttaaatcagctttgtggaaatgtaattcacataccctaccatttacccatttaaagtatacaatgtaaagtatacaattcagtgatttttagcatattcacttgtatgtgcaattatcaccatggtcaattttagagtgctttcatcactccaaaaggaaacccgtaccctttacctgctagcccctctttccccatccgctcttctgccagccccaagaaactacgaatctactttctgtctctgttctggacattttatatagatggaatcataccacatttgtccttttgtgtctggcatctttcattatatttttggggtcttgttgctgtttttgtgacagagtctcgctctgttgcccaggctggagtgcagtggcacgatctcagcttactgcaacctctgcccctccaggtttaagcagttctctgcctcagcctccggagtagctgggattacaggcgcgtgccaccacacccggctaatgttttgtatttttagtagagacgggatttcaccatcttgtccaggctggtcttgaactcctgacctcgtgatccacccaccttggcctcccaaattgctgggattacaggcatgagccactatgccaggctgttgttgttttttaagacgtggtctcgatctatccctcgggcgggagtgcagtggcatgaccatagctcactgcagccttgaactcctgggctcaagtgatccttctgcctcagcctcctgagtagctgggactacccccatgcaccaccatgcctagcttgtttatttatttagtagcgatgaggtctcactatgttgcccaggctggtctcgcagtgctgggctcaagcgatcctcccaccttggcctcccttagggctgggattacaggtgcgagccaccacacctggccaagaattggtattccttaaatatttgtagaattcagtagtgaagctatttggccagggcttttctttgtggatagtgttttgattactaattcaatctcttcacgtgttataagtctttcaaattgtctctttcttgagacagttctggtagtttgtgtctttctacttggcttagattttgcaggcctcccctgctctttcagtcatagttgacatttattgagttctttctatgtaccaagcatttgttgtgcattagctcatttaatctttacaaaaacttgatgagctaggtagtactattgtcatctccattttacaaatgcgggagtggaagcagggagaggtgagataacaggtcaaggtcacactgttaggaaataggaaacagtccagctgggctttgattccagacagtccagccatgcagcccctggccttgccacctccctctgccattctccagagactcggagaggggcctaaggcctgacatgaacgaagggctgggggaggtggggtcggaagggccccaggaaaagcgtgtgtgtgaagggctcagactcccagttggggagttcggatgtccccttctggggctttcatcttctaacctcctctcccaagcgctcagccaaagggcagcacagagcaccctaccctaaggtgtgacgccccagctggcaggactttggagcagtagatctgtgcccagcaggtctgtatgaatcacccaggcctctgcattttgcttttctagaggaagaggcatggcaatttgtaagacaatcgccagacagaaatcgggagcaaccagacataactcaacataattatttctgcataatgacttctgctacttgattctgtctcgagcaatgactgtaatctctatctgtcactgggaagctggtggccagggagcccctgtggcttagagatagagccaggaggaaatttgcaattcgagttaatggagtgttcccaagcagcctgagcgccaattccttcaaggtctccggaacagcagacccccttcctgctaggaagcctggtgtcagagctggctgggcctcctctgcggagtccagctcatccactttgtcacagatggggaaactggaaatggcagaggtcacaggatgtgcccaaggcacaggccaacctggaaccagcacttcctctccaccctcccaccacccagcattttccccttcagctggcctggctgtggtgggacagaggaaagatgcctctgtggagctggtcactgagagtgctggccaggcagggctgcccccaggaagctggagacagtggggcctttgcaaccagatagcgagggacctcaatgtggagatagggtgtgcttgctgagcgtgccagcaggcttgtgctcacctgctccagctgggggcatgcagaggcccctcctaccccaggaggatgcttattcactgcattccatggccttttaaaaatcccctttaggcccgggcgtggtggctcacacctgtaatcccagtactgagggaggccaaggcaggcagatggcttgagcccaggaatttgagaccagcctgggcaatgcagtgagatctcatctctactaaaaatgaaaaaaaaaaaaaaaaagattggggtgcacctgtagtcccagttacttgggaggctgaggctggaggattgcttgagcctgggaggttgaggctgcagtgagctttgattgtgccactgcgctccagcctgggtgacagagcgagatcctgtctcctgaaaaacaaacaaacaaaaaaaaaaccttgtaactaaccagagcagctgaaaagaacagagcatgggtttggggatttgtgttttgggcgccccacaccccatttagccgagtgtcacctgagctggtgtcccggagtctctttccttctccataaacagttgagaatgagctctctgccaggccggtaggaaggggatgatgaaatgaggacctggtacattctgctgctggttccattgctgggtttctcctcgtggagagcccttgaccctgtccaggtcttgatttctcggagtgtcaaagcagtgcgcacggagctgtgagataaattggctgagatcatcgatttgaaaacgccgtgagaaaatatggggcaaggcagagagcacagaggggctttagggcagcgagcccgcgctatgtgatgctgtaatggtgggtgcgcatcggtacacgtttgtcaaagcccacggagtggcccacgccaagagggaaccctaacgtgagctgcggacctggggggtgatgatggtcagtgcaggtccctcagttgtaacaaatggcctgctctggcaggggatgtggatcgtggggaaggctgtggccgggagtggtgtaaggggtgtgtgggaactttctgctcaattttgttgggaagacctaaaaaataaaatcttttattttattttatttttttgagacaacatttcactgtcacccaggctggagtgcagtggtgtgatctcggctcactgcaacctcagccttctgggcccaggtgatcttcccacctcagcctcccaggtagctgggactacaggcacgcaccaccacgcatggctaattttttgtatttttagtagagatggcatttcatcatgttgcccagggtggtctcgaactcctggagtcaagcaatccacctgcctcagcttcccagagtgctgggattacaggcgtgaacaatggtgtccagcctaaaatctatctttaaaacacacacacacacacacacacacacacacacacacacacacacactgctatcttaaaagcatagggaccttgcagtgagaatttctggtgggaagatgtatgactttgtcaggtcttgaattctagcagtgagtttacattccataattggcctacaaaattctatatttgggaaacagtagaaatttaactctgagcaagatacaccctatttccaatcacacgtgatgcatctcgggggcattcatttgtcaaacattatttgttgagcacctgctgtgtccaggctctggacgcatagacgtgaaacggacgatttcctgaccttgtggcgctcacagtcaggggggtgggttggtgggtgggtggaaggaggggagaggtgcagcacccccattgtgcaggagcgaggggagccccgctggcacgccgcactgtgctgaggctgggtgttctagggtgaacaagccacttcgtctagtgggtgcttgtaaagcgggatcgttgctatgagagagagaaccttgcgttgggagaaagtaattagggagtgtgcggtagatgcggaagagaaacgggccgtcaggtgaagtgactgtcaggattccatcctggctcggccccttggaagacacatgatcttgcaggtaattagctcctgtaagcctccatttttccccgtctgtcaaatggggatgatgattgtgcctgcctcccagggctgctgtgtggattacgttggataatgagtacaaatgcatagacagcctttagcaaggagcctggttgtatagagctgtcggcctcaacactgttaatacacatatgtaccagaggctgcaggttcacggaggaggagtcaccaatccatgcccggggagcaggcagagaagagggaggcgggcccgtcccgagttcacgccacgtgaaaggtgcttggaacgcttgtgccagagctggcagtgagggttgagggtgggagtggccgagcacctagacacccgcaatgcaaattttccttctcagtctctggatggttttctgagctgagctgcgggctgaatgtcaggtgatgcgtcctgacctcttcctgagcacctagtgtgtgccctgtgctgggcccaggaggcatgctgggggcaatgtgggcctcaaggaggaggtcgggtgatgaggggccaacccaggtatgccagtcaagaaaccgtggaggctggagagaccctgaagggagcagggcacagtcgtgggtggcaggcctgggtgtgcctgattccactgaaccctcgtaacagccctgggtgcagagtgtagagtgctgggtgaggacggaggctgtgcgtctgtgatggccccaggtgacaatgctgttgggatttgaacctgagtttgtggaccacagaggtcccggccacacttagtttccatgccagttttgtagtaaccagcaacctcactcgaagggtggccagcatcttaccttggggcttctatcaacgttgtcctgggcttctcgcctgctggggtgcagcggccttgggcatgtgcccctgtccatggtggctggccggaggccgggagccagggctttctgtatgtagcatggcacttgcaaaaactgtgatcccccagcaggcaccacagaagcaaccagagggaggggcatgggctccgggccgggtcgtcacagcctgcgtgacctgtcgctcttctcttccaggggcatggtctagtggcccagtcaggacgcggaaacactccctggaggttctgacccactccctctcagcctccgcctggtctctggtaagtcactcccagaggccgactggctcagggtgggtgaggactgaggatggaagtgggtggctcctgctgtgccgtggggtcctgcccatgtgtggggactggacccagctcagcagaaagagcagggaagactgggcgtggggggcagcccagctagcacccctagacaggtcaggaaactgcggctcggaaatgcagagaaacagccccccaggccccacagccatctcagctctcgccctaagctggccaggtctttctgggtaaatcgcgtgaccttcggtgcttctgtttggcgatttgtcaggggaatgaggggcccagaactttgagaaggacgtgtgggtgagggcaaggagggcactgtcttagtgtccgggtttctttgtcttctatcccctgcagcccctgtacctggaagcttccttctcccaggctcctgtgcatggtcagggccactcagccctctggacccccacccacgccagataagctgtctgcgctgggagctgggcatgtggctctcccctcagagcagttaccgtaggctgccgggcccagggtctgtctgaatccgccaccctgcagccccccaggcccctgcctgctctgggtgcgaggaaggcttgagggagggcaaagtgcttacagcttgaatgcaccaccctggcctggccactggtcgcctctcccccagtgttagcctggcttaggggctttttccatccggaatccttcctggccctgcctgagctaactccgtgagctcgggagggctcctcatgaccctggtcatcctgccagctcccgagacaggaaggcctggccatgtcccggggctgccctcgggtctggagagcctgccagccatgctgtggggctgcccttccagcgttgagggtttggttttgtttgtaagcaaggaaccaggtatgcgatgctggagagtgtgtaattctggctgtgcctcttcacagccccttccaatctcgtgcatattaaggttgataaaaacaccctcttcagggtcaatgcgagatcagacctggagtgaagtgtccctgtggtatctggaccagcaggacctggctgccccacagctcctcctctctctccctcctccctctcatggtctcatgactattatggtgactcttgtcactcaccaccctgccccacctgctcctgcatactgtgagcatcagttggggccatggatgtagcaagggtcagctgtcataggctcccggggggacacctgggggagggacatttggggacagagccccatctggccatgcccagcccctgagagccctcatcaccgacttgcatctggtgagtttggcagggtcctgtataaggattaaagtcctccaagtcctcatacaaagtcgctttccaaaagtctggaattttcttggccctagacacgggagatgctctttataattttcatcttcccactcagaaggaaccacctttgaatactcagccaggctaaaatttggacccaaaacctgttaaagcatcactgtcttaatttcagtgttcatgatggggttctgggctgtgtgaggggtggagggcagataccagtggcaggtttcatctgtggccctggtagatgtgagtcccgcagccggtcagcccagggcccagggcagaccccgggcgtggctgctttcccgctgggcaccaacgcacgcacgtggtgtttccagggcaaagtgagctccccaccctctgcccgtcccctgccccgcccttagatctgcatcccgtgggtggggtgggttttcctgccttcctcttcctgagggaggcgatttctccttccgctttctccttgccacagtagctgctgggttgggaggagacatccaggctggggcctcagcctcagggtgccagttagcgtgtggttagctgagaaaaaagtatttttctcagcagaaaatagacacaactgcatgtgaaggggccacttccactccttcattctccatccaccagccttactggagctagagagtgggggaacatctgggtccgtgttacctggatgtcacctgcatacaaatgtcctggcccgaggccactgtcagcacgggtgcacaggggaggcgcctggcccggcaggtcgtgctgaggctgatacccgtgtcaagaagctggagcaggcgaagagatcagaagagggtagaggaggtggtccgaggtgtccattcccatccccagacccctggggcatttcagtgcacgcacagcaaataatatcactgcaccaccaccaccaccaccaccaccaccaccatcaccaccaccaccaccaccatcaccaccaccaccaccatcaccaccaccaccaccatcaccaccaccaccaccaccaccaccatcaccaccaccaccaccaccaccaccatcaccaccactaccatcatcaccaccaccaccaccaccaccaccatcaccaccaccaccaccaccaccaccatcaccaccaccaccaccatcaccatcaccaccaccaccaccatcaccatcatcaccaccatcaccgccaccatcaccatcaccaccaccgccgccaccaccgccactgccaccgccaccatcaccgccaccactaccgccaccgccaccaccaccgccaccgccaccgccaccaccaccaccacgagttgagggactctgggatcagaaggcactttccagcacattcacaccattggccgtggatgttgtgggtcaggtgatgggcactggaagggccttccgcttctctctgcccctggcccttggtcatgtacagcaggccgctccccgggcagtggagaagcagcacctgcatactaaggctcgagtcccagcctcccctaccagcctccctctccacgtccccagacactcatgcgttccttcccttgaggtgggttcatggagcacgtaccctgtgtcagacaagcttccaggctctgggcttctgatggagaacagaccagagtaaacctggccccaaggaccttgagctccactcaaggggagacagacagtgaactcaacaaaacagaaatgagagaaaggatcaagctggaaaggggataaagaatgagtgtcggttttggatagagtgcttggggaaggccttcctgagatgagacctgaccaaaggcctgcaggaggtcagggacgggcgtgcttctagctaaggagcagctggtgcaaagggcctgtggcagacgtgcacccgtggcaaggagggggcgagcaggcggctcagccaggtcggagtgggtcacacctgaggggcaggacgctggcaaccccgaccgctgaggaagacaggtgcgagcagcatctcggcacagccagacccccaccatacggcagccctctgtgtcccttaaataaggatgcctcctcccaggcttaagagatcattgttgctcatagtgatttgtgtagccaacaattcttctggaagaagttagatgaacagggccatggagatttggggccggaagagcaggaccccaggcttgcctcccctctagtgctggccaggccgtggatcccaggcgggcatctcagagagccatctgagcggcctttctggaagtgccctcctaggcagacgctggtcatgaggcagggcagcggggaagggacaatcctcctgtgttgtacattgagggttatatttagggtgacttgggatgacttggcagtatcacttcctgtggtcgtcccctccagccctcagccacggagggcagatcctgtctgacaagcattgtgggcagacacgtgcctgcacacacgtacacacccacatgcacacatacacacacgcacacacatacacacattgtgggcaggcacaacttggcattctcatctgccctggaattggtggagggctggggacattgtcctggcccttctgcaggaccgccaggtgcctggcgggggaatcctagccgtcagcatctccggagcatctgctccatgtcgggctctgtgtgaagggctgcatccagatcccacatgagcaagaccggcctagcctccccatctggttgggagatgccaggcagaggtggaaggaagggcggctgacctgccccttagtctgctcagccacacaggcagccacagccgaggctgcacaaggacactcccctgaccttgctgcctgctggccccgggtctccaggccaggtccgagccagccaggctcctccccacccatgtcaccggcctctctaggtggagtccacagtgatctttgctccccttccccaggcatccagcaccacaccaggcacagggcctggtatttctgggacagcccagattacacgttttctctcagttaccccctagaatattcttggacttctcagaccccatgtgcaaatttttagcttagaagtaatcactgggatcatagacgatgtttagcaaatatctgttcttttgggtgttcctaggcccccagagggtctccgggaaactggctcttttgctgaggctagagactatctgggctagaatgtgtctgatggggctctcggagggtgcacagacagtgccgcggtggccgaagatccactattccaaggccggatctgcagaggatttggaagttgtctgtaaggagcgcctagatcacccggaccttctctctccctccttgacttccttcctgcctctcgtcaaacaattactgtgtgcttcctgtgttctaggcgctgtgctaataattggttatgggattattcctagccacaccctgggtaaatggaacccagctctctgtccttgggaaaagggtcaggagagaactggggcccagctgggaagctggaggcttgaggctgctggtccatgttggaatgctgtctccctctgccatccagcacccaagcccggcgccaggctcagagcaggaactgaagcttttgctgttgttgttgtttttgttttttgagacagtctcgctgtgtctcccaggctggagtgcagtggtgtgatctcagctcactgcaagctccgcctcctgggttcaagcgattctctgcctcagcctcctgagtagctgggattacaggcgcgcaccaccacgcccggctaatttttgtattttgagtagagacggggtttcaccatcttggccaggctggtcttgaactcctgacctcaggtaatctgcccgcctcggcctcccaaagtgctgggattgcaggcatgagtcaccgcacccggccaggaactgaaccttggtaggagaaggaaagaaggagttcctgtcttgctttcccgaccagactggaagcgctctgagggcgttttacacttcggtgtcttcccagcacttagcattgtggcctgcatgtaaggggtgttccgtgactgcgtgttgattacactttgtgtgtatgggtgggtgcgttgccacaactctccctgcagaatctgtggcctctggtgctgtgatttaaagactaaagatggcaaagagtggcttttatgagctgccccactcctgattataaacacactctctatgagtcagaggcctgggtgatcatggataagtcacttgccaacagttaactccagactgtagctgctggggccaccgagggcggctggaacatcaccattctgtgcctagcgtttcagccgggctgaggccattttattaataatgatttattgtttttattgcttcccagagatattaaacatgaatcaaataatgcatgtgatgattcactggaggttcccttccaaatttaaaaaagaattaaagaaaaagtttttgacgggtgtgctggtgtggacaccaggcaggcacctgagagccctcccaccttgagctcagccgtgggcagcacagcacagggtggaccttgccctgcagacagagccatgcagcctgcgcaaaaccccagggaggacgcgcgtctcacaaacacctcttcagtctaacatttacaatggtatttcttacaaatggtttccacccgagatatattacaatgtggccaaaccccattcatttgggacacataaattcaaaatttggaaatagttcctttggggctcatgaactgatcaagtttagtcatttctcaagcagggacctggcagaaatgttgctttttaccatctactaagacaagagctaggcagctggttctgctgaacaaggtcccggggagagggacaccagtcctggctcagtgagcagctcctcaggtgctttggaagcctcctctggggatagactcaaagaagttttctatttatttatttatttttctttatttttaaatgtttttctcaaggatgttttttagagctagctcatacctcaggggccacactgtccaaacacatattggaccctgatgaggaaagtgagagccgtcagggtgtgtgacatagccactgtcacccaggcctccagctccattctgcagttgaaaatgatgccctcataacaaagagttcttttgtgtgtgtgtgtgtgtgtgtgtgtgtgtgtgtgtgtgtgtgtgtgtgtgacggagtcttgctctgtcacccaggctggagtgcagtagtgtgatcttgtctcgctgcaacctccgcctcccaggttcaaatgagtctcctgcctcagcctcctgagtagctggattacaggtgcctgccatcatgcctggctaatttttgtatttttagtagtgatggggttttaccatgttggccaggctggtcttgaactcctgacttcaggtgatccgcccacctcaccctcccaaagtgctgggattacaggtgtgagccaccgagtccggccaacaaagagttcttatccgttcattacaaacgcccactctttccagtccttacctgatcaagaattcagaggcaatttttcaggtatttttttgactcggactttacaaatttgaactaccattcaagtaattggtctgaattcctaagtttcgatggtatttttctcttccttcttctggctgcctctcctccccataccctgcatttgttaatgtacccatttgttccatattctgtttgttctttattgctctatacactgctccataatgttctctatcatttgtccattcattacccatgaaggtacatgcagaggtcaccagcccagaggtttgtagcagggacaagttacttgctggtggtggtctccccaaaagtttgggcctgcgagtcattgacacctacacactttgaaaacaccccaggatgaagtctgggactggaaggagctcccaccttagccagactctggcctcctccccagctgtgtccccgccagcccttctccagccatgcccttttgcctcccagcacactgaggattcctcctggaatgcccctcaccccgtctttgctgggtgagtgtttccccagccccgctgagctcaggtatcagccccagcgctctgggtaagtctgggaccatctcctacattgtctgcaaaatcctgcagaaagcctggcctgtgctggtcagcaggatgctgcgtttccttttaaacagacccaaagcagtcagcagccacagactccccagagacggagatgagaggagggacctcatgccctgaggcagccccagcctcactcccatgccctgcaggcgctgagcagcccccagatcccgggctcctttgctgccccagggtcgggcagttcttgcatcttggaccgagtgggctctgccctgctgtggcatgactgggcttcttctgtcctttttctttattttctctttgaagaacaggagttggaatttcactcaccctgccccagctggatgtgtctaggccaccgtggtcccaggctctctgcccagctgggcctcaggaccaggttttaatgccgctgcttgggtgtgccgagcgagaagggctcgccaggcagtgcagagattccaccgagcccaggccgcagcccccacctcccgccgggctgtgctcagtgtcaggaatcggctcccaagatggccgcctttcttgtaaagctgtgccaataccccaggcatctgactggtgctttccagctggcactccttttacagattccatttccctttatcctcacaactgctcagtagaacctgcaggcagggacccttattcccattttacagtcaaggaaaataaggcccagagaagttgagacagccaggaccatatggctggagacggggcaggctgggcagagcccccagcagggcccctgggtctgcgggctgctcccagcagcacccctcatatacacaccctcatcctgactgcaggcccctgaagctggcattctggttcaattttacagaggagcaaacaggctgggtctggagcgttgacactggcaactctagcccagccttgcctgactccagggcatggctccaagaccctggaagagctgcctgtccctccatggcccctccagggcgtgctgggtgctggcagggcaggctgaggcactcgacagcagagttggccccgtagtctcagttttgctcccgctagggtgaaacacggttccctggggaagggctgttgctcacctcttggcctggaacatcagggtggaatttgcagacggaattctgccatctgacgcgtagatcttccccccaggcatgggtcagtgcttgagtcattctgcagctggcacaaagagccaggaagaatgcgctccaagatgcctgggagctggcatgccaaatcaccaggcgtcatcagcacagccaagccagggtgggggcctcgggcaggagcagcgccctgccagctctggctgactgcacgaggggccacatctagagggactgatgaaggggcgtctaaagcctcagtatctccagcctgctgtgccctcttacattttctcccaaagagcagtcagcttgcagtatgcgccaagtccccgcaaatgggacgttgggtgattcacatggttgtttcagcttttgagtttttgttgtgtgattgaatagtaatagaattattcttggtgttctatggagcattaccgggtagtggggaggtgggcacactgagcctctactgtttctccccttcacccctccttgctgtcatcaacatgcgttctcctacagtcatgctccgcgctaattcctttagtcattccttccagcattactgaaactggaagagtcttttgtggcatgtggggattcctcgtcgtgcagggcttgagtgccacaggacccagtgctcgctgtccccatgccctggcacacactgttccctttgtcccagctggagaactcctggaacctttaagccctggctcagccctcagctctgtcccatcccagctgacctctgtgctctgcgcccgagctcctgagcccacgtaagtctcttcatgcccatcactgctgtttcatgggcgtgtgtggggggtcacttcaaggagccccaggaagggtctgtgtcttgtccatccacgtgtgactacacccagcatggaacaggactcgggaaccactgaggtgtgggtgaaggaaccagtccagagactccactctcacttcagcctgatgtttctggggtctgtcactgaaaaccccaacttcgccttcaaagcgagatcctgggtgggggcagaggaagtcccaggctctgtggccaggactccacacccagatttccaccgggctcgctctagcctggccctggcacgggtgctgcgtggctctgctccccgcctggcatccggcacccttcacctctgtagaaacacggaactgtcacagggacagacgtacatgggtcgggggttgctttcagaaagtctatggtctcattttggtcctgcctttgagcttccttttcctgctgggttagggttccggacggaaggggagcattctcttgggcgtttcccttttcctgtctccctgttctctccccagaggctcatgtatgtccgtttcactcacctccctttctctgcttgggaggcagctcaaagagctcctctccaaagactcaagctggagtgatgttcgctctatgatgacgccgcactggtccagggaatgatctcactggagagtagcaggaagtcccccatcctgtcccccaccccactggctgaggaccatatagctgggatgtgttcacctgggaaggagattggcaccagtttgataaatggacacccccaagtctggcatggccccaaaactctactctgctgcagctgtttccatgccagaaaacagagatttccagaataccgagtctgaatgtgccttcttggagcagcttcaaatctgagcaggagagcacttgaccatcctaacccctgaccttcctccagcaattcctaaaactggaagagtcacagaatgttagaataagagggatcctagaaaaagaaccactcactcattgctttgttcatttgctcaggcactgtgctaggcgcttggaatacacaaccattcattcaaacatatttattgactgaattgtgtgccaggccctgttttgggccctgtgggggtacagtggtgaacaaaaggaggcagacagtcaagagattttgtaaatatagtgccaggtggcaggaaatgctgagaaaggggtcagggtgagggaccagagggtgagggtggatgctctttgaggtgggtccttggaggaggtttccccacgactgttgagcaagaacatgaacttggagggagtgagccttgcagacactgaggggaaggaagagcagacaggtggagggaactgcaggtgcgaaggccctgaggctggaacacgctgagcagcttctctgactgggacaaatgaaggattctccttcccccaggagctcccagtctaatgaaggaaaaagacaaagaagtgacgcgttcaaagctgagttcatactagaaaaacgctgttagaattcaaagggaagagcagttgtaggggctgggaaaggcaagcctgaggagtgacctttgcattgggctttggtggatgagtaggggttggcagggtggctgaggcgagcgtgccacacgggtgaactcatatctgcagaggcacaaggtgtgcagggacagccacccacacattcctcttcctgtcgcagtagcagcttctgcaagagaaagtacagctcttggggatttcccttttcctttctccacctcttccttctcaccagcttcatttagggcatttcagccttgagagggtggaaaagaaggagagattggtagaggaaggggatttctgtgccctgctgggtctctctctctctctcttctcatatgttatgtttttcttgtaaggttttggggagttgtggggagtttaagaggctggggatgggtaagaagtcaagaaggtttcggttggatttctcaacaacaggtcattggcctggagcccctccagtgggtaaaatgccgtgatgcaacagctttcaggaaggcctccagaaatgagctctaggtcagtgggttgggtttaggtgcaggcacgccctggaactgtcactctagaggtgttactaacctcctctttccccggatctgactcagcagggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtaattatgaaatacaaacgccatgatctttcactcaagggcactaaggagtgaataaataaaggataccacagggtgctaatgagcttgaagagtccctgtttggtagccccagatccagggtccctggtatcacccactgaatgctacttctacccagcactgcccacgggaaataaagtgggagacacatacctatgtgattgtaactttttctatagccgcattgaaaagtaaaaaagatgaaatttaaaacttgtttgatttaaaccgttagatcccaaatggtatcatttaccatttcacatgtaatcaagaaagagaaagtattaatgagatattttatgttgttttttttcatatgaagtcgtcaaaatccggcgtgtattttacactaagggcacatatatgagttcagactggcgacggtttatgtgctcagtagccacgtgtggctggttgtgaccatagtggacaaagcagccctagcttataggtggagacacggaggcacctgagaggggcggggtctcagctcaggccctgggagcctgttcaacagctccctctagcgtcggcccagccacacttcagcctggatggtcccagatgcatcggctcctccctgcacctgggtcctggcagccggcacagcctccccgcaatcacccaggggcaaaacgggcccctccttggagaactaccgggaagctaaggctgcaggcagcttgactgtcacttgcttatttggaggaaagaaggacacaggcccgagttgttttgaaaaatgcaatcagccctaggagaggggcttagctgcaggggccgtgtgggtccagcggtcaccgggagaaagaactgggttgggtgctggataagaaagagcacaaacctgtttgtcttccaccggccccttctgccttccaccttcctgttccaccccaggaagaacaagctctcatctcaaatggcctgagccctctgattccttgaagttcaaattcacaacaaacgcctctccagcctcttcctgagcctcagtcttttttttttttttttttttttttttttttgagacagagtctcgctctgttgcccaggctggagtgcagtggcaccacctcagctcactgcaacctccaccctccgggttcaagcaattctcccgtctcaacctcccgagtagctgggactaccaggtgcgtgccaccgcacccagctaattttttatatttttagtagggacggtttcaccatgttgctcaggctggtcttgaactcctgagctcagacaatccactgccttggcctcctgaagtgctgggatgacaggtgtgagccacggcgccccggccagcctgggtctctcataagcatttggtgtttcccacctctctggtcgccttccctcaaagcatctcagagtctggttggcctggcaagcttcggggatctgactgatgaaagcattttggagcaatgggatgagatgccaaccaatgccgtcagccggcactgaggtgggattaacaggacaatcaagccctcggttcccaggagcctcactgagcagctgctagaactgtgccactaaacaggctttaatttacaggcaataccgactctgggttaactatttctcacagggctccccagctgcatgtttacatttctttccttgttcctctttttcttcttcttctttttttttttttttttttttttttacaattcagcagattaagaacaatagcagggtaactgagaaccacagaggtggctgtaagtgactcattaactccctctcccatgtttccatcaccgtgaattacaacgtcatctctgatgccctcagacagctgttactagtttgatccgagccttgcttgaatatgaatctttttaagccgagcaggagatggttctgctctcaaatagactgccctcccctgggcctcccatttcttaccccaccatcctccttggagatgaaagacttcctgagaaatgaaggctgggtttgcctaattactggagcaaggtggctgttctgctgggaaacgtgagtggtggctttctgtctctgcagaaaggcttgcttttgctcggtcgtcttactagacagccaagcaccaataaggttggctcctttgcttaatgaatgacagaggggtcacagcagcatgcagcattccccccgccccccgtttcttgtgaggcagcctgcgtcgggcccgacagcctccaggagagagctaaaatgaggtccttcagattacatatttcatctgggcccttgttaataagcaaatgctggctgtcccagtgagtgactgggagtgtgtgtgtggccgtcaccttcatttggcattcatgggctccatttaccagtttcataaaagttccagtggggaggccatcttgcaaagctgtcctggcgagcacaagcagagtgctggacaccagccaggagcaccctgggtggcctccacggctgcttatggtcttggcatggaaagggcccagaggaggttacaggacaatgggaaggaggtgggctctccactcagacctcctgggtccacagcccaccaccccaccgaagcctcggtcccttgtccctaaggtggagctgacattgcctcctctcggcctagccaggagtgaccccactttcccagctcctagaatcttcactgtgtcctcccctggatgtggcctacagggactgggcctcctgcagcctttgaaatcctccttgtcattcagttgtgattccaaatgccgttgtcctaggcaagccgccgagtgccccgggaatgagcgactcccctggaccccactttattcactttttatgccccttcctgggcatgcctacaccataactcaagccccccagggagctggtgactggggaccggcatcccagtgctcagcctgggattcggcactcagagggcccgacagcctggaatacactgagcaccccgctggcaccaggccccaaggacaggctgatgtttccacttccctggagaaagatcctccagtcccctgctcggaggctgatcccggctggctgcccgcttgctcagggcaaggaggtaggctggagagggcagacttccctcaactcacccatcttctgtgggttcctcaccagccttcctctgggcctgttgttctcctgtccagtgtctttccagagaagattcctcccccaagctttggagatggggctggggtgggggtggttacctgaccgctgagtcgcagtacagggttccatgttggtcaggggtggctaattgctgtaagaagcaagtgccaacctttgcttggcccagtgaagtggtgtttcctgatgtgttgcagtgggatgtcaccgcaggagacgaaggctctattccacgcagtcacgcaaggacttaagtttcttctttttagaaggtctttcgtctcacagcctttctcagccggggttccaggagggaatcaaggactcacagcaaaggcatcatggtgtgcagggaacgactttcctcctgcatacctggaatgaaaccagttacacaccatccttaggtacatgactggttggggaaatgggcacaccagtcattgactgcaggctgtggttcagatgagaaagcctggttgagaaatgctttagggtctatgccctctggggcctccaagtcctcccctggatagtctgcttccaggtgcccagcaagaaagggcaggaaagggcgtgtgcagcaagggctgccctgacagttatggaggctcaggccagaagtgtggtcatcactctggccacatcccattggccagagtgtagtcacatggtaccacctagctgcaagggaggctgggaaatgtagtccggctgtgtgccctggaagaaaaggcaatagagtaagaagagcacatggtctcggcacaggctctattcttgcacattccttcagactctgcctcccacacctcctgaggctctggggataccctatccctgagccttctggaattttggggccccagttgccctgtttctccttcctggcccccctccctgttcagctgtttgccatctccctgcccacttcccactgatatgtgttggggcttgtggatgtgatcaaggtcataggcacagtctttcttttctttttcttgttctccttgttggggtggggattttttcaaaaggaagcggcaaaggtattgtactatttttgggtccctacactcttctgcctccacattcttctgttgtgtttatgctgctagacctggaaccttaggatgagcaggtcttggcatcagactttgtttgcatcagcagaatcctttctttgaaagagaacagatgcagaaacagatcagagggttgctgctctggtctgtgctgggcctggaggcccagagtccttcctcctcccctgcccatcctgtggacccccaaagccttaggaaggtccctggggctcctgggacacagctcagaggctcctggctggtgtcactcctctctgtgaggcttgaattctctcccttgcattccgaaagtgggtcacactggaataccagctttgtccaaacctccctgcctctggagttagccaaaccttaaagcaggttcttgtgcatgtgtgtatacacagcaactgcaaccacagcaagagtgtccattcacccaacacagacacccaccttgtgccaggcccagctgggtcacctgggagagggtgaagggtaggaagcccttccagaggaggtgctgagtgaggcaggaggccgcaggcgcacacgtctgccctctggcacacgcaggaaggtgctgggaatgcagggagcttctccccagcagaccatgatgcactccgcctgttaccttctagcggtgtgctcactgggtttggcactgcccctaatctggtacctccctttctatacgcatctgtgatttcaggcagataagtgttatgagtttggcattccaatgggatcggtaagaacataaatcaccgatccatcctgggataaatttctcccttcgttctgagaggtgatttggttttcactgaggtgagtggattcttaaggcagtgatcctcaactcccagggcctagaacttcacagaaggtggctcattttgataatgaaaaatgcaggggtgcaaatcaggcagaaagggcctgccactagccaacaatgtgtccatcaccatgtcgcccttgcctgggccagcctcccctctgctgcccatgcaaggcctggggaggaggccagaccgcctgggtccaagccctggctttgcctctcagaggttccggggctctcccagggttggtttacttgtggtgaagcgtgactaataggtaaagtatctgacaaaatgggccccacaggccatggttgctgcttctggctgtccctgctgagagcaggtgtaacgtacctggcatcactcctgccccagagacaccgataacacatgtttgtcagctgtaggtcagttccccaagggtggctgctgtgctactgtaacacgggactgcagactgggcacttaaactacagaactctgttttctcacggtctggaggccagaagtccaaggtgttggcagggttgggtgttggcagggttgggtgttggcagggttgtttcctccagaggcccctctcctagaattgcagatggctgtcattttgctgtgccttcacacggtttcccctgtgtgtctgtgtcctcatctcctcttcttataaggacaccagtcatattggattagggcccaccctggtgacctcattttaacctaatgacctctttaaagactgtgtttccaagtacagtcccattctgagggacctggggttaggactttaacatgggaatttgggggaagcacagttgaggccatagcagcagctgtctcattctgctcacagctggttctctctggccacgtgccagagaggagtacgatgccatccccttaaaccacacacggacatgctgccaggaggaacgtcatcacctttcagctgaaaggagtgaggaatgaggacaagcaggtgcagaacacagccttctcacgtactggtccattctgcacgtgcgctgctgctgttacagcggcagacgggaggctgaactagagacacctaagacaaaccctgctttcccctccagatgctggctgcaagaacgccacagtttgagaggagtgtggacaatagaaagccttgagagcagctgagctgacgaagggatgggaaaatgggcccttttgaagcctaggaatgaccaagtggagatgtgcagggtttgggggtgccccagcttgagtctcagtgctctgagggacatagcgcagagtgggacagcccggtgggtcaacccctgcctggttctgcagacttggagaggtgggacttctgccccaggccgcatggagggccggccctgggctgggtgtgcctcacgctgcctgggagcctcaggcaacctgctgcagctgcttgttttgccactcactggcctgactgcgggagctggaggggctgggaggtcattccctactccacagcttagctcaacctcccaggtgccccgcacccccatccctcccttcccataaaaccagttattcctcatcctcataagcgctcctaggacacttgccatgttctatcagtttgggggttctctggggcagccatccacagatccatgccccgcctatgagccatctcccctctccttctcacccccgtgctccccgtgtggtgtcggcccccgaggcaaggaccgtatgggttttgttcactgcccacactccctctgacacacaggaagttctggaaaagcttccgcatggtgaaggagccacatgcggtttggtcgggtgccccaggcctcctcttgatcatcacgaccaccctgccatccctgttattcggggggagtccagagctccaggaagttgaccacctccccaaggtcccccgagcaggggtgggtggaactggctctgagcccacactcaatgcctttcccctgtgccccggagcctggcttggtgccacccaggacttgtttgtggaagtgacatgtgaacacctagcgagctccatgggctctgcgtgtgtacgtctttgctgactcagtggccccacacagcaacccgagggccagggcagaaagcacaggaggagccaccacgggtgctgcagggcctcaggctgggcatccatcctctacctgtccttctgccgtccatctgtgggttctccctcaggtgccacgcaaggctggtccttcacaatggcccaggccctcaaactcagtggtcaggagggttcccaccacctcagggcttagcggcagtcaaggtaacctcaggtcctcaggctacctttgcaaataggtccttgcaaagaccctaattcacattcacagatactgggagttaggacttcaacatcttttaggcgggccatgattcaacccatgcatctgggcctaggaagtggaactgccccagtgagcgatgccctgggcactgtgcagttctgggggacacagccctgacagccggaggggggctttctgggcacagagctgtctgggatccgccaaggcaacacaggaaggagtccagagctcacctgggtgagacccgagagctgtcagtgacagcagaatccagagggagcccacatctccaagccaggtccagagctcttccaacaggatagcagtcttgtcaggcactctgggaggccaaagtgggaggatcactttggggccaggagttcgagcaacctgggcaacatagcaagatccctatctctacaaacaaaccaaaaacctcagtagcatctttgttgttttttctcttctgtcaggtattttggtagtagtgatcttctgattttacattccctttttttttttttccatgtagaaatctctatggccatttcctcttgtgaattaattgagtttctaaagtgaactagctgcatgttagaaccaggacttttttgagccctttagagcatgctggcaggcgtcatccccaagccccagggtgggtcatatttctggatgatggaggcagggggtgcaggggtcccctatctgcacattgttctgagtctgatgtgattcctcaactcctccatgaaacaggggccatgcttgtcctcgtctggggcaaactgcagttggagaggctggcctcctgtggctgcatatccagagctgggcttaactggccaggaggagagaagaatcctctctcttaataaaaagtccccaggggctgggcacagtggctcacacctgtaatcccagcacattgggaggctgaggcaggtggatcacctgaagtcaggagttcgagaccaggttggccaacatggtgaaaccccatctctactaaaaatacaaaaattagctgggcatggtggtgcatacctgtaattccagctacttgggaggctgaggcacaagaatcgcttgaacccaggaggcggaggttgcagtgagctgagatcgctccattgcactccaacctgggtgacaagagcgaaactccctctcaaaaaaaaacaaaaaaaaaagtccccagggcccatgtccacccagccgtctctctccctcccggccaatgttattctttcctcataagcccttccagagcacaaacacacaagcacgtatgtttgtcttcttttctcataaatggtaacaagctctgcttgctgttgtgcagcttctcttttcacataaaaatacaccttgaagattatttcttatgagtacgtaagatgggcacctgagtagtttgctgttacagaccacgtaggcaatggccacctgcacagattatttgcacaggtgggagtatcattagatgtttctggaagtgggatggctgggtcaaggtgaatgtgtgtttggaattttgaaagataaagtcataaagataagtaaaaacacctggcatcttggctcacggctgtagtcccaacacattgggaggtcaaggtgggaggactgcttgaagctaggagcttgagactggcctgggcaaaatagtgaggccctgtttctacaaaaaaaaaaaaaattaactgggtgtggtggtgtgtgcccatagtctcagctactcaggagactgaggtgggaggatcacttgagcaccggaggtcaaggcttcagtgagtcatgatcacacactgcagcctgggtgacagagtgagagcctgtctcaaaaaataaataaataaaaaatagatagatagattgattgattgatatagagaggataagtaaaaacaaaaacatgtatgtactataaaacctgggatgggctgggcgtggtggcttatgcctatactcctaacactttgagaggccaaggcaggcgaatcacttgaggtcaggagtttgagaccaacctggccaacatagtgtgaaaccctgtctctactaaaaatacataaataaataaataaataaatagccaggtgtggtggtgcatgcctataatcctagctactcaggaggctgagttgggaggattgcttgaacccaggaggtggaggttgcagtgagccgagatcacaccactgcacactcctcataagtgcctggaagggcaacacagtgagactccatctcaaaaaaaaaaaaaaaaaaaaaaaaacaaccctgggatagaggcagagaagaaaggaagtggtgggcagtgtgggtggtctgtcttacctttcataatggagagctggtgcctactgtttagaattcacaaacacagagttcaaagtggttgccactgtggctagggtaggagacatctttttatttctcattcttccatgtacttcaaaaattatcacgccctgtatatcagttaactgttaatgtaagaaaataacatgaggtggtgcagtggcagccgtgtgaatgccggttgatcagtcttgcattcaggacttgtggagaaccgccctgggggatggttttgagcagagcagttcctcgttcccacaggtgcctcatttttccctggttccattcagaacatcatttactgcctagagctaattccagatcctcctcccacccggggcagtttatcaaaggcaaaataaagagggtgggccggggacagtggctcacacctgtaatcccagcaccttgggaggccgaggcaggtggatcacctgaggtctggagttcgagaccagcctggccaacatggtgaaaccctgtctctactaaaaatacaaaaaattagctgggcgcggtggtgcatgcctgtaatcccagctactcaggaggctgaggcaggagaattgcttgaacctgggaggcggaggttacagtgagctgtgatcctgctactgcactgcagcctgggcgacaagagcaaaactccatctcaaaagaaacaaacaaataaacaaataaagaaggtgggtgggggtgactccctgaaagtttctagacgcctcttctaaagataaaaacataatgtgatgcctgaaagagggaagaactgccccaaagagtctgggatgtggctgaggtggccactttgccaggagctgatgagggggatgaaagtaagaactgattttaatcttcgcctctcgtacaacccctggtgggcaccggatgatgccctgttccactgattttaagttgcattttcccccccgcatttccacattctccaagtgagaacgtgtcccgcagtgtgagggtgagctgtcgtgatataattagagtctcttggccttcttggtggtccataagatagcggcatgccttccgatgggggacccgggagttgctgagtcgcagcgcttgcacagcgatgggcttatttggtctctccggcacatggctcagccctgctccgtggccgtgggtggcgtccccggctgaccccctgtcttgcaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggtaccggcgcccgaggccccgggtctcaccgcgggcccaggtcccctcccagctcccagcccccagcccagggcttttttttttttttttttttttaagacaggaatcttgctctagtgactggagtgcagtggcactatctcagctcactgcaacctctgcctcctgggctcaggtgatttttccgcttcagcctcttgagcacctccatgccctgttaatttttttggtatttttgatggtagagagagggttttgccacattatccaggctggtcttgaactcctaggctcaagcgatctgcccgcctcagcctcccagagtgctagaatgacaggtgtgagccaccgtgcctggcctccctgtgttctttatgttcactcgacattgggtctttcttggccaggttgctacctggtgcactttggaaagtgagcagttgtcacctgattgggcagacccttgcaaagggcaatggtaaaagccaatgtttattgatcacttgctatacatcagggccgggtggagcactttgatccgttttcatcttcataacccaacaacgtgggtcattctctgcattttacaaagtctgagactcaaatagatgaatttctaaaaattatattttatatatatttggagatggagtctcactttgtcgcccaggctggagtgcagtggcatgatctcggctcactgcaacctccacctcctgggttcaagagattctcctgtctcagcctcccatgtagctgggattacaggtatgtgccaccgcagccagctaatttttgtatttttagtagagacgaggtttcaccatgttggccaggctagtcttaaactcctcacctcagttgatctgccttcagcctcccaaagtgctaggattacaggcatgggccaccgtgcctggccaagaattgtatgattgctgggctccttggcacttgcaagaggtacctgccaagacctggggaaagccctggatttgagaactcaacagatagcttgtgatgtccccaggaatgcgcagtcatcaagtaaaactgaagcattaacgatcacgagaatcagctcagcacgggaaagacgtcactttaggaggcatctcttcaccttcatgcctatcaacagctctagcagaaaggccatgtttcagaaggaaaccaagttttgttcacttggccaggtgcctaggtatgcgagagagagtagagagcagagctgcccctccctggcattcccctgagtgcctccctgagcccaggagcatccaattctagaactcatggccaggcctgtaatcccaacactttgggtggccgaggctggaggatcgcgtgagcccgggagtttgagaccagcctgggcaatatagtgagactccatctctataaaaaattaaaagagtagcagggcatagtggcatgcacctgtagtcccagctacttgggaggctgagatgggaggattgcttgagcccaggagttcaaggtgacagtgagctgtgattgcactgctgcattccagcctgggtgacagagtgagaccctgcctccaaaaagaccaaaagcaaaataagaaaaaaatggaactcttcagaaggggtggtcccatggtagggaacttcaggggtgggcctccagtagcgggtatcaaatccgtgaacttctgcagcagcagtggcccgcctcaggaatgagcgacccatttcccacgtagatggttttcacactgtcagagtaaattaacatgggctcggggaactctggtactgtcgtcactttctggctcttagcttcatgcagtggcggaagtaagaattctattccccaggaatcacccgtcctgtcctgtgtgttaacccttaccctttgcaaataggtgtgcctgtcactggccgtgcagaggcttggtcagaacatcaaggcactggtagaactgttccaagcagtgaggagcagccacttctgtccaaacgggacagcccccaaaccaagtccccaaaccctgaaagccttcccccgacgccatcgatggctccctggccggctgggtggtgtttctcatgggacacttggttgctacctctttctcacaatgagaaaatggtctgttgtcaggaatgagaatatcaagccaccttcacgtggagtgctcagaaaatcccacagcagtgccaccactccccacgcatgtcactctgctcagtggccactcaccagtcccatcaccgtctcctctgtacacccaccagcagcacagagtcacatgccccaggctgggccactcaggcagagacacgcagagagaccagtggctagactgagccctcggctgacagtgccctaaacaggccatggagaccccagtgctgctgcttcctgtcctgtcggggctggtgatggggcttgccctgtgagtttcagggactcagtctcttttaaactgaggggtaacagccatggagtaaaatgcacacagctcagcaggcagtgtggggaatttcacacatctgtgaccaccactctccctcagcattcccagcccccgacagggacacttaggcaccttcctggcactacccacccccaggcagagataccagcaccctcaccaccctcccagtagaacccttctgccagctctgctcttgaacttcacatagacacccgtgaggttcactagggaacattctccccactggggaagggtcccgaaggccaccgggagcccctgacctctccgagccttgttgtgggctgggcggaagcccacccttgctgcacccgcccaagcccccgggcctctgagcacagtgtcattgcccccatccgcaggccatctacaagatggtgtcgtctgtgatgaagatgccggaggatgagtccaccccggagaagcgcacagacaagatcttcaggcagatggacaccaacaatgacggtagtgcggggtgggggcggggctgcatgtgtacgccacggtaggggcaaaaccatgtggtttggggcaccccctcccctctgcagcttcttggtctcctgagggccacccccgcccgccacctgcctggcgcctgccatgcccagggaagagcgggatgcagtcagggacacccgtgctgtatcctggctcctctgtgcagctttgtgatgctgggcatgttgtggcctctctgagccactgtctccccacttatagaatcgggcatacccatattcccgtgggtacaatgtttaggggcagggaggcaagcatgctggtggccctgaacctggaggggttgagatcaaaggatcccagatgttggggtcctggggtgctggccatgcctctcttgctgccatcctgagagaagaagctgcccagatggccccagtgtccaaggggaactgtcaggatgtacgctgccaccttgtccacctacagcagctctgtggagactcagccccactgcagaagtgcaagtctcacgatggtgggtggcagcagtggtgacagggctgtgcctcgagtgccctcctctgcattggctgtgaggtgagggcggctgtgcggccctcccattctgctcttcttgccggctttgtcaagagcagccacagcaccaggtttgctttgcttttgagcaataaagaaacacgaccttaagaagagaaaatacaggctgggcgcagtggctcacgcctgtaatcccagcactttgggaggccgaggtgggcagatcacgaggtcaggagatcgagaccatcctggctaacacggtgaaaccccgtctctgctaaaaatacaaaaaaattagccaggcgtggtggcgggcgcctgtagtcccagctactcgggaggctgaggcaggagaatggtgtgaacccgggaggcagagcttgcagtgagccgagatcgcaccactgcactccagcctgggcgatagagtgagactccatctcaaaaaaataaagaggaaatactccctgggttgtgctggggattaaacgataagctaatgcccaagaagctgctctgcgaagtctggagtgcagccctcgggtgagttaagcatggccccagcgggagacgggatgtgggggagctgtaagcagcaaagagcattccaggcagccaggtcacagtttcaaaacacacacacacagaaaacaaggctgcctggtgcctggcgttgcctttgggctgatgggaaatgtgtgttccaccctccagcctagcagggcacctgctgccgctctcctgaggctgtccgctcctcgtggggatggtgaatccggtcccatggggttgtgaggtttcagcgagatgatgccttaaagcttttagcagggcttgcactccacaaataatggctgttgttcccaacttcacagtgtccctggggaagccacccatggtcactcgctgcccgaatctgcctcctggcttggccctgcccacctcttcagagggcatcttctaggttggttgggaatttggatggcatggtcgttgctaatgtgcctgctgggatggagcacttcctcctgtgagcccaggggacccgcctgtccctggagcttggggcaaggagggaagagtgataccaggaaggtggggctgcagccaggggccagagtcagttcagggagtggtcctcggccctcaaagctcctccggggactgctcaggagtgatggtgccctggagtttgccccaacttccctggccaccctggaaggtgcctggctgctccaggcctctaggctgggctgatgggtttctccaggacacaagtatcattaaagccaccctctcctcagcttgtcaggccgcacatgtgggacaggctgtgctcagcaaccccctcgcctgccctgccctccatcaggaggagccagtggaaccttcggaagctcccagcatctcagcagccctcagagtcgtcctggggcagctctggttctcctgactggaggtccatctgggctggcctgctctctctcggcctgagacaggagggcctggggtcaggaactggaagtggggaggctggggccgtggactctgaggccccacacctagccaaggagatgaccacacagctggctgccctgagtggtcagaggtggagggtggggagccactctctccattggcagaggttcctggggactgtctgctgagggcctggctgtccctccctctccctacccaccccttagcccgggcattgtttgggctctcttggggccagcaggctgcccaggccccagaggcatcaagttcgtgccctggaagaagccagcctgcccaagcctgggccagagtcccatgaggacaggtgtccctgcctgccagtgggctggaggggctgaattcccagcagggccctactgtgcaggggcatcctccgtcctggtgctggtctgagtcctcaaatgcatcctcccaggtgcctttgagatgggtgttcccattatcccaccttcgagacgaagatcctgagacctggaaacgttggtggcttgccatgcgccagagccgagagcccctcctgcatgccttcccctgtgctgggcctggctgcatgcgtctgtgttgcctgcacagacattttgcagggtgccctagtgattccagctgacagcacagagcctcaaacagacacatggaggggctgccccaggaccaggccgccaggacgcagccaacctcaaacctcatccttccccaccagctggagccagagggaccgcctcctgcccttgaggccatgtctgaacgggcagaatccttacagcctatcctgcttgtggactagcagagccagggctatagtgaccacagtgtgagctcattgacagcggttatgggatggggagcggagggtcagaaaacctcaccccacccagctcagccgatcagccttacggagccctgccctaggccacgagcctccagaggccactcagcccagtgtggagtcaccgagtctgtgtcctgggagagggaatatgttgtcaccagcattggatgcggaggatgagggggcagctgattccttagcacgaccaatctttttctaggttttcctctcaccgcatggggccaaaacagtacagagcatgagtttggtaccccaagcctgagcagcgggtctacgctgatgccagggaggatccggaccgtgcttccgggggcccccaaccagcatggccttctcagcctggattctgtatgggttagaggcaaatgcttcatttttctgcacagtgtacacgttccttaataagcgaagtgtggggtgatttctaaaaggatttaaatggccctcatcagccacgtcctgctgagcttgctgggtaagccctttgaggtacctgatgtattgcagggagcagggaaaggaaaaaggattttttttcagaaatgcctgtaaagtgaatggagactagacaccgtccagcttcaagaaggctcaggactttcaacaaagggagcatacctgacctgagagctgtccccatcctctctggaagcataaagaacagtgagcactggctaatcccattgtctctggtcccctgcaggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctga

SEQ ID NO: 1752 - DNA, 58940 bp, Homo sapiens
ggtggtggccgcccttggggagctggcctctcagcacagcgccgggcaccggggctcaaggtcagtgggtgtgtgtttgggcttgaactgatgtgtgtgtttactgagctttctccgcagcctgctccggcagctccaaaatggcatttcaggaattgaattaccgacatttcagtacttgcggaatccaggaatagattatttgattgtatctgttggaagtcattgccgtaactggcttcgttttcttcaccaacatctaaaccgagtggggagggaccgcaggagaatgctgtggtgacttgattttcccaaaagcacatctcccaagctggcggcagccgatggcgttgccctgtgactgggggaagcctgaggactcacggtcgcctcaggctggccaccttcgcactggaacctgcccatcacatcaaggagccctctcaggctgaaaaccctgtgccggggtggctgcagcaacacaaggattcccctccagctctgtgatgtggggagcagagggccactgagtcctgccatgtgagtcacatgatgcccgtggcctgatttctgtgcccccatcttgcctcttagagtttgttgacctcagggctcacatatcccttgtaaggggttgtgatggcttccacggccatcatggctagttaggattttcctccagcccttgaggaattctctcgggattttttctggccttgcctgtctgcagaatccatagaggacctacaggaatgtctgcctctgagtccatagtacttgcaggcctgggaggctggatcaaggtggatgttgacacttggtggggccggagccctggcttcctggctgcctcatagctcaggcccgtttgacagcatttgtgagcacctgtcccaggcaggagcaagttcaacagcagcaagggctccaggcagagggaggtgggctctgatgggactcaggggcagcctaaatgtagcagagaactgagaggggatccctgaggccttcttggaggaggtggtggttaagccagctaactttgtccattggaaactgtcaccaggtccttattaatcaaataataatgaatatgccgtgttcggatccactagggaaagctgaaattgagctcaaaggaggcatagaagttcagcttgtaattttgaaaaaggaaaaggctctggcctcattaggctgcccccagtgtgtccttgagacctccttactccttgaaatgtgcttcttaacgttttggaaaaaacaactttctccttctatacttagcccttatctcaatgtgcaggcgcctacctggcccacttatcttcaagaaatgtgctgggttaggcctcaggagtggcaggcacatagatactgtatttggccttggccttctgcccaagtggagtctccgcattcctttgtatgggcccattgggcatgcctggctaatctgcgcaccctctttccactctccttcctgcatttctccttcccttcagtagtggctcccttcccattccccaaatcgcctctgcttttatcttcttccaatcgaattcccgtcagtcgtggagcaggtgggacacctgtgtatgttgcgggggcacagagaagcagcctgtgctcacccatgcctgcctgcaggtgcatgcttgggacttggcagtgggggaagattttggggttaggatttccaggctggcttgacactgacctgttttgttccaacccatacaagccctaaaccctcatgtgcagatcctgctggctctctggggaacacttagttggatgcaggtaggaagaggcttcaaggagcagaggaggggctggctgagggccagccactttgtctggtccccagagcggggtctaacatgtgggaactgagcagcaactgtgagctagccctcaggcaaggctgccccatgatgccagggcacatagggcagactccagatgatggggccactgctggcattggccttttgcagggcacaggagtctgccaggggtgtgttttggagccacccatacaggtgtaccagcttttggaaaatcccaaagatgtggtgccctgctcctgggggtcttgggggctcccaggtagcaacagcgttctgggaggacgtgggctcaaattccaacttttctaccaggttttggctatccttcatccccgtggggctcagtttcctcatctccaagctaagggggcccacctaaagttgtcacagaattggacgtgtgacggggcagcccccttcacctgtgggatccgaggcagagctggcacctccaggctgtgggtccagtgacccggcatggagccagcaaacagaggaggcacctccaggctgcagggtccagtgacctggcatggagcaaacagaggaggccagtgggcaggtgggtgttaccagggcctggagcagcaggggtggagccctggggccaggcagggcgggtttggggtggcatgtggtttgttgtggccctgtcatttgcagtttgggttagtgggtctggctggccaccggggttggaggggaatgccagtgggactatacattgtctccttggaggtgactgtgcccccagaactgagtggacaagccaggcttgtgtccacacctgcccccgtcttttaccctcttctggctctcctccaagaagagcttttcctaaatcattcgccctgttcacctgggctttgaggccccaggtgtaggcccagggggtggggtggggtggggggatggtctctgactggatagccccacctgggtaggaagcccccagtgtggccccaccttggctgtgacctgggggtcctgcagagtcctgtgtcctgttgcagtgaggggtcagtcagtgggaagagtggacaattaggagacaccatgtctgtctcctcgacgccagtcaacactgttgcctttgttcccagggcagccttccccttgccttccattccaaactcctcctcctccctctaagattccctattcacctcctagaggaggccacctgagtgtcagccaggcactggacctgggcctgcccggaaaggtccctgggcctggtgtgctccaagaacctcgctgtcaggggtcagcgtgccatggaggatagggagaggcatgtgcccttggggacgtctggctttgtccggggggttttctgctgctcactggcttcaggtcagggcttggctctgtgctgcagccttaagccagcgggcccaaccgcctcctccaggcccgccagcgcctcagatgtttctctccttcttagagggtgtttcacatcctttcttttgtttgccctgattatttttgcagatgaaggaatacacacaatggtcatctttgtcttatttgaaagccaaacacgttgcttacacgttgggtgcacagtgaatatgtatcagtccagcgcttttcaccatctggtctggttttagtgttgctttatttctggtcattcctcaatcggggctaaagatcagaaaaatcgcatctccaggtcctgagccatggcgaggaagctgggtggtgccctgtgctgtgtggctaaggtgggggacgagggttgtcggtgggggaagccccatgggggccccactggagtcataggagcgaatggagcacccactccatgccttctgtcaattacaaagcacctattatgtcccggatactgtgtccaacacagtggacacattgatgggtaaggcataatccccccccaggagctcccagttggattgaggaggcagacaggcgagcgtatggctgtgacacacccagcaactcccagttggatcggggaggcggacaggcgagcgtatggctgtgacacaggggggcaagtggcgtcaccaaggcagaacccagcagccggggcctgaagccccctcacccagctgcagccttcccgaaacagctgagatcagcctggagagctcttcctccctgcctgcccggagggtggcgtgggtcccatcgctctccgtcagccacggccagagcacacctgtgctgctcctcagaagggcatcacctgtggagacggtgacagctgttcctgttccctgccccaaggacaggatctggagcctgtgggtgtgtaaggagccaactccctgaccccaaaactgtggccagttctggagaaggtggccaggctctgggtcccgggactgtggcccccctcctgcctctaaagcccctcttctggcctccatgacttcagcccctcctgcccccagaaggagggatcagccctacaagggacccaagagagggagcctcacacacaggcgctgcctgactctcctccaagctggcctgagccctgggcagtgttctgaggctcagccacacggctgtgcagggcaggtgagagcggcagcctgagagctgcgagccggggccggggttttcctggagcagcaggagggatgagttgggtttctgtaactacaagggccaagaagagggagaggatgatctgggaaggagagtggctttgggccagcatttgggccagcaggactcagaggcgagggaggtggtaagatcccttgcttgggatgagaggcagatggggaaactgaggcttggagcagagggaggggcagggcctgggcccccagcaggtcccagttcatgatggcatgctgcttctgcatgagtgagacatgagggggtcacagacgcccggaagcatcggcatcatcagatcatccgactcgataatagaaaaattaaaatttaaagtcactgaaagtgacgagtgacagaaatgttcctagaaactggagattgggtgctcagcggatctcaggatagatgatatcagacacaatgtcccctgggctgaggtttttttttgttttttgtttttttatgtttcagaattctaaggcaaggatgaaagtcttctctattcttgaggtgctggggttcctcagcctccaccgtccagcctcgagcagctgccccctctcacctgctcctcagccttctggaacagacaggccccccacagcagcccagcccaggccaccagcaccacccccagaggtttatgccatcttcatgcagtgggaggctcagcccccacactgggacctgtccactttagccccaaggatcttaccaaggtcaaatctttggaactcagggtctttgggaacttctgggccagacaacccggccatcacaggggcttctgcggggttggctttatgatgcatttgggtcaggaggtctgtttttatcctttgggcctctgggaaagtccgtcctggccaagtcctctgtcccctagtctcatggctggctggccctggagctcgggtggcctggcccggcccgcctgcttccccacaggcagcggctcttgcttctgctgcctgcagtgctccagatgctgcaggctccttccttccttcagggcatcctaagtcccccgagtctcgaatccccagtctcagctgagtcctcgaggtcagtggggcagaacgccagagccctgggacaacgggctgcataaaacacttattttaattataagagtgatgtaagaacatatcagaaaattggcaaaatacagggcaaaaaaaaaaaatcactggtggtcgccttctcacacagtcacacacagtggtgtgcagccttctggcttttggttgctttgttgcagtattggcacctgcgttacaagattttgtgttgaccattcttgttcttgctgtggtctttaaggtttacagcgacagctgttcctcttcaggatgcaaggagaccgagcctgcctgccctcagggagctgacggtccagcaggaggcatcctgtctgcagggcccatgcgggggacagggcaagaggtgcggtggaaccagaccttgccctccagaaatgcagggagacagacacgggcgtatttaattcaactatagcatgtggttctgagaaggcttcttggaaagggcctggggttgagctgggcaccagcagggaggtctcagagtggaggcggcagttccaccctacggcgtagaggaggcgccctgatcactgcctttcagccgtggccctgcctgtaatcttatcctttttgttgattgttgttggctgatgttggctgttgctgtgtcctccaccagagtggagaactccctggggctggaccccttgtccttattcacccagagaataggtgccttaaaatactgactggacagaaggaggaagagatgggttggggggccgtgtcatggaagaattccttgggccagccgcagaggagtaggccttggcagagagctgggagcctggaggggagctgaagacctctcccatagtcagctgcctttagggaagaaatactagaaagtcacagaagagaaaagaggcggggaaggggaggaaagcatttccacccacagtcctgtcgggagaggtaacattttggagtacagtgtgccctgccccagcaggccctggctggatgcatattcctatagatataattctataagtgagatcattccatatctactattttacaacctgtttttgttttttgttttttccacttagcaacactttgttcttacctagaattcaccaggcaggacagggctgatgagggagcccctcccacctggacactcagtggcccctcccaggactcggggctttcctgggggcctcagctgcggagcaacagctccctgtgcatcagagccgtgggggaggggggccagggggcataggtacgaccaccactcccatttcgtgtcctttaggaagcttgaagaaaagtggttagccaagaacacaaattacggtgatgttgtttgcagtgtggcgtgttgggttaacataaactctgaagtcagaattgacatcaatttgagcccagatcatcctgttagcagctgtgtgacctgggacagggtgcttaccttccagactttagttccctcactgtacaacagggacagggatcatacctttctctgagagttgaaggaagaagtgaaaccaaacacagccccatgacagccccttatgcatggtaggcactcagcaggtgctggctcccttacggcccgaaggaatcgattgacaaactctcaaattaatgacataattcaagagagtagctgcggagacaataaataattatagtagctgatgtggtttggatgcgtgtcccctccaagtccatgttgaaatgtgatccccagcattgcaggaggggtctggtgggagttgattggatcaggggggcagattcctcatgaatggcttgggccatccccctggtgatgagtgagcaatttggtcgattaaaagagtgtgtcacctccctattcttttgttcccactcttgccatgtgacacattggctccccatcgcctcccaccatgatcgtaagctacaccagaagcagatgctggcaccacgcttcctgtacaggctgcagaactgtgagccaattaagacacttttctttataaattccccagtctcaggtactcctttgtaataatgcaaacagactaacacattagccatagccatttattaacataattttaaaagatttcagtcttgtgctgaaattgttatgttgatggttacacatttgtcaaaacttagtgacctgtacacctaaaaggatgaacttaattgtgtgtaaagtataccttaataaacttgactttacaaaaaaaatccctcttttttttttttgagattgggtctcactcacccaagctgcagtgcagtggcacaatctcggctcactgcaacttccacttcctgggttcaagcaatcctcctgcctcagcctcccaagtagctgggattacaggcgtgcatcaccacacctggttaatttttgtattttttagtagagatggggctttaccatgttagccagactggtcttgaactcctgatctcaagtgatctgcccgcctcggcttcccaaagtgctgggattacaggtgtgagccactgcccccagcctttatatctcttgactgtcacaaaatgcatattttatttaagtttgccataaacagaacatttttacatactgtattgtaacagtatataatacaatacataccgtattgtattgtgtgtagtacaatacatagcgtattgtattgtgtgtagtacaatacatagcgtattgtattgtgtgtagtacaatacataccgtattgtattgtgtgtagtacaatacataccgtattgtattgtgtgtagtacaatacataccgtattgtattgtgtgtagtacaatacatgtatgtaatacaatacatactgtattgtattaatcagatatgttgtcctgtgttattaaaatcatcccttgtggcccaaatttgaaggcagtactctgttcctgggtgtgcaccgttaacttctttaatgaacatcctgctgttcaatagtgaggctgcatccttctagaaagcgctgttgagaggtgtgaggaggctgccacgcaggccgcgccgccccgaatggcaggtggaaggcggctgagtggagccgcagcaaatgcaaccctgcccccgagccaggccccaggctgcacctttccactgcttcacaccagcagtgctttacctggaaaggtgtctgaacagtgcttgcaaaggtaactggcattctgccggctgctcaactctgtggacaccagtacagtcaacaactctcactcgccgcgggcacctgctgtgcccacctgctgccatctgagtgtcacgaccacacccccatccctgtcctttcacgcactgtctgcccgcacacactcttccaccctctgtcggcagggcccctgccacctctgaagccccctgccagctctcggcagccccctcctccccctggctcccgtgtcctgcccacctccccacactggcacctcctgagcagccctggctgagcatgcactctgagggcagaccctggccgggcaccaagatacaaaaggttatgagggtgttctcttgaggaactgagtccagtgtgaacagtgaacacagaaacataaagggacaccagaatccccatccccatccccagggtggtgagccaccgaggggggccaggcacgggggagggtattcaagggcggcaagccaccaaggggacggggcaggcacagggagggcatttcagagagtgcaaggaggcggcgaagatgctggttgagggcacgggtgaggcggggaggcgtttcgactttggactgaaggccttaattgaccaaggcggtaatttccagtcctgtgacctcacgacaggctggacattggaggatgggatgacactggctcttctggggtaacttgtctgggtttaaggttcttgatggggtttaggacatggcgggaccctaaggatggtgccagcatctgaattctctgccgtcttgcagagtcaggattctgcagctacttgcccaagaaaaagtagagaaaggtggtttcatgtttttttttttttttttttttttttactgctttgaagggaggtgtgggactcgtttgcacacacagttaatatttccaaggcttgtgcagggccagacagatttggttgcagctgttagttttacttcctgtcccgataaaggagggtgcttgcctcagctctcacctgctgccataacaaagctccatggaccgggccgcctaaatgcagacacatactcagctctggaggcgggaggtctagatcagggcgtccgcattgtcaggttctggggagggctcttcctgctttgcaggtggcttttttctctgtgtcctcctgtggaatgagagcaaactatagtctcttcctcttcttacaaggacactaataccatcatgggggcctcactctcctgacctcaccgcaacctaattactttccaaaggccccaccccctaccaccatcgccctcggggttagggcgcctgggtacacatttgaggagagggcacagccgttcagtccatgaccacattgcatgttccagggaggaactggagagaggctgctgtttgctgggcacctgagctggttatagatgttaaatcctcacggtagaaaatgtggaaaatacagaaacaattataatgcataatcctacaattcagagatcatcacagcagacatatgggtccatttcttctggtcagtattcatttacagcgaggcggacagactcatgctgtaattgagtcatgctatgtatttgtttcaggtcccgctttttctttccacttaagacaatatcattcatttcctgtatcattaaaaatatttgcggtcgggtgcggtcgctcctacctgtaatcccagcactttgtgaggccaagacgggcagatcacttgaggtcaggagttcgagaccagcctggccaacatggtgaaacccccatctctactaaaaatataaaaatttgtccacctgggccagtgcgtgattccgaagactacatttgaagtccagccttgcagctttccaaaaacccgtgcctccctctttctgcttgtaaatgtccctcacaactggtttcccagaaaaattgtgaggatgagcgaggtgttgcttgtggaagttactttggagggaaagtgtttgtgacaccccatgggtgtggcccatggggctcctgagggtggatggatgtgggagtggacaggcctggctccttttcttggtgggctgggctgggctatgagcaggagctatggccgtggctgacccttctgcaatgggagctgagcagtggtacagttagatagctgcgcagatggtccgatggcccggcctccaaggccttgagtgatgggatgaccatgaccactggatgtctctcaataggctttgccttaaccatgccagcagttcccccatctgctttatcagccctggtatgtacatcagattggctaagggtgcaaaactggaatgctattaaattccagaggctctggtcgcttgaaaagatgagctgaaaataagataaaatttcacagggttaaaggcaggctttgcactctggtttaagtatagagtcgtccattcatgagagtataggtttgggagacaatagcattgaagaggcttgagcgcacactcagaaccagtggctctttcttagtctgtccatgctggctatactgcagcccccctcaactggaatcagatgtggcccaaccatgaatactttggacaaagctcccccaagtcaggcatgccctcttgttagggaaggtggattcctgacctgagtccatctggaggtccaggcaggaattagaaccacttcagaaaagctctgcacagatttaattgcacgagtacctgcgtctcagagctgcagactgagtgtgttgtgcaattgttgggcggcttttcccttggccacagtagattcgcaattaagaaaaacaaatgcagctctcagtcagaagtgtgcaaggtttgcttggtctggagacagcagcttctgtgctctggggtagtgaggaagtgtgtgggcaggttggcaaataagccacatgtatgtcccctgggctcagcccccatcttagtgggcacaccagggcccacgagatctggggactatttatgtagggtctgctggggcaggggtgtgggtgggtgtgcgctgcttgtgttgttgaattgggatttttccagccagaccagtctgctgggacaagccttctggctctgggccaaaggcctccccagctgtgatccattcaggcctagaaagctgggggtgctgactgccatcacccactggcctccatggtgtgtccacagagggccaccttcctgcagggctgagctacttctgtctgggtgtagcttcttgtaaagtccctagcagggttgctccctacaacccacccctccccattttctctttctctctgcatgactattattcactcttcaagtctctgtttagatgtcacctcctctgggaagccttcccagattccaggtggggctggaggcccttctgcggactcccctggcatcctgcactcactcacctatggcacatatcattggccgcaaaatctcctgggcacttatcacactgcgggttccttgaaaacaggaatcattcttgttctctgctgcatcttaggatggtgactggcacatagtaggagtccaattaagaatgttttgaataagcgaaagagtgcctaaatgagacttctattccagcttgaagaccagcccaccaccctgataagaaagttcaagtgtgggaaccgctggggatcttgatggcctgggacctctggatcagtgcttgtgcaggacagaggcagccccggagttctcatgggggctggtgagcagagtggggccccaggatgcctgatggcccggtctgaggtgtgcaggtgcccctgaggtgggcaccacccaggagatgcatgtatctgtgaaataccagataggcccttagtctaagcaaggaggcatctaagctccttaaagattccacaaggatgttacgttgtgctttgaacaacagagacgtggctctgctgagccccagccaaagctctgcacagggaccttgactctcccttcccgctgtgtggctccagcaagtttcctcccacctcaggtctgggtttccaggcattaagtgacaaagtggatgcgacgctccttctggactgtaatgcgcactgcgtggagatgttcgtgttccagtgtagacagggcgttgtcacatcaggcaggactacagggacaatgtttgtcagcctgtcttctgggcaacttggggtatcctccctttatatcacctcctgcccaggtgctctgcgccgccagagcatcatgtcatttgggatccctgatggcaattttgagactttggttcacagtaaagattggtcctgtgtgatcttaaagtaatgtggcttaaaaacaaatggctgtcagggaattgtaaatcaaagcaaacaccgatgagaatggcccaaatccaggacactcagcaccaaatgcgagggaggatgtgaagccacaggaagcctcactcactgctggtgggaacgcaaaacagtacagccaccttggaagacagtttgacaaatccttagaaagctaaacacacttttaccctgtgatccaacaatcatgctccttgatatttacccagaggagttaaaaaaacttatgtccacacaaaaacctgcacatgggtgttcatagcgactttattcacgattattcataacagctggaacttggaggcagcgaaggtgtccttcagcaggtgaatggataaattagctgtggtgcatccagacaatggaatattattccacagcactaagaagaaatgagctagcaagccatgaaaagacatgggggaactcatctgcatatgagtaggtgagagaagccaatctgaaaaggctatgcctatggaggattgcaactctatgatatcctaggaaaggcaaagcgatggagataataaacagatcagtggttcctacgggttaggagggagggagggatgagcaggcagagcacagggcatttttaaggcagtgaaactgctctgtgtgatactgtagtgggggagccatgtcattgcacagttgtcaaaacccatagaatatacagcaccagcagtgagtcctaatgtaacctacggacttgggtgataatgacgtgtgaagagacaaggcgggttcatccgttgtaacaaacagccaccctggtagtagggagggcaggaggtatgtagagaactctgtgctttccacgcgattttgctgtgaactaaacagctctaaaaaataaagttcattaattaaaaaaaaaaaaaaaaaaaagggaaatgaccacatgcaaagcactgcgtggagggccacgcatcccaagcaagtcagctagagtagaggcaggaaccaaacagctctatgaggttctggatgagaagccgcatgcaccaccccctccctgctcccgtgtgggacccagtgaagacctcctgtgcccggctgcagctgctgagtgtgggagtgtgctctccacagcaaaccagccgtgaaggctgcacaccttcctgtttctgcccagccacaccacagggcactcagcccttttcctgagcacttgaagctgcgtttcctcgagctccttcctgtttaagaacaggaggggagtggcggctcgcttgtgcaccactctccagggcagtggtgtgcgggacaccctgcagcacctttgactcctcctctgggaatgaggcgtggtttaatctgcaaccccttaccattagagtctgcaactagtcaaaaggtgaatctggctgggcgcggcggctcatgcctgtcatcccagcactttgggaagctgaggcaggaggactgcttgagcccaggagtcctgaccagcctgggcaacatagtaagacctcctctctacaaaagtaaacaaaactagcctggcgtggtgtcatgtgcctgtggtcccagctactcaggaggctgaggtaggaggatcacttgagcccaagaggttgaggctgcagtgagccaagatcgcgccactgtgctccagcctgggtgacagagtgagacccaccccccttttttttcagaccgcatcttgctctgttgcccaggctggagtgcagtggcacgatctcggctcactgcaacctccacctcccaagtttaagcaattcttttgcctcagcctgccaagtagctgcgattacaggcacctgccaccacacccagctaatttttgtatttttagtagagactgggtttcactatgttggccaggctggtctcaaactcctggcctcaagtgatctgcccacttcagcctgccaaagtgctgggattacaagtgtgagccacccagccctgagtgagaccctttctcaaaaaaaaaagaaaagaaaagaaaaaaaaggtaaatctaagaggtgaccagtaggggaatatatttgtcgagtctcctcacctcagcactgttgccatttggagaagcataattctttggtgtgtgcggggaagggggggctgtcctgtgcattgtggggtattgagcagtatccttggccctacccataagatgctggtaggcatgtcccctcaactccccagttgtaataaccaaaaatatctccagacattgccaaatgtacccgggaaaatcactcaggttgaagtcactaaattatatgtgtgtacatataattacacatgcatatacatcgcgtacacacacacacccacacacacacacaccttttgctggtggctctggattggtaagctggctccatggcaagaatcagcatcctaatacttgccccaccctttaaaataaacttcccaatcctaggcagacaaaagaacaaccccagacctcctccctcagggtggggacaaggtgagggaggtggcggcccggcaggaaggtcatttctttcttcagtcacatcagatgagctgcttcccctcactaggagtggatggggctgccagtggtgttcttgcaaaataccccttgtgggaggagaggggtggagggagagaacaccctccacacatccccgtgggatgtctggagggaagggttttgggcacccaccctggggagagaggagagcccaggttaccatctgtggtgtcccctcgctcacactcactactgccctccacaaactgccatgcttgcttggtgcacggtgctgtgctgggcactggggcaaggccccctcccccatggggctacagatgctaatctgcaaatcccagaaaagtggaatctcggtggcagagtggatgaaggggaggtgctcagtgctatgaaagccagcagctgggagtttcaggggcttccctagggagggaccctgagctggggtctgaaggaagagcagttcactggggagttagggagtgttctaggcagagtaaacagtgcagtggcagccggggctggcacttttaaagaaagcctcaagacttctctttctgattgtgaagtgagctgagcagactgaaatcaaagatgtgaaaataaagatagaggcgacaggctgggtgcggtggctcatgcctgtaatcccaacgctttgggaggccgaggtgggtggatcacaaggtcaagagatggagaccatcctggccaacatggtgaaaccccgtctctactaaaaatacaaaaattagctgggcatggtggcacacgcctgtaatcccagctacttgggaggttgaggcaggagaatcacttgaacccgggaggtgaaggttgcagtgagccagcctggcgatagagcaagactccgtctcaaaaaaaaaaaaaaagatagaggtgacaggaagaccccaccatgagtggcctccactgagtgcgcatgtgagtgagcagctgtgcggtggtccttgccatcttcccatcagcccctcccagcccctgggcctggagaggctgagaatctgacctaaggctgcccagtggcgtgaggctggcctgccgagcttacgtccctgggggactccaggaccccagtgcttcctactggtggcttcagctcccggtcacttgtcgggaatgcagggctgaacccctggaggttgtgtgggacagggcccaggaatctgcattctagcaagcacctgctccaggcttgcttccctggcagggaggcttggtgatccaagttccttgggtgcagacacttgctgcttctctcggaggccgggctgggctgtgattttttcatccaatgtgctgggctgatttcacttgcggatgcagaatgagaagctgtagaggagatcacggcaagctgtctgcatggacgatggcagaatccggtgtctgcttggccgcgtggtgtcactaataggatttgccgagccttttggatgtttgtggcgcgacggctgctgtgggaacccagaggctgctcatttgcagggaatgaataatttatttctgttttcagatgacttattccttcatctgcagccgagcccccacatgttctgtaggctcctgattaagtgatttcagcaggagaatttggcttaatcccccactgccctggacgcctggttccaggctgctgatttgtcggcctcgtgtcggggggtgtccggagcctctcctctctgggggcttttcttcctgctctgcctgtttgggaagcctctggccactgagcatgtgctggccttgggttttacggctgtctggcaattagaatattaatgtcgataacacagcaggacttgcgtgtgacaagctgagccacataacgtcacagtcgctcttgaacatctcggactttcacatgggccagccacaccccagcctaggttgctccctcacctcctcagggcctccctgatgtcggtttagacatgtgccttccatcttgcctgggccaccatgttgatcctctgggtccattgctcaagagcccaccatggctccctgttgccaaatgcagcctgaattcagtattcaaagccctccgtgaatgggcttggtccttcctccctggcctctcttgcgtggctccatgctctgagctgcctactcgctgactcattcatttaatgtttattctttggttgttgtttcagcactgagtgggtctgtggaatcatttacatgtttattgagagtccccctggctgcagatgctgggcaggggctttgatgtggggagaaagacccccccccaggttacaggtaagccctcccaagtggcccagggccctgggagggggtgaggttgtgtgagatggcagtgtgggagagtctcaaatttttggcatctttaatctgcccactgggtgagattgaggactcaggtgggtgtcaggggctttgaatgccaaaccacaaaggtctgcaggctgggggagctgcaggaggttgtcatcagtggcaggggccttggagcttggtggaggagaccacgcttcagatggccagctggagcaccccccaccagccccgctgcctggaccccttccacctctccatggacccacctcaggccctacccaccctctgcaccgccttgcacggcattgcttaatttcactgcaatggctcactggggctgctttcctccctctcttattgctctctgggtgagagttggtctctggcctccacatgaggcagggacagtgcccagggagtggccagtgggagaagcggggcttgcaggccaggtgggcccaagtgtgattcctggtgcagtgctggtggctgtgtcgcccggggcaagtggctcagagcctgtttctcatctgcagatggggggatggtctgtacctgtccagcacccatgaggagcaggtggaacaggatgtggcagtcaagggctcctgaggggacccgtaagtgccacattcagccttctgtgttaaggaccatgagtccaaagagtagtcgcgtgtgaatccacctccttgtgccagcctcacggcctcctcaggaagggcatggaggagcagtgggatgcccacggtaccgtggaggaagcagtcctggaggaagggtgactggccgagggccatgcggtgacgcactggggactggctctagctgctgtggggcacgtccacgtggagaagcgcttggtgtattcccccaccctctcacccccacagcgttcctggtgctctgggtgcctgctgtttctgagccatctaggtgggcacagggacaacctcaccagggacagtgtggccccatgctggtaagcaggcgatactgaccctggttccaaactgcattcctgttggtcctttgtcttgctcttccggtatcattacgaacacaactttagaaagtttaacagtggtactcagagaggcttgtggccccaactcatgtgacagtgaccaacaggtgaaaggtgacttgtggtctgaacacctgcaagggacacttattccgatgcctgaatctttgcatctctgcccagcagatgacagcacctggagtgttagctggtcatacctggacctgcgagtgtaggtaagacccttcttctcagggcctgtttgctcaactgcacgatggaagggttgggcaagatggatctttcctttcttttcttttcttttctcctttgcagttgaacatttttcttgccactgaaatcacaggtggaggtctgtgtgttcggcaggtgaatggccatgcaggggtggagggaggcctggatgctttttcttccctgcactcgcaggccccccatgggaccctcagcccccagaggacaattggaggcttctggactagggttctaaggtctcctgagaaggtcagaggctcgttgtccggccaagacagacagcagacagttggcgtgtctcagggtaggaggctccccaaatagaaagtactggattgggagcggatttattgttccctgcctccccggggccgtcggcatttcccctgtggctgcctcactgttctgatgttggcaaaggtttgttttatcttcctccttccagaacaggaggtgcctcagtgcctcagatgctgcctgagaaggtcagtggcatctgggagccatggtgagggtggcagtgactgggctcgggaggttccagaattctgttagtgagcagtgagctgttttattttccttcctgcctatggaaggtcctgagtgaacaaacaagtttcagtctcaagacaacacatcgtgtttcgaggtgacctgtccccaccccacccctgtcactgggagaagactgcaggtctcacggtctcccgtctgtctctgctgcccccaggtccagggactcctgcgatttctctccctggtgcctggtatttttgtagcactctctggttttcaaagttttcctacaacaattgtgcttaaaatgaaatataaactccatccccagcccccaagtcccactccctgccgacctcgtctcttactgggaaggcccatctttgtcaccagcagcagctgtgagtgcctcgtcagtgtttaagagtccaggtcgctgcagcatcttggtgtgtactgtggacccattgtgtgtgtgcccccaaattcctgtgctgagaccctcactccgagtaggatgttattaggaggcggggcctttgggaggtaatttggtcattagtgcccttataggaagaggatgcgagccagacctgcctctgctgtctaccaggcaagtatataatgagaaggtgacgtaggaggcgggactcgactccagaggcaggactcagacaccagaccaaattgaggactagctacaacagggccagggtagaaacagctttccctaagacgtgcccaccagtgtgcatgtcagtttaccactgccatggtaatacccggaagttacggctcctttccgtggcaatcatctgacgacctggaaattaccacccttttcctagaaatttctgcataatccaccccctaatttgcatgtaattaaaagtgggaataaatctgattgcagtgccgcctctgagctgctgctctgggcacactgcctgtggggtagccctgccccgcaaggaacagtccctctgctgccgctgggcacagctgcttcagtaaaattgctaataccaccggctcacccttgaattctttcctgagtgaagccaagaaccctcctgggctaagtcccagtttgggggctcacctgccctgcaagatcaggagccatctgtacaccaggaagacagccctccccagaactcaactgtgctggcaccttgatcttggacttccagcccccagaactgtaagaggtaaatgtttgttattgaagccacccagtctatggtaatttgttagagtggcctggaggaagacacagtattaagtaaggcttcgtgtctgacttcactgaacactgcggttgtgagacgcatctgttgtgtggggcactgaggttcattctgattgctttatgggactctgttgtgactgtactccagtttctctgcccgtggaatgtacatggatgtttggatagtttccagggtggggctgggacaaattgtgcagctctgagtgttcctgcacatgctttgtcttggacatgtgtccttctttctgttggacatacatgaaggaggtcagctgctgcttcacggggcatgtgtgtggtcatctttagtaaatatgccagtttttcaaagtggtcatagacagtagattccttttattatgtgacaagagctcaaatgccctggtagtgggagtggcagcaggagctacagtaagacattgcacattctctggaagtcagggatccctgccagtcagttcccagtgccccaggaaccaggggtttggtgctgggcactagtcatgaccactcgcggctcaggtgttgggtggtctttccagaccttcacctgtgtgaagcttgcaacctggatggtctcatgtggacatcttggcttccaccctgtgctctgtgtctggtctcagaccacagcccaccctggtggtctcctcaggacacataggctcctctgtaactcagtttcttgaattgaacaatggaagaaaatgcctctatgaagagaggtcattgtgcaaaacgtctgtgtgacagtattcttggagcaactgtgcttatcacccggaggccacagtggaattagtcatttgaaaaccagtcacctccaaaatagtcataatccaaaaccatccatctttgacttcagactccattataattttttctccctaagggactttgctttgtaattatgttggatttcctaatatattaaaataatttgtcatctcttgagcacacatctgcctgctatgagcaagcaggagaggccacttccggttttctgcaggtcccagtgagcatgtgaagcctgcgcctgggcaagaggttggatactgggaggaagaagcttttccagtaccctttcccaaagaccagccagtgagggaaatgggcaccgaatgcaccccaccccccggcctgggactgggccaagaaggaggaactgaccccagaaatggccccggaaccataacctgcttacactgtgacctgcagtgcccatggtggcagcctgggctgtttctggagttgagcggagagttcctccagtctaaactccttagagaacatgaatattcctgagggcctggggtccggcaccaccttcagtggactggatcaccttcttgaaggcagagagatcttaagagcttatgtctgactgcctacccgatgcccagcactaatctgcatgcaccccactgggccatgggcttctcaaaggtggggacgctgtccctgtacctaacacacatggtgggcactcggcctaggtttgcagggcctgctggggagttctccaaggcagttttatagctcagctccagcaccttcctgggggcccagtcctggatttgaggctgccaggggggtttgcagtcagctaagttggtacccatccatcccttcccctctgtaaggggtgacaagcactaagacctgttatgtcccctggaagctctacactctgtccccttgctcttgtgactctgctctttgctctcctgtccactggcatataggagtaggaggatattgacttagattcctttttattatttttgtttaaatcagctttgtggaaatgtaattcacataccctaccatttacccatttaaagtatacaatgtaaagtatacaattcagtgatttttagcatattcacttgtatgtgcaattatcaccatggtcaattttagagtgctttcatcactccaaaaggaaacccgtaccctttacctgctagcccctctttccccatccgctcttctgccagccccaagaaactacgaatctactttctgtctctgttctggacattttatatagatggaatcataccacatttgtccttttgtgtctggcatctttcattatatttttggggtcttgttgctgtttttgtgacagagtctcgctctgttgcccaggctggagtgcagtggcacgatctcagcttactgcaacctctgcccctccaggtttaagcagttctctgcctcagcctccggagtagctgggattacaggcgcgtgccaccacacccggctaatgttttgtatttttagtagagacgggatttcaccatcttgtccaggctggtcttgaactcctgacctcgtgatccacccaccttggcctcccaaattgctgggattacaggcatgagccactatgccaggctgttgttgttttttaagacgtggtctcgatctatccctcgggcgggagtgcagtggcatgaccatagctcactgcagccttgaactcctgggctcaagtgatccttctgcctcagcctcctgagtagctgggactacccccatgcaccaccatgcctagcttgtttatttatttagtagcgatgaggtctcactatgttgcccaggctggtctcgcagtgctgggctcaagcgatcctcccaccttggcctcccttagggctgggattacaggtgcgagccaccacacctggccaagaattggtattccttaaatatttgtagaattcagtagtgaagctatttggccagggcttttctttgtggatagtgttttgattactaattcaatctcttcacgtgttataagtctttcaaattgtctctttcttgagacagttctggtagtttgtgtctttctacttggcttagattttgcaggcctcccctgctctttcagtcatagttgacatttattgagttctttctatgtaccaagcatttgttgtgcattagctcatttaatctttacaaaaacttgatgagctaggtagtactattgtcatctccattttacaaatgcgggagtggaagcagggagaggtgagataacaggtcaaggtcacactgttaggaaataggaaacagtccagctgggctttgattccagacagtccagccatgcagcccctggccttgccacctccctctgccattctccagagactcggagaggggcctaaggcctgacatgaacgaagggctgggggaggtggggtcggaagggccccaggaaaagcgtgtgtgtgaagggctcagactcccagttggggagttcggatgtccccttctggggctttcatcttctaacctcctctcccaagcgctcagccaaagggcagcacagagcaccctaccctaaggtgtgacgccccagctggcaggactttggagcagtagatctgtgcccagcaggtctgtatgaatcacccaggcctctgcattttgcttttctagaggaagaggcatggcaatttgtaagacaatcgccagacagaaatcgggagcaaccagacataactcaacataattatttctgcataatgacttctgctacttgattctgtctcgagcaatgactgtaatctctatctgtcactgggaagctggtggccagggagcccctgtggcttagagatagagccaggaggaaatttgcaattcgagttaatggagtgttcccaagcagcctgagcgccaattccttcaaggtctccggaacagcagacccccttcctgctaggaagcctggtgtcagagctggctgggcctcctctgcggagtccagctcatccactttgtcacagatggggaaactggaaatggcagaggtcacaggatgtgcccaaggcacaggccaacctggaaccagcacttcctctccaccctcccaccacccagcattttccccttcagctggcctggctgtggtgggacagaggaaagatgcctctgtggagctggtcactgagagtgctggccaggcagggctgcccccaggaagctggagacagtggggcctttgcaaccagatagcgagggacctcaatgtggagatagggtgtgcttgctgagcgtgccagcaggcttgtgctcacctgctccagctgggggcatgcagaggcccctcctaccccaggaggatgcttattcactgcattccatggccttttaaaaatcccctttaggcccgggcgtggtggctcacacctgtaatcccagtactgagggaggccaaggcaggcagatggcttgagcccaggaatttgagaccagcctgggcaatgcagtgagatctcatctctactaaaaatgaaaaaaaaaaaaaaaaagattggggtgcacctgtagtcccagttacttgggaggctgaggctggaggattgcttgagcctgggaggttgaggctgcagtgagctttgattgtgccactgcgctccagcctgggtgacagagcgagatcctgtctcctgaaaaacaaacaaacaaaaaaaaaaccttgtaactaaccagagcagctgaaaagaacagagcatgggtttggggatttgtgttttgggcgccccacaccccatttagccgagtgtcacctgagctggtgtcccggagtctctttccttctccataaacagttgagaatgagctctctgccaggccggtaggaaggggatgatgaaatgaggacctggtacattctgctgctggttccattgctgggtttctcctcgtggagagcccttgaccctgtccaggtcttgatttctcggagtgtcaaagcagtgcgcacggagctgtgagataaattggctgagatcatcgatttgaaaacgccgtgagaaaatatggggcaaggcagagagcacagaggggctttagggcagcgagcccgcgctatgtgatgctgtaatggtgggtgcgcatcggtacacgtttgtcaaagcccacggagtggcccacgccaagagggaaccctaacgtgagctgcggacctggggggtgatgatggtcagtgcaggtccctcagttgtaacaaatggcctgctctggcaggggatgtggatcgtggggaaggctgtggccgggagtggtgtaaggggtgtgtgggaactttctgctcaattttgttgggaagacctaaaaaataaaatcttttattttattttatttttttgagacaacatttcactgtcacccaggctggagtgcagtggtgtgatctcggctcactgcaacctcagccttctgggcccaggtgatcttcccacctcagcctcccaggtagctgggactacaggcacgcaccaccacgcatggctaattttttgtatttttagtagagatggcatttcatcatgttgcccagggtggtctcgaactcctggagtcaagcaatccacctgcctcagcttcccagagtgctgggattacaggcgtgaacaatggtgtccagcctaaaatctatctttaaaacacacacacacacacacacacacacacacacacacacacacacactgctatcttaaaagcatagggaccttgcagtgagaatttctggtgggaagatgtatgactttgtcaggtcttgaattctagcagtgagtttacattccataattggcctacaaaattctatatttgggaaacagtagaaatttaactctgagcaagatacaccctatttccaatcacacgtgatgcatctcgggggcattcatttgtcaaacattatttgttgagcacctgctgtgtccaggctctggacgcatagacgtgaaacggacgatttcctgaccttgtggcgctcacagtcaggggggtgggttggtgggtgggtggaaggaggggagaggtgcagcacccccattgtgcaggagcgaggggagccccgctggcacgccgcactgtgctgaggctgggtgttctagggtgaacaagccacttcgtctagtgggtgcttgtaaagcgggatcgttgctatgagagagagaaccttgcgttgggagaaagtaattagggagtgtgcggtagatgcggaagagaaacgggccgtcaggtgaagtgactgtcaggattccatcctggctcggccccttggaagacacatgatcttgcaggtaattagctcctgtaagcctccatttttccccgtctgtcaaatggggatgatgattgtgcctgcctcccagggctgctgtgtggattacgttggataatgagtacaaatgcatagacagcctttagcaaggagcctggttgtatagagctgtcggcctcaacactgttaatacacatatgtaccagaggctgcaggttcacggaggaggagtcaccaatccatgcccggggagcaggcagagaagagggaggcgggcccgtcccgagttcacgccacgtgaaaggtgcttggaacgcttgtgccagagctggcagtgagggttgagggtgggagtggccgagcacctagacacccgcaatgcaaattttccttctcagtctctggatggttttctgagctgagctgcgggctgaatgtcaggtgatgcgtcctgacctcttcctgagcacctagtgtgtgccctgtgctgggcccaggaggcatgctgggggcaatgtgggcctcaaggaggaggtcgggtgatgaggggccaacccaggtatgccagtcaagaaaccgtggaggctggagagaccctgaagggagcagggcacagtcgtgggtggcaggcctgggtgtgcctgattccactgaaccctcgtaacagccctgggtgcagagtgtagagtgctgggtgaggacggaggctgtgcgtctgtgatggccccaggtgacaatgctgttgggatttgaacctgagtttgtggaccacagaggtcccggccacacttagtttccatgccagttttgtagtaaccagcaacctcactcgaagggtggccagcatcttaccttggggcttctatcaacgttgtcctgggcttctcgcctgctggggtgcagcggccttgggcatgtgcccctgtccatggtggctggccggaggccgggagccagggctttctgtatgtagcatggcacttgcaaaaactgtgatcccccagcaggcaccacagaagcaaccagagggaggggcatgggctccgggccgggtcgtcacagcctgcgtgacctgtcgctcttctcttccaggggcatggtctagtggcccagtcaggacgcggaaacactccctggaggttctgacccactccctctcagcctccgcctggtctctggtaagtcactcccagaggccgactggctcagggtgggtgaggactgaggatggaagtgggtggctcctgctgtgccgtggggtcctgcccatgtgtggggactggacccagctcagcagaaagagcagggaagactgggcgtggggggcagcccagctagcacccctagacaggtcaggaaactgcggctcggaaatgcagagaaacagccccccaggccccacagccatctcagctctcgccctaagctggccaggtctttctgggtaaatcgcgtgaccttcggtgcttctgtttggcgatttgtcaggggaatgaggggcccagaactttgagaaggacgtgtgggtgagggcaaggagggcactgtcttagtgtccgggtttctttgtcttctatcccctgcagcccctgtacctggaagcttccttctcccaggctcctgtgcatggtcagggccactcagccctctggacccccacccacgccagataagctgtctgcgctgggagctgggcatgtggctctcccctcagagcagttaccgtaggctgccgggcccagggtctgtctgaatccgccaccctgcagccccccaggcccctgcctgctctgggtgcgaggaaggcttgagggagggcaaagtgcttacagcttgaatgcaccaccctggcctggccactggtcgcctctcccccagtgttagcctggcttaggggctttttccatccggaatccttcctggccctgcctgagctaactccgtgagctcgggagggctcctcatgaccctggtcatcctgccagctcccgagacaggaaggcctggccatgtcccggggctgccctcgggtctggagagcctgccagccatgctgtggggctgcccttccagcgttgagggtttggttttgtttgtaagcaaggaaccaggtatgcgatgctggagagtgtgtaattctggctgtgcctcttcacagccccttccaatctcgtgcatattaaggttgataaaaacaccctcttcagggtcaatgcgagatcagacctggagtgaagtgtccctgtggtatctggaccagcaggacctggctgccccacagctcctcctctctctccctcctccctctcatggtctcatgactattatggtgactcttgtcactcaccaccctgccccacctgctcctgcatactgtgagcatcagttggggccatggatgtagcaagggtcagctgtcataggctcccggggggacacctgggggagggacatttggggacagagccccatctggccatgcccagcccctgagagccctcatcaccgacttgcatctggtgagtttggcagggtcctgtataaggattaaagtcctccaagtcctcatacaaagtcgctttccaaaagtctggaattttcttggccctagacacgggagatgctctttataattttcatcttcccactcagaaggaaccacctttgaatactcagccaggctaaaatttggacccaaaacctgttaaagcatcactgtcttaatttcagtgttcatgatggggttctgggctgtgtgaggggtggagggcagataccagtggcaggtttcatctgtggccctggtagatgtgagtcccgcagccggtcagcccagggcccagggcagaccccgggcgtggctgctttcccgctgggcaccaacgcacgcacgtggtgtttccagggcaaagtgagctccccaccctctgcccgtcccctgccccgcccttagatctgcatcccgtgggtggggtgggttttcctgccttcctcttcctgagggaggcgatttctccttccgctttctccttgccacagtagctgctgggttgggaggagacatccaggctggggcctcagcctcagggtgccagttagcgtgtggttagctgagaaaaaagtatttttctcagcagaaaatagacacaactgcatgtgaaggggccacttccactccttcattctccatccaccagccttactggagctagagagtgggggaacatctgggtccgtgttacctggatgtcacctgcatacaaatgtcctggcccgaggccactgtcagcacgggtgcacaggggaggcgcctggcccggcaggtcgtgctgaggctgatacccgtgtcaagaagctggagcaggcgaagagatcagaagagggtagaggaggtggtccgaggtgtccattcccatccccagacccctggggcatttcagtgcacgcacagcaaataatatcactgcaccaccaccaccaccaccaccaccaccaccatcaccaccaccaccaccaccatcaccaccaccaccaccatcaccaccaccaccaccatcaccaccaccaccaccaccaccaccatcaccaccaccaccaccaccaccaccatcaccaccactaccatcatcaccaccaccaccaccaccaccaccatcaccaccaccaccaccaccaccaccatcaccaccaccaccaccatcaccatcaccaccaccaccaccatcaccatcatcaccaccatcaccgccaccatcaccatcaccaccaccgccgccaccaccgccactgccaccgccaccatcaccgccaccactaccgccaccgccaccaccaccgccaccgccaccgccaccaccaccaccacgagttgagggactctgggatcagaaggcactttccagcacattcacaccattggccgtggatgttgtgggtcaggtgatgggcactggaagggccttccgcttctctctgcccctggcccttggtcatgtacagcaggccgctccccgggcagtggagaagcagcacctgcatactaaggctcgagtcccagcctcccctaccagcctccctctccacgtccccagacactcatgcgttccttcccttgaggtgggttcatggagcacgtaccctgtgtcagacaagcttccaggctctgggcttctgatggagaacagaccagagtaaacctggccccaaggaccttgagctccactcaaggggagacagacagtgaactcaacaaaacagaaatgagagaaaggatcaagctggaaaggggataaagaatgagtgtcggttttggatagagtgcttggggaaggccttcctgagatgagacctgaccaaaggcctgcaggaggtcagggacgggcgtgcttctagctaaggagcagctggtgcaaagggcctgtggcagacgtgcacccgtggcaaggagggggcgagcaggcggctcagccaggtcggagtgggtcacacctgaggggcaggacgctggcaaccccgaccgctgaggaagacaggtgcgagcagcatctcggcacagccagacccccaccatacggcagccctctgtgtcccttaaataaggatgcctcctcccaggcttaagagatcattgttgctcatagtgatttgtgtagccaacaattcttctggaagaagttagatgaacagggccatggagatttggggccggaagagcaggaccccaggcttgcctcccctctagtgctggccaggccgtggatcccaggcgggcatctcagagagccatctgagcggcctttctggaagtgccctcctaggcagacgctggtcatgaggcagggcagcggggaagggacaatcctcctgtgttgtacattgagggttatatttagggtgacttgggatgacttggcagtatcacttcctgtggtcgtcccctccagccctcagccacggagggcagatcctgtctgacaagcattgtgggcagacacgtgcctgcacacacgtacacacccacatgcacacatacacacacgcacacacatacacacattgtgggcaggcacaacttggcattctcatctgccctggaattggtggagggctggggacattgtcctggcccttctgcaggaccgccaggtgcctggcgggggaatcctagccgtcagcatctccggagcatctgctccatgtcgggctctgtgtgaagggctgcatccagatcccacatgagcaagaccggcctagcctccccatctggttgggagatgccaggcagaggtggaaggaagggcggctgacctgccccttagtctgctcagccacacaggcagccacagccgaggctgcacaaggacactcccctgaccttgctgcctgctggccccgggtctccaggccaggtccgagccagccaggctcctccccacccatgtcaccggcctctctaggtggagtccacagtgatctttgctccccttccccaggcatccagcaccacaccaggcacagggcctggtatttctgggacagcccagattacacgttttctctcagttaccccctagaatattcttggacttctcagaccccatgtgcaaatttttagcttagaagtaatcactgggatcatagacgatgtttagcaaatatctgttcttttgggtgttcctaggcccccagagggtctccgggaaactggctcttttgctgaggctagagactatctgggctagaatgtgtctgatggggctctcggagggtgcacagacagtgccgcggtggccgaagatccactattccaaggccggatctgcagaggatttggaagttgtctgtaaggagcgcctagatcacccggaccttctctctccctccttgacttccttcctgcctctcgtcaaacaattactgtgtgcttcctgtgttctaggcgctgtgctaataattggttatgggattattcctagccacaccctgggtaaatggaacccagctctctgtccttgggaaaagggtcaggagagaactggggcccagctgggaagctggaggcttgaggctgctggtccatgttggaatgctgtctccctctgccatccagcacccaagcccggcgccaggctcagagcaggaactgaagcttttgctgttgttgttgtttttgttttttgagacagtctcgctgtgtctcccaggctggagtgcagtggtgtgatctcagctcactgcaagctccgcctcctgggttcaagcgattctctgcctcagcctcctgagtagctgggattacaggcgcgcaccaccacgcccggctaatttttgtattttgagtagagacggggtttcaccatcttggccaggctggtcttgaactcctgacctcaggtaatctgcccgcctcggcctcccaaagtgctgggattgcaggcatgagtcaccgcacccggccaggaactgaaccttggtaggagaaggaaagaaggagttcctgtcttgctttcccgaccagactggaagcgctctgagggcgttttacacttcggtgtcttcccagcacttagcattgtggcctgcatgtaaggggtgttccgtgactgcgtgttgattacactttgtgtgtatgggtgggtgcgttgccacaactctccctgcagaatctgtggcctctggtgctgtgatttaaagactaaagatggcaaagagtggcttttatgagctgccccactcctgattataaacacactctctatgagtcagaggcctgggtgatcatggataagtcacttgccaacagttaactccagactgtagctgctggggccaccgagggcggctggaacatcaccattctgtgcctagcgtttcagccgggctgaggccattttattaataatgatttattgtttttattgcttcccagagatattaaacatgaatcaaataatgcatgtgatgattcactggaggttcccttccaaatttaaaaaagaattaaagaaaaagtttttgacgggtgtgctggtgtggacaccaggcaggcacctgagagccctcccaccttgagctcagccgtgggcagcacagcacagggtggaccttgccctgcagacagagccatgcagcctgcgcaaaaccccagggaggacgcgcgtctcacaaacacctcttcagtctaacatttacaatggtatttcttacaaatggtttccacccgagatatattacaatgtggccaaaccccattcatttgggacacataaattcaaaatttggaaatagttcctttggggctcatgaactgatcaagtttagtcatttctcaagcagggacctggcagaaatgttgctttttaccatctactaagacaagagctaggcagctggttctgctgaacaaggtcccggggagagggacaccagtcctggctcagtgagcagctcctcaggtgctttggaagcctcctctggggatagactcaaagaagttttctatttatttatttatttttctttatttttaaatgtttttctcaaggatgttttttagagctagctcatacctcaggggccacactgtccaaacacatattggaccctgatgaggaaagtgagagccgtcagggtgtgtgacatagccactgtcacccaggcctccagctccattctgcagttgaaaatgatgccctcataacaaagagttcttttgtgtgtgtgtgtgtgtgtgtgtgtgtgtgtgtgtgtgtgtgtgtgtgtgacggagtcttgctctgtcacccaggctggagtgcagtagtgtgatcttgtctcgctgcaacctccgcctcccaggttcaaatgagtctcctgcctcagcctcctgagtagctggattacaggtgcctgccatcatgcctggctaatttttgtatttttagtagtgatggggttttaccatgttggccaggctggtcttgaactcctgacttcaggtgatccgcccacctcaccctcccaaagtgctgggattacaggtgtgagccaccgagtccggccaacaaagagttcttatccgttcattacaaacgcccactctttccagtccttacctgatcaagaattcagaggcaatttttcaggtatttttttgactcggactttacaaatttgaactaccattcaagtaattggtctgaattcctaagtttcgatggtatttttctcttccttcttctggctgcctctcctccccataccctgcatttgttaatgtacccatttgttccatattctgtttgttctttattgctctatacactgctccataatgttctctatcatttgtccattcattacccatgaaggtacatgcagaggtcaccagcccagaggtttgtagcagggacaagttacttgctggtggtggtctccccaaaagtttgggcctgcgagtcattgacacctacacactttgaaaacaccccaggatgaagtctgggactggaaggagctcccaccttagccagactctggcctcctccccagctgtgtccccgccagcccttctccagccatgcccttttgcctcccagcacactgaggattcctcctggaatgcccctcaccccgtctttgctgggtgagtgtttccccagccccgctgagctcaggtatcagccccagcgctctgggtaagtctgggaccatctcctacattgtctgcaaaatcctgcagaaagcctggcctgtgctggtcagcaggatgctgcgtttccttttaaacagacccaaagcagtcagcagccacagactccccagagacggagatgagaggagggacctcatgccctgaggcagccccagcctcactcccatgccctgcaggcgctgagcagcccccagatcccgggctcctttgctgccccagggtcgggcagttcttgcatcttggaccgagtgggctctgccctgctgtggcatgactgggcttcttctgtcctttttctttattttctctttgaagaacaggagttggaatttcactcaccctgccccagctggatgtgtctaggccaccgtggtcccaggctctctgcccagctgggcctcaggaccaggttttaatgccgctgcttgggtgtgccgagcgagaagggctcgccaggcagtgcagagattccaccgagcccaggccgcagcccccacctcccgccgggctgtgctcagtgtcaggaatcggctcccaagatggccgcctttcttgtaaagctgtgccaataccccaggcatctgactggtgctttccagctggcactccttttacagattccatttccctttatcctcacaactgctcagtagaacctgcaggcagggacccttattcccattttacagtcaaggaaaataaggcccagagaagttgagacagccaggaccatatggctggagacggggcaggctgggcagagcccccagcagggcccctgggtctgcgggctgctcccagcagcacccctcatatacacaccctcatcctgactgcaggcccctgaagctggcattctggttcaattttacagaggagcaaacaggctgggtctggagcgttgacactggcaactctagcccagccttgcctgactccagggcatggctccaagaccctggaagagctgcctgtccctccatggcccctccagggcgtgctgggtgctggcagggcaggctgaggcactcgacagcagagttggccccgtagtctcagttttgctcccgctagggtgaaacacggttccctggggaagggctgttgctcacctcttggcctggaacatcagggtggaatttgcagacggaattctgccatctgacgcgtagatcttccccccaggcatgggtcagtgcttgagtcattctgcagctggcacaaagagccaggaagaatgcgctccaagatgcctgggagctggcatgccaaatcaccaggcgtcatcagcacagccaagccagggtgggggcctcgggcaggagcagcgccctgccagctctggctgactgcacgaggggccacatctagagggactgatgaaggggcgtctaaagcctcagtatctccagcctgctgtgccctcttacattttctcccaaagagcagtcagcttgcagtatgcgccaagtccccgcaaatgggacgttgggtgattcacatggttgtttcagcttttgagtttttgttgtgtgattgaatagtaatagaattattcttggtgttctatggagcattaccgggtagtggggaggtgggcacactgagcctctactgtttctccccttcacccctccttgctgtcatcaacatgcgttctcctacagtcatgctccgcgctaattcctttagtcattccttccagcattactgaaactggaagagtcttttgtggcatgtggggattcctcgtcgtgcagggcttgagtgccacaggacccagtgctcgctgtccccatgccctggcacacactgttccctttgtcccagctggagaactcctggaacctttaagccctggctcagccctcagctctgtcccatcccagctgacctctgtgctctgcgcccgagctcctgagcccacgtaagtctcttcatgcccatcactgctgtttcatgggcgtgtgtggggggtcacttcaaggagccccaggaagggtctgtgtcttgtccatccacgtgtgactacacccagcatggaacaggactcgggaaccactgaggtgtgggtgaaggaaccagtccagagactccactctcacttcagcctgatgtttctggggtctgtcactgaaaaccccaacttcgccttcaaagcgagatcctgggtgggggcagaggaagtcccaggctctgtggccaggactccacacccagatttccaccgggctcgctctagcctggccctggcacgggtgctgcgtggctctgctccccgcctggcatccggcacccttcacctctgtagaaacacggaactgtcacagggacagacgtacatgggtcgggggttgctttcagaaagtctatggtctcattttggtcctgcctttgagcttccttttcctgctgggttagggttccggacggaaggggagcattctcttgggcgtttcccttttcctgtctccctgttctctccccagaggctcatgtatgtccgtttcactcacctccctttctctgcttgggaggcagctcaaagagctcctctccaaagactcaagctggagtgatgttcgctctatgatgacgccgcactggtccagggaatgatctcactggagagtagcaggaagtcccccatcctgtcccccaccccactggctgaggaccatatagctgggatgtgttcacctgggaaggagattggcaccagtttgataaatggacacccccaagtctggcatggccccaaaactctactctgctgcagctgtttccatgccagaaaacagagatttccagaataccgagtctgaatgtgccttcttggagcagcttcaaatctgagcaggagagcacttgaccatcctaacccctgaccttcctccagcaattcctaaaactggaagagtcacagaatgttagaataagagggatcctagaaaaagaaccactcactcattgctttgttcatttgctcaggcactgtgctaggcgcttggaatacacaaccattcattcaaacatatttattgactgaattgtgtgccaggccctgttttgggccctgtgggggtacagtggtgaacaaaaggaggcagacagtcaagagattttgtaaatatagtgccaggtggcaggaaatgctgagaaaggggtcagggtgagggaccagagggtgagggtggatgctctttgaggtgggtccttggaggaggtttccccacgactgttgagcaagaacatgaacttggagggagtgagccttgcagacactgaggggaaggaagagcagacaggtggagggaactgcaggtgcgaaggccctgaggctggaacacgctgagcagcttctctgactgggacaaatgaaggattctccttcccccaggagctcccagtctaatgaaggaaaaagacaaagaagtgacgcgttcaaagctgagttcatactagaaaaacgctgttagaattcaaagggaagagcagttgtaggggctgggaaaggcaagcctgaggagtgacctttgcattgggctttggtggatgagtaggggttggcagggtggctgaggcgagcgtgccacacgggtgaactcatatctgcagaggcacaaggtgtgcagggacagccacccacacattcctcttcctgtcgcagtagcagcttctgcaagagaaagtacagctcttggggatttcccttttcctttctccacctcttccttctcaccagcttcatttagggcatttcagccttgagagggtggaaaagaaggagagattggtagaggaaggggatttctgtgccctgctgggtctctctctctctctcttctcatatgttatgtttttcttgtaaggttttggggagttgtggggagtttaagaggctggggatgggtaagaagtcaagaaggtttcggttggatttctcaacaacaggtcattggcctggagcccctccagtgggtaaaatgccgtgatgcaacagctttcaggaaggcctccagaaatgagctctaggtcagtgggttgggtttaggtgcaggcacgccctggaactgtcactctagaggtgttactaacctcctctttccccggatctgactcagcagggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtaattatgaaatacaaacgccatgatctttcactcaagggcactaaggagtgaataaataaaggataccacagggtgctaatgagcttgaagagtccctgtttggtagccccagatccagggtccctggtatcacccactgaatgctacttctacccagcactgcccacgggaaataaagtgggagacacatacctatgtgattgtaactttttctatagccgcattgaaaagtaaaaaagatgaaatttaaaacttgtttgatttaaaccgttagatcccaaatggtatcatttaccatttcacatgtaatcaagaaagagaaagtattaatgagatattttatgttgttttttttcatatgaagtcgtcaaaatccggcgtgtattttacactaagggcacatatatgagttcagactggcgacggtttatgtgctcagtagccacgtgtggctggttgtgaccatagtggacaaagcagccctagcttataggtggagacacggaggcacctgagaggggcggggtctcagctcaggccctgggagcctgttcaacagctccctctagcgtcggcccagccacacttcagcctggatggtcccagatgcatcggctcctccctgcacctgggtcctggcagccggcacagcctccccgcaatcacccaggggcaaaacgggcccctccttggagaactaccgggaagctaaggctgcaggcagcttgactgtcacttgcttatttggaggaaagaaggacacaggcccgagttgttttgaaaaatgcaatcagccctaggagaggggcttagctgcaggggccgtgtgggtccagcggtcaccgggagaaagaactgggttgggtgctggataagaaagagcacaaacctgtttgtcttccaccggccccttctgccttccaccttcctgttccaccccaggaagaacaagctctcatctcaaatggcctgagccctctgattccttgaagttcaaattcacaacaaacgcctctccagcctcttcctgagcctcagtcttttttttttttttttttttttttttttttgagacagagtctcgctctgttgcccaggctggagtgcagtggcaccacctcagctcactgcaacctccaccctccgggttcaagcaattctcccgtctcaacctcccgagtagctgggactaccaggtgcgtgccaccgcacccagctaattttttatatttttagtagggacggtttcaccatgttgctcaggctggtcttgaactcctgagctcagacaatccactgccttggcctcctgaagtgctgggatgacaggtgtgagccacggcgccccggccagcctgggtctctcataagcatttggtgtttcccacctctctggtcgccttccctcaaagcatctcagagtctggttggcctggcaagcttcggggatctgactgatgaaagcattttggagcaatgggatgagatgccaaccaatgccgtcagccggcactgaggtgggattaacaggacaatcaagccctcggttcccaggagcctcactgagcagctgctagaactgtgccactaaacaggctttaatttacaggcaataccgactctgggttaactatttctcacagggctccccagctgcatgtttacatttctttccttgttcctctttttcttcttcttctttttttttttttttttttttttttacaattcagcagattaagaacaatagcagggtaactgagaaccacagaggtggctgtaagtgactcattaactccctctcccatgtttccatcaccgtgaattacaacgtcatctctgatgccctcagacagctgttactagtttgatccgagccttgcttgaatatgaatctttttaagccgagcaggagatggttctgctctcaaatagactgccctcccctgggcctcccatttcttaccccaccatcctccttggagatgaaagacttcctgagaaatgaaggctgggtttgcctaattactggagcaaggtggctgttctgctgggaaacgtgagtggtggctttctgtctctgcagaaaggcttgcttttgctcggtcgtcttactagacagccaagcaccaataaggttggctcctttgcttaatgaatgacagaggggtcacagcagcatgcagcattccccccgccccccgtttcttgtgaggcagcctgcgtcgggcccgacagcctccaggagagagctaaaatgaggtccttcagattacatatttcatctgggcccttgttaataagcaaatgctggctgtcccagtgagtgactgggagtgtgtgtgtggccgtcaccttcatttggcattcatgggctccatttaccagtttcataaaagttccagtggggaggccatcttgcaaagctgtcctggcgagcacaagcagagtgctggacaccagccaggagcaccctgggtggcctccacggctgcttatggtcttggcatggaaagggcccagaggaggttacaggacaatgggaaggaggtgggctctccactcagacctcctgggtccacagcccaccaccccaccgaagcctcggtcccttgtccctaaggtggagctgacattgcctcctctcggcctagccaggagtgaccccactttcccagctcctagaatcttcactgtgtcctcccctggatgtggcctacagggactgggcctcctgcagcctttgaaatcctccttgtcattcagttgtgattccaaatgccgttgtcctaggcaagccgccgagtgccccgggaatgagcgactcccctggaccccactttattcactttttatgccccttcctgggcatgcctacaccataactcaagccccccagggagctggtgactggggaccggcatcccagtgctcagcctgggattcggcactcagagggcccgacagcctggaatacactgagcaccccgctggcaccaggccccaaggacaggctgatgtttccacttccctggagaaagatcctccagtcccctgctcggaggctgatcccggctggctgcccgcttgctcagggcaaggaggtaggctggagagggcagacttccctcaactcacccatcttctgtgggttcctcaccagccttcctctgggcctgttgttctcctgtccagtgtctttccagagaagattcctcccccaagctttggagatggggctggggtgggggtggttacctgaccgctgagtcgcagtacagggttccatgttggtcaggggtggctaattgctgtaagaagcaagtgccaacctttgcttggcccagtgaagtggtgtttcctgatgtgttgcagtgggatgtcaccgcaggagacgaaggctctattccacgcagtcacgcaaggacttaagtttcttctttttagaaggtctttcgtctcacagcctttctcagccggggttccaggagggaatcaaggactcacagcaaaggcatcatggtgtgcagggaacgactttcctcctgcatacctggaatgaaaccagttacacaccatccttaggtacatgactggttggggaaatgggcacaccagtcattgactgcaggctgtggttcagatgagaaagcctggttgagaaatgctttagggtctatgccctctggggcctccaagtcctcccctggatagtctgcttccaggtgcccagcaagaaagggcaggaaagggcgtgtgcagcaagggctgccctgacagttatggaggctcaggccagaagtgtggtcatcactctggccacatcccattggccagagtgtagtcacatggtaccacctagctgcaagggaggctgggaaatgtagtccggctgtgtgccctggaagaaaaggcaatagagtaagaagagcacatggtctcggcacaggctctattcttgcacattccttcagactctgcctcccacacctcctgaggctctggggataccctatccctgagccttctggaattttggggccccagttgccctgtttctccttcctggcccccctccctgttcagctgtttgccatctccctgcccacttcccactgatatgtgttggggcttgtggatgtgatcaaggtcataggcacagtctttcttttctttttcttgttctccttgttggggtggggattttttcaaaaggaagcggcaaaggtattgtactatttttgggtccctacactcttctgcctccacattcttctgttgtgtttatgctgctagacctggaaccttaggatgagcaggtcttggcatcagactttgtttgcatcagcagaatcctttctttgaaagagaacagatgcagaaacagatcagagggttgctgctctggtctgtgctgggcctggaggcccagagtccttcctcctcccctgcccatcctgtggacccccaaagccttaggaaggtccctggggctcctgggacacagctcagaggctcctggctggtgtcactcctctctgtgaggcttgaattctctcccttgcattccgaaagtgggtcacactggaataccagctttgtccaaacctccctgcctctggagttagccaaaccttaaagcaggttcttgtgcatgtgtgtatacacagcaactgcaaccacagcaagagtgtccattcacccaacacagacacccaccttgtgccaggcccagctgggtcacctgggagagggtgaagggtaggaagcccttccagaggaggtgctgagtgaggcaggaggccgcaggcgcacacgtctgccctctggcacacgcaggaaggtgctgggaatgcagggagcttctccccagcagaccatgatgcactccgcctgttaccttctagcggtgtgctcactgggtttggcactgcccctaatctggtacctccctttctatacgcatctgtgatttcaggcagataagtgttatgagtttggcattccaatgggatcggtaagaacataaatcaccgatccatcctgggataaatttctcccttcgttctgagaggtgatttggttttcactgaggtgagtggattcttaaggcagtgatcctcaactcccagggcctagaacttcacagaaggtggctcattttgataatgaaaaatgcaggggtgcaaatcaggcagaaagggcctgccactagccaacaatgtgtccatcaccatgtcgcccttgcctgggccagcctcccctctgctgcccatgcaaggcctggggaggaggccagaccgcctgggtccaagccctggctttgcctctcagaggttccggggctctcccagggttggtttacttgtggtgaagcgtgactaataggtaaagtatctgacaaaatgggccccacaggccatggttgctgcttctggctgtccctgctgagagcaggtgtaacgtacctggcatcactcctgccccagagacaccgataacacatgtttgtcagctgtaggtcagttccccaagggtggctgctgtgctactgtaacacgggactgcagactgggcacttaaactacagaactctgttttctcacggtctggaggccagaagtccaaggtgttggcagggttgggtgttggcagggttgggtgttggcagggttgtttcctccagaggcccctctcctagaattgcagatggctgtcattttgctgtgccttcacacggtttcccctgtgtgtctgtgtcctcatctcctcttcttataaggacaccagtcatattggattagggcccaccctggtgacctcattttaacctaatgacctctttaaagactgtgtttccaagtacagtcccattctgagggacctggggttaggactttaacatgggaatttgggggaagcacagttgaggccatagcagcagctgtctcattctgctcacagctggttctctctggccacgtgccagagaggagtacgatgccatccccttaaaccacacacggacatgctgccaggaggaacgtcatcacctttcagctgaaaggagtgaggaatgaggacaagcaggtgcagaacacagccttctcacgtactggtccattctgcacgtgcgctgctgctgttacagcggcagacgggaggctgaactagagacacctaagacaaaccctgctttcccctccagatgctggctgcaagaacgccacagtttgagaggagtgtggacaatagaaagccttgagagcagctgagctgacgaagggatgggaaaatgggcccttttgaagcctaggaatgaccaagtggagatgtgcagggtttgggggtgccccagcttgagtctcagtgctctgagggacatagcgcagagtgggacagcccggtgggtcaacccctgcctggttctgcagacttggagaggtgggacttctgccccaggccgcatggagggccggccctgggctgggtgtgcctcacgctgcctgggagcctcaggcaacctgctgcagctgcttgttttgccactcactggcctgactgcgggagctggaggggctgggaggtcattccctactccacagcttagctcaacctcccaggtgccccgcacccccatccctcccttcccataaaaccagttattcctcatcctcataagcgctcctaggacacttgccatgttctatcagtttgggggttctctggggcagccatccacagatccatgccccgcctatgagccatctcccctctccttctcacccccgtgctccccgtgtggtgtcggcccccgaggcaaggaccgtatgggttttgttcactgcccacactccctctgacacacaggaagttctggaaaagcttccgcatggtgaaggagccacatgcggtttggtcgggtgccccaggcctcctcttgatcatcacgaccaccctgccatccctgttattcggggggagtccagagctccaggaagttgaccacctccccaaggtcccccgagcaggggtgggtggaactggctctgagcccacactcaatgcctttcccctgtgccccggagcctggcttggtgccacccaggacttgtttgtggaagtgacatgtgaacacctagcgagctccatgggctctgcgtgtgtacgtctttgctgactcagtggccccacacagcaacccgagggccagggcagaaagcacaggaggagccaccacgggtgctgcagggcctcaggctgggcatccatcctctacctgtccttctgccgtccatctgtgggttctccctcaggtgccacgcaaggctggtccttcacaatggcccaggccctcaaactcagtggtcaggagggttcccaccacctcagggcttagcggcagtcaaggtaacctcaggtcctcaggctacctttgcaaataggtccttgcaaagaccctaattcacattcacagatactgggagttaggacttcaacatcttttaggcgggccatgattcaacccatgcatctgggcctaggaagtggaactgccccagtgagcgatgccctgggcactgtgcagttctgggggacacagccctgacagccggaggggggctttctgggcacagagctgtctgggatccgccaaggcaacacaggaaggagtccagagctcacctgggtgagacccgagagctgtcagtgacagcagaatccagagggagcccacatctccaagccaggtccagagctcttccaacaggatagcagtcttgtcaggcactctgggaggccaaagtgggaggatcactttggggccaggagttcgagcaacctgggcaacatagcaagatccctatctctacaaacaaaccaaaaacctcagtagcatctttgttgttttttctcttctgtcaggtattttggtagtagtgatcttctgattttacattccctttttttttttttccatgtagaaatctctatggccatttcctcttgtgaattaattgagtttctaaagtgaactagctgcatgttagaaccaggacttttttgagccctttagagcatgctggcaggcgtcatccccaagccccagggtgggtcatatttctggatgatggaggcagggggtgcaggggtcccctatctgcacattgttctgagtctgatgtgattcctcaactcctccatgaaacaggggccatgcttgtcctcgtctggggcaaactgcagttggagaggctggcctcctgtggctgcatatccagagctgggcttaactggccaggaggagagaagaatcctctctcttaataaaaagtccccaggggctgggcacagtggctcacacctgtaatcccagcacattgggaggctgaggcaggtggatcacctgaagtcaggagttcgagaccaggttggccaacatggtgaaaccccatctctactaaaaatacaaaaattagctgggcatggtggtgcatacctgtaattccagctacttgggaggctgaggcacaagaatcgcttgaacccaggaggcggaggttgcagtgagctgagatcgctccattgcactccaacctgggtgacaagagcgaaactccctctcaaaaaaaaacaaaaaaaaaagtccccagggcccatgtccacccagccgtctctctccctcccggccaatgttattctttcctcataagcccttccagagcacaaacacacaagcacgtatgtttgtcttcttttctcataaatggtaacaagctctgcttgctgttgtgcagcttctcttttcacataaaaatacaccttgaagattatttcttatgagtacgtaagatgggcacctgagtagtttgctgttacagaccacgtaggcaatggccacctgcacagattatttgcacaggtgggagtatcattagatgtttctggaagtgggatggctgggtcaaggtgaatgtgtgtttggaattttgaaagataaagtcataaagataagtaaaaacacctggcatcttggctcacggctgtagtcccaacacattgggaggtcaaggtgggaggactgcttgaagctaggagcttgagactggcctgggcaaaatagtgaggccctgtttctacaaaaaaaaaaaaaattaactgggtgtggtggtgtgtgcccatagtctcagctactcaggagactgaggtgggaggatcacttgagcaccggaggtcaaggcttcagtgagtcatgatcacacactgcagcctgggtgacagagtgagagcctgtctcaaaaaataaataaataaaaaatagatagatagattgattgattgatatagagaggataagtaaaaacaaaaacatgtatgtactataaaacctgggatgggctgggcgtggtggcttatgcctatactcctaacactttgagaggccaaggcaggcgaatcacttgaggtcaggagtttgagaccaacctggccaacatagtgtgaaaccctgtctctactaaaaatacataaataaataaataaataaatagccaggtgtggtggtgcatgcctataatcctagctactcaggaggctgagttgggaggattgcttgaacccaggaggtggaggttgcagtgagccgagatcacaccactgcacactcctcataagtgcctggaagggcaacacagtgagactccatctcaaaaaaaaaaaaaaaaaaaaaaaaacaaccctgggatagaggcagagaagaaaggaagtggtgggcagtgtgggtggtctgtcttacctttcataatggagagctggtgcctactgtttagaattcacaaacacagagttcaaagtggttgccactgtggctagggtaggagacatctttttatttctcattcttccatgtacttcaaaaattatcacgccctgtatatcagttaactgttaatgtaagaaaataacatgaggtggtgcagtggcagccgtgtgaatgccggttgatcagtcttgcattcaggacttgtggagaaccgccctgggggatggttttgagcagagcagttcctcgttcccacaggtgcctcatttttccctggttccattcagaacatcatttactgcctagagctaattccagatcctcctcccacccggggcagtttatcaaaggcaaaataaagagggtgggccggggacagtggctcacacctgtaatcccagcaccttgggaggccgaggcaggtggatcacctgaggtctggagttcgagaccagcctggccaacatggtgaaaccctgtctctactaaaaatacaaaaaattagctgggcgcggtggtgcatgcctgtaatcccagctactcaggaggctgaggcaggagaattgcttgaacctgggaggcggaggttacagtgagctgtgatcctgctactgcactgcagcctgggcgacaagagcaaaactccatctcaaaagaaacaaacaaataaacaaataaagaaggtgggtgggggtgactccctgaaagtttctagacgcctcttctaaagataaaaacataatgtgatgcctgaaagagggaagaactgccccaaagagtctgggatgtggctgaggtggccactttgccaggagctgatgagggggatgaaagtaagaactgattttaatcttcgcctctcgtacaacccctggtgggcaccggatgatgccctgttccactgattttaagttgcattttcccccccgcatttccacattctccaagtgagaacgtgtcccgcagtgtgagggtgagctgtcgtgatataattagagtctcttggccttcttggtggtccataagatagcggcatgccttccgatgggggacccgggagttgctgagtcgcagcgcttgcacagcgatgggcttatttggtctctccggcacatggctcagccctgctccgtggccgtgggtggcgtccccggctgaccccctgtcttgcaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggtaccggcgcccgaggccccgggtctcaccgcgggcccaggtcccctcccagctcccagcccccagcccagggcttttttttttttttttttttttaagacaggaatcttgctctagtgactggagtgcagtggcactatctcagctcactgcaacctctgcctcctgggctcaggtgatttttccgcttcagcctcttgagcacctccatgccctgttaatttttttggtatttttgatggtagagagagggttttgccacattatccaggctggtcttgaactcctaggctcaagcgatctgcccgcctcagcctcccagagtgctagaatgacaggtgtgagccaccgtgcctggcctccctgtgttctttatgttcactcgacattgggtctttcttggccaggttgctacctggtgcactttggaaagtgagcagttgtcacctgattgggcagacccttgcaaagggcaatggtaaaagccaatgtttattgatcacttgctatacatcagggccgggtggagcactttgatccgttttcatcttcataacccaacaacgtgggtcattctctgcattttacaaagtctgagactcaaatagatgaatttctaaaaattatattttatatatatttggagatggagtctcactttgtcgcccaggctggagtgcagtggcatgatctcggctcactgcaacctccacctcctgggttcaagagattctcctgtctcagcctcccatgtagctgggattacaggtatgtgccaccgcagccagctaatttttgtatttttagtagagacgaggtttcaccatgttggccaggctagtcttaaactcctcacctcagttgatctgccttcagcctcccaaagtgctaggattacaggcatgggccaccgtgcctggccaagaattgtatgattgctgggctccttggcacttgcaagaggtacctgccaagacctggggaaagccctggatttgagaactcaacagatagcttgtgatgtccccaggaatgcgcagtcatcaagtaaaactgaagcattaacgatcacgagaatcagctcagcacgggaaagacgtcactttaggaggcatctcttcaccttcatgcctatcaacagctctagcagaaaggccatgtttcagaaggaaaccaagttttgttcacttggccaggtgcctaggtatgcgagagagagtagagagcagagctgcccctccctggcattcccctgagtgcctccctgagcccaggagcatccaattctagaactcatggccaggcctgtaatcccaacactttgggtggccgaggctggaggatcgcgtgagcccgggagtttgagaccagcctgggcaatatagtgagactccatctctataaaaaattaaaagagtagcagggcatagtggcatgcacctgtagtcccagctacttgggaggctgagatgggaggattgcttgagcccaggagttcaaggtgacagtgagctgtgattgcactgctgcattccagcctgggtgacagagtgagaccctgcctccaaaaagaccaaaagcaaaataagaaaaaaatggaactcttcagaaggggtggtcccatggtagggaacttcaggggtgggcctccagtagcgggtatcaaatccgtgaacttctgcagcagcagtggcccgcctcaggaatgagcgacccatttcccacgtagatggttttcacactgtcagagtaaattaacatgggctcggggaactctggtactgtcgtcactttctggctcttagcttcatgcagtggcggaagtaagaattctattccccaggaatcacccgtcctgtcctgtgtgttaacccttaccctttgcaaataggtgtgcctgtcactggccgtgcagaggcttggtcagaacatcaaggcactggtagaactgttccaagcagtgaggagcagccacttctgtccaaacgggacagcccccaaaccaagtccccaaaccctgaaagccttcccccgacgccatcgatggctccctggccggctgggtggtgtttctcatgggacacttggttgctacctctttctcacaatgagaaaatggtctgttgtcaggaatgagaatatcaagccaccttcacgtggagtgctcagaaaatcccacagcagtgccaccactccccacgcatgtcactctgctcagtggccactcaccagtcccatcaccgtctcctctgtacacccaccagcagcacagagtcacatgccccaggctgggccactcaggcagagacacgcagagagaccagtggctagactgagccctcggctgacagtgccctaaacaggccatggagaccccagtgctgctgcttcctgtcctgtcggggctggtgatggggcttgccctgtgagtttcagggactcagtctcttttaaactgaggggtaacagccatggagtaaaatgcacacagctcagcaggcagtgtggggaatttcacacatctgtgaccaccactctccctcagcattcccagcccccgacagggacacttaggcaccttcctggcactacccacccccaggcagagataccagcaccctcaccaccctcccagtagaacccttctgccagctctgctcttgaacttcacatagacacccgtgaggttcactagggaacattctccccactggggaagggtcccgaaggccaccgggagcccctgacctctccgagccttgttgtgggctgggcggaagcccacccttgctgcacccgcccaagcccccgggcctctgagcacagtgtcattgcccccatccgcaggccatctacaagatggtgtcgtctgtgatgaagatgccggaggatgagtccaccccggagaagcgcacagacaagatcttcaggcagatggacaccaacaatgacggtagtgcggggtgggggcggggctgcatgtgtacgccacggtaggggcaaaaccatgtggtttggggcaccccctcccctctgcagcttcttggtctcctgagggccacccccgcccgccacctgcctggcgcctgccatgcccagggaagagcgggatgcagtcagggacacccgtgctgtatcctggctcctctgtgcagctttgtgatgctgggcatgttgtggcctctctgagccactgtctccccacttatagaatcgggcatacccatattcccgtgggtacaatgtttaggggcagggaggcaagcatgctggtggccctgaacctggaggggttgagatcaaaggatcccagatgttggggtcctggggtgctggccatgcctctcttgctgccatcctgagagaagaagctgcccagatggccccagtgtccaaggggaactgtcaggatgtacgctgccaccttgtccacctacagcagctctgtggagactcagccccactgcagaagtgcaagtctcacgatggtgggtggcagcagtggtgacagggctgtgcctcgagtgccctcctctgcattggctgtgaggtgagggcggctgtgcggccctcccattctgctcttcttgccggctttgtcaagagcagccacagcaccaggtttgctttgcttttgagcaataaagaaacacgaccttaagaagagaaaatacaggctgggcgcagtggctcacgcctgtaatcccagcactttgggaggccgaggtgggcagatcacgaggtcaggagatcgagaccatcctggctaacacggtgaaaccccgtctctgctaaaaatacaaaaaaattagccaggcgtggtggcgggcgcctgtagtcccagctactcgggaggctgaggcaggagaatggtgtgaacccgggaggcagagcttgcagtgagccgagatcgcaccactgcactccagcctgggcgatagagtgagactccatctcaaaaaaataaagaggaaatactccctgggttgtgctggggattaaacgataagctaatgcccaagaagctgctctgcgaagtctggagtgcagccctcgggtgagttaagcatggccccagcgggagacgggatgtgggggagctgtaagcagcaaagagcattccaggcagccaggtcacagtttcaaaacacacacacacagaaaacaaggctgcctggtgcctggcgttgcctttgggctgatgggaaatgtgtgttccaccctccagcctagcagggcacctgctgccgctctcctgaggctgtccgctcctcgtggggatggtgaatccggtcccatggggttgtgaggtttcagcgagatgatgccttaaagcttttagcagggcttgcactccacaaataatggctgttgttcccaacttcacagtgtccctggggaagccacccatggtcactcgctgcccgaatctgcctcctggcttggccctgcccacctcttcagagggcatcttctaggttggttgggaatttggatggcatggtcgttgctaatgtgcctgctgggatggagcacttcctcctgtgagcccaggggacccgcctgtccctggagcttggggcaaggagggaagagtgataccaggaaggtggggctgcagccaggggccagagtcagttcagggagtggtcctcggccctcaaagctcctccggggactgctcaggagtgatggtgccctggagtttgccccaacttccctggccaccctggaaggtgcctggctgctccaggcctctaggctgggctgatgggtttctccaggacacaagtatcattaaagccaccctctcctcagcttgtcaggccgcacatgtgggacaggctgtgctcagcaaccccctcgcctgccctgccctccatcaggaggagccagtggaaccttcggaagctcccagcatctcagcagccctcagagtcgtcctggggcagctctggttctcctgactggaggtccatctgggctggcctgctctctctcggcctgagacaggagggcctggggtcaggaactggaagtggggaggctggggccgtggactctgaggccccacacctagccaaggagatgaccacacagctggctgccctgagtggtcagaggtggagggtggggagccactctctccattggcagaggttcctggggactgtctgctgagggcctggctgtccctccctctccctacccaccccttagcccgggcattgtttgggctctcttggggccagcaggctgcccaggccccagaggcatcaagttcgtgccctggaagaagccagcctgcccaagcctgggccagagtcccatgaggacaggtgtccctgcctgccagtgggctggaggggctgaattcccagcagggccctactgtgcaggggcatcctccgtcctggtgctggtctgagtcctcaaatgcatcctcccaggtgcctttgagatgggtgttcccattatcccaccttcgagacgaagatcctgagacctggaaacgttggtggcttgccatgcgccagagccgagagcccctcctgcatgccttcccctgtgctgggcctggctgcatgcgtctgtgttgcctgcacagacattttgcagggtgccctagtgattccagctgacagcacagagcctcaaacagacacatggaggggctgccccaggaccaggccgccaggacgcagccaacctcaaacctcatccttccccaccagctggagccagagggaccgcctcctgcccttgaggccatgtctgaacgggcagaatccttacagcctatcctgcttgtggactagcagagccagggctatagtgaccacagtgtgagctcattgacagcggttatgggatggggagcggagggtcagaaaacctcaccccacccagctcagccgatcagccttacggagccctgccctaggccacgagcctccagaggccactcagcccagtgtggagtcaccgagtctgtgtcctgggagagggaatatgttgtcaccagcattggatgcggaggatgagggggcagctgattccttagcacgaccaatctttttctaggttttcctctcaccgcatggggccaaaacagtacagagcatgagtttggtaccccaagcctgagcagcgggtctacgctgatgccagggaggatccggaccgtgcttccgggggcccccaaccagcatggccttctcagcctggattctgtatgggttagaggcaaatgcttcatttttctgcacagtgtacacgttccttaataagcgaagtgtggggtgatttctaaaaggatttaaatggccctcatcagccacgtcctgctgagcttgctgggtaagccctttgaggtacctgatgtattgcagggagcagggaaaggaaaaaggattttttttcagaaatgcctgtaaagtgaatggagactagacaccgtccagcttcaagaaggctcaggactttcaacaaagggagcatacctgacctgagagctgtccccatcctctctggaagcataaagaacagtgagcactggctaatcccattgtctctggtcccctgcaggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctga

SEQ ID NO: 1753 - DNA, 58854 bp, Homo sapiens
actgatgtgtgtgtttactgagctttctccgcagcctgctccggcagctccaaaatggcatttcaggaattgaattaccgacatttcagtacttgcggaatccaggaatagattatttgattgtatctgttggaagtcattgccgtaactggcttcgttttcttcaccaacatctaaaccgagtggggagggaccgcaggagaatgctgtggtgacttgattttcccaaaagcacatctcccaagctggcggcagccgatggcgttgccctgtgactgggggaagcctgaggactcacggtcgcctcaggctggccaccttcgcactggaacctgcccatcacatcaaggagccctctcaggctgaaaaccctgtgccggggtggctgcagcaacacaaggattcccctccagctctgtgatgtggggagcagagggccactgagtcctgccatgtgagtcacatgatgcccgtggcctgatttctgtgcccccatcttgcctcttagagtttgttgacctcagggctcacatatcccttgtaaggggttgtgatggcttccacggccatcatggctagttaggattttcctccagcccttgaggaattctctcgggattttttctggccttgcctgtctgcagaatccatagaggacctacaggaatgtctgcctctgagtccatagtacttgcaggcctgggaggctggatcaaggtggatgttgacacttggtggggccggagccctggcttcctggctgcctcatagctcaggcccgtttgacagcatttgtgagcacctgtcccaggcaggagcaagttcaacagcagcaagggctccaggcagagggaggtgggctctgatgggactcaggggcagcctaaatgtagcagagaactgagaggggatccctgaggccttcttggaggaggtggtggttaagccagctaactttgtccattggaaactgtcaccaggtccttattaatcaaataataatgaatatgccgtgttcggatccactagggaaagctgaaattgagctcaaaggaggcatagaagttcagcttgtaattttgaaaaaggaaaaggctctggcctcattaggctgcccccagtgtgtccttgagacctccttactccttgaaatgtgcttcttaacgttttggaaaaaacaactttctccttctatacttagcccttatctcaatgtgcaggcgcctacctggcccacttatcttcaagaaatgtgctgggttaggcctcaggagtggcaggcacatagatactgtatttggccttggccttctgcccaagtggagtctccgcattcctttgtatgggcccattgggcatgcctggctaatctgcgcaccctctttccactctccttcctgcatttctccttcccttcagtagtggctcccttcccattccccaaatcgcctctgcttttatcttcttccaatcgaattcccgtcagtcgtggagcaggtgggacacctgtgtatgttgcgggggcacagagaagcagcctgtgctcacccatgcctgcctgcaggtgcatgcttgggacttggcagtgggggaagattttggggttaggatttccaggctggcttgacactgacctgttttgttccaacccatacaagccctaaaccctcatgtgcagatcctgctggctctctggggaacacttagttggatgcaggtaggaagaggcttcaaggagcagaggaggggctggctgagggccagccactttgtctggtccccagagcggggtctaacatgtgggaactgagcagcaactgtgagctagccctcaggcaaggctgccccatgatgccagggcacatagggcagactccagatgatggggccactgctggcattggccttttgcagggcacaggagtctgccaggggtgtgttttggagccacccatacaggtgtaccagcttttggaaaatcccaaagatgtggtgccctgctcctgggggtcttgggggctcccaggtagcaacagcgttctgggaggacgtgggctcaaattccaacttttctaccaggttttggctatccttcatccccgtggggctcagtttcctcatctccaagctaagggggcccacctaaagttgtcacagaattggacgtgtgacggggcagcccccttcacctgtgggatccgaggcagagctggcacctccaggctgtgggtccagtgacccggcatggagccagcaaacagaggaggcacctccaggctgcagggtccagtgacctggcatggagcaaacagaggaggccagtgggcaggtgggtgttaccagggcctggagcagcaggggtggagccctggggccaggcagggcgggtttggggtggcatgtggtttgttgtggccctgtcatttgcagtttgggttagtgggtctggctggccaccggggttggaggggaatgccagtgggactatacattgtctccttggaggtgactgtgcccccagaactgagtggacaagccaggcttgtgtccacacctgcccccgtcttttaccctcttctggctctcctccaagaagagcttttcctaaatcattcgccctgttcacctgggctttgaggccccaggtgtaggcccagggggtggggtggggtggggggatggtctctgactggatagccccacctgggtaggaagcccccagtgtggccccaccttggctgtgacctgggggtcctgcagagtcctgtgtcctgttgcagtgaggggtcagtcagtgggaagagtggacaattaggagacaccatgtctgtctcctcgacgccagtcaacactgttgcctttgttcccagggcagccttccccttgccttccattccaaactcctcctcctccctctaagattccctattcacctcctagaggaggccacctgagtgtcagccaggcactggacctgggcctgcccggaaaggtccctgggcctggtgtgctccaagaacctcgctgtcaggggtcagcgtgccatggaggatagggagaggcatgtgcccttggggacgtctggctttgtccggggggttttctgctgctcactggcttcaggtcagggcttggctctgtgctgcagccttaagccagcgggcccaaccgcctcctccaggcccgccagcgcctcagatgtttctctccttcttagagggtgtttcacatcctttcttttgtttgccctgattatttttgcagatgaaggaatacacacaatggtcatctttgtcttatttgaaagccaaacacgttgcttacacgttgggtgcacagtgaatatgtatcagtccagcgcttttcaccatctggtctggttttagtgttgctttatttctggtcattcctcaatcggggctaaagatcagaaaaatcgcatctccaggtcctgagccatggcgaggaagctgggtggtgccctgtgctgtgtggctaaggtgggggacgagggttgtcggtgggggaagccccatgggggccccactggagtcataggagcgaatggagcacccactccatgccttctgtcaattacaaagcacctattatgtcccggatactgtgtccaacacagtggacacattgatgggtaaggcataatccccccccaggagctcccagttggattgaggaggcagacaggcgagcgtatggctgtgacacacccagcaactcccagttggatcggggaggcggacaggcgagcgtatggctgtgacacaggggggcaagtggcgtcaccaaggcagaacccagcagccggggcctgaagccccctcacccagctgcagccttcccgaaacagctgagatcagcctggagagctcttcctccctgcctgcccggagggtggcgtgggtcccatcgctctccgtcagccacggccagagcacacctgtgctgctcctcagaagggcatcacctgtggagacggtgacagctgttcctgttccctgccccaaggacaggatctggagcctgtgggtgtgtaaggagccaactccctgaccccaaaactgtggccagttctggagaaggtggccaggctctgggtcccgggactgtggcccccctcctgcctctaaagcccctcttctggcctccatgacttcagcccctcctgcccccagaaggagggatcagccctacaagggacccaagagagggagcctcacacacaggcgctgcctgactctcctccaagctggcctgagccctgggcagtgttctgaggctcagccacacggctgtgcagggcaggtgagagcggcagcctgagagctgcgagccggggccggggttttcctggagcagcaggagggatgagttgggtttctgtaactacaagggccaagaagagggagaggatgatctgggaaggagagtggctttgggccagcatttgggccagcaggactcagaggcgagggaggtggtaagatcccttgcttgggatgagaggcagatggggaaactgaggcttggagcagagggaggggcagggcctgggcccccagcaggtcccagttcatgatggcatgctgcttctgcatgagtgagacatgagggggtcacagacgcccggaagcatcggcatcatcagatcatccgactcgataatagaaaaattaaaatttaaagtcactgaaagtgacgagtgacagaaatgttcctagaaactggagattgggtgctcagcggatctcaggatagatgatatcagacacaatgtcccctgggctgaggtttttttttgttttttgtttttttatgtttcagaattctaaggcaaggatgaaagtcttctctattcttgaggtgctggggttcctcagcctccaccgtccagcctcgagcagctgccccctctcacctgctcctcagccttctggaacagacaggccccccacagcagcccagcccaggccaccagcaccacccccagaggtttatgccatcttcatgcagtgggaggctcagcccccacactgggacctgtccactttagccccaaggatcttaccaaggtcaaatctttggaactcagggtctttgggaacttctgggccagacaacccggccatcacaggggcttctgcggggttggctttatgatgcatttgggtcaggaggtctgtttttatcctttgggcctctgggaaagtccgtcctggccaagtcctctgtcccctagtctcatggctggctggccctggagctcgggtggcctggcccggcccgcctgcttccccacaggcagcggctcttgcttctgctgcctgcagtgctccagatgctgcaggctccttccttccttcagggcatcctaagtcccccgagtctcgaatccccagtctcagctgagtcctcgaggtcagtggggcagaacgccagagccctgggacaacgggctgcataaaacacttattttaattataagagtgatgtaagaacatatcagaaaattggcaaaatacagggcaaaaaaaaaaaatcactggtggtcgccttctcacacagtcacacacagtggtgtgcagccttctggcttttggttgctttgttgcagtattggcacctgcgttacaagattttgtgttgaccattcttgttcttgctgtggtctttaaggtttacagcgacagctgttcctcttcaggatgcaaggagaccgagcctgcctgccctcagggagctgacggtccagcaggaggcatcctgtctgcagggcccatgcgggggacagggcaagaggtgcggtggaaccagaccttgccctccagaaatgcagggagacagacacgggcgtatttaattcaactatagcatgtggttctgagaaggcttcttggaaagggcctggggttgagctgggcaccagcagggaggtctcagagtggaggcggcagttccaccctacggcgtagaggaggcgccctgatcactgcctttcagccgtggccctgcctgtaatcttatcctttttgttgattgttgttggctgatgttggctgttgctgtgtcctccaccagagtggagaactccctggggctggaccccttgtccttattcacccagagaataggtgccttaaaatactgactggacagaaggaggaagagatgggttggggggccgtgtcatggaagaattccttgggccagccgcagaggagtaggccttggcagagagctgggagcctggaggggagctgaagacctctcccatagtcagctgcctttagggaagaaatactagaaagtcacagaagagaaaagaggcggggaaggggaggaaagcatttccacccacagtcctgtcgggagaggtaacattttggagtacagtgtgccctgccccagcaggccctggctggatgcatattcctatagatataattctataagtgagatcattccatatctactattttacaacctgtttttgttttttgttttttccacttagcaacactttgttcttacctagaattcaccaggcaggacagggctgatgagggagcccctcccacctggacactcagtggcccctcccaggactcggggctttcctgggggcctcagctgcggagcaacagctccctgtgcatcagagccgtgggggaggggggccagggggcataggtacgaccaccactcccatttcgtgtcctttaggaagcttgaagaaaagtggttagccaagaacacaaattacggtgatgttgtttgcagtgtggcgtgttgggttaacataaactctgaagtcagaattgacatcaatttgagcccagatcatcctgttagcagctgtgtgacctgggacagggtgcttaccttccagactttagttccctcactgtacaacagggacagggatcatacctttctctgagagttgaaggaagaagtgaaaccaaacacagccccatgacagccccttatgcatggtaggcactcagcaggtgctggctcccttacggcccgaaggaatcgattgacaaactctcaaattaatgacataattcaagagagtagctgcggagacaataaataattatagtagctgatgtggtttggatgcgtgtcccctccaagtccatgttgaaatgtgatccccagcattgcaggaggggtctggtgggagttgattggatcaggggggcagattcctcatgaatggcttgggccatccccctggtgatgagtgagcaatttggtcgattaaaagagtgtgtcacctccctattcttttgttcccactcttgccatgtgacacattggctccccatcgcctcccaccatgatcgtaagctacaccagaagcagatgctggcaccacgcttcctgtacaggctgcagaactgtgagccaattaagacacttttctttataaattccccagtctcaggtactcctttgtaataatgcaaacagactaacacattagccatagccatttattaacataattttaaaagatttcagtcttgtgctgaaattgttatgttgatggttacacatttgtcaaaacttagtgacctgtacacctaaaaggatgaacttaattgtgtgtaaagtataccttaataaacttgactttacaaaaaaaatccctcttttttttttttgagattgggtctcactcacccaagctgcagtgcagtggcacaatctcggctcactgcaacttccacttcctgggttcaagcaatcctcctgcctcagcctcccaagtagctgggattacaggcgtgcatcaccacacctggttaatttttgtattttttagtagagatggggctttaccatgttagccagactggtcttgaactcctgatctcaagtgatctgcccgcctcggcttcccaaagtgctgggattacaggtgtgagccactgcccccagcctttatatctcttgactgtcacaaaatgcatattttatttaagtttgccataaacagaacatttttacatactgtattgtaacagtatataatacaatacataccgtattgtattgtgtgtagtacaatacatagcgtattgtattgtgtgtagtacaatacatagcgtattgtattgtgtgtagtacaatacataccgtattgtattgtgtgtagtacaatacataccgtattgtattgtgtgtagtacaatacataccgtattgtattgtgtgtagtacaatacatgtatgtaatacaatacatactgtattgtattaatcagatatgttgtcctgtgttattaaaatcatcccttgtggcccaaatttgaaggcagtactctgttcctgggtgtgcaccgttaacttctttaatgaacatcctgctgttcaatagtgaggctgcatccttctagaaagcgctgttgagaggtgtgaggaggctgccacgcaggccgcgccgccccgaatggcaggtggaaggcggctgagtggagccgcagcaaatgcaaccctgcccccgagccaggccccaggctgcacctttccactgcttcacaccagcagtgctttacctggaaaggtgtctgaacagtgcttgcaaaggtaactggcattctgccggctgctcaactctgtggacaccagtacagtcaacaactctcactcgccgcgggcacctgctgtgcccacctgctgccatctgagtgtcacgaccacacccccatccctgtcctttcacgcactgtctgcccgcacacactcttccaccctctgtcggcagggcccctgccacctctgaagccccctgccagctctcggcagccccctcctccccctggctcccgtgtcctgcccacctccccacactggcacctcctgagcagccctggctgagcatgcactctgagggcagaccctggccgggcaccaagatacaaaaggttatgagggtgttctcttgaggaactgagtccagtgtgaacagtgaacacagaaacataaagggacaccagaatccccatccccatccccagggtggtgagccaccgaggggggccaggcacgggggagggtattcaagggcggcaagccaccaaggggacggggcaggcacagggagggcatttcagagagtgcaaggaggcggcgaagatgctggttgagggcacgggtgaggcggggaggcgtttcgactttggactgaaggccttaattgaccaaggcggtaatttccagtcctgtgacctcacgacaggctggacattggaggatgggatgacactggctcttctggggtaacttgtctgggtttaaggttcttgatggggtttaggacatggcgggaccctaaggatggtgccagcatctgaattctctgccgtcttgcagagtcaggattctgcagctacttgcccaagaaaaagtagagaaaggtggtttcatgtttttttttttttttttttttttttactgctttgaagggaggtgtgggactcgtttgcacacacagttaatatttccaaggcttgtgcagggccagacagatttggttgcagctgttagttttacttcctgtcccgataaaggagggtgcttgcctcagctctcacctgctgccataacaaagctccatggaccgggccgcctaaatgcagacacatactcagctctggaggcgggaggtctagatcagggcgtccgcattgtcaggttctggggagggctcttcctgctttgcaggtggcttttttctctgtgtcctcctgtggaatgagagcaaactatagtctcttcctcttcttacaaggacactaataccatcatgggggcctcactctcctgacctcaccgcaacctaattactttccaaaggccccaccccctaccaccatcgccctcggggttagggcgcctgggtacacatttgaggagagggcacagccgttcagtccatgaccacattgcatgttccagggaggaactggagagaggctgctgtttgctgggcacctgagctggttatagatgttaaatcctcacggtagaaaatgtggaaaatacagaaacaattataatgcataatcctacaattcagagatcatcacagcagacatatgggtccatttcttctggtcagtattcatttacagcgaggcggacagactcatgctgtaattgagtcatgctatgtatttgtttcaggtcccgctttttctttccacttaagacaatatcattcatttcctgtatcattaaaaatatttgcggtcgggtgcggtcgctcctacctgtaatcccagcactttgtgaggccaagacgggcagatcacttgaggtcaggagttcgagaccagcctggccaacatggtgaaacccccatctctactaaaaatataaaaatttgtccacctgggccagtgcgtgattccgaagactacatttgaagtccagccttgcagctttccaaaaacccgtgcctccctctttctgcttgtaaatgtccctcacaactggtttcccagaaaaattgtgaggatgagcgaggtgttgcttgtggaagttactttggagggaaagtgtttgtgacaccccatgggtgtggcccatggggctcctgagggtggatggatgtgggagtggacaggcctggctccttttcttggtgggctgggctgggctatgagcaggagctatggccgtggctgacccttctgcaatgggagctgagcagtggtacagttagatagctgcgcagatggtccgatggcccggcctccaaggccttgagtgatgggatgaccatgaccactggatgtctctcaataggctttgccttaaccatgccagcagttcccccatctgctttatcagccctggtatgtacatcagattggctaagggtgcaaaactggaatgctattaaattccagaggctctggtcgcttgaaaagatgagctgaaaataagataaaatttcacagggttaaaggcaggctttgcactctggtttaagtatagagtcgtccattcatgagagtataggtttgggagacaatagcattgaagaggcttgagcgcacactcagaaccagtggctctttcttagtctgtccatgctggctatactgcagcccccctcaactggaatcagatgtggcccaaccatgaatactttggacaaagctcccccaagtcaggcatgccctcttgttagggaaggtggattcctgacctgagtccatctggaggtccaggcaggaattagaaccacttcagaaaagctctgcacagatttaattgcacgagtacctgcgtctcagagctgcagactgagtgtgttgtgcaattgttgggcggcttttcccttggccacagtagattcgcaattaagaaaaacaaatgcagctctcagtcagaagtgtgcaaggtttgcttggtctggagacagcagcttctgtgctctggggtagtgaggaagtgtgtgggcaggttggcaaataagccacatgtatgtcccctgggctcagcccccatcttagtgggcacaccagggcccacgagatctggggactatttatgtagggtctgctggggcaggggtgtgggtgggtgtgcgctgcttgtgttgttgaattgggatttttccagccagaccagtctgctgggacaagccttctggctctgggccaaaggcctccccagctgtgatccattcaggcctagaaagctgggggtgctgactgccatcacccactggcctccatggtgtgtccacagagggccaccttcctgcagggctgagctacttctgtctgggtgtagcttcttgtaaagtccctagcagggttgctccctacaacccacccctccccattttctctttctctctgcatgactattattcactcttcaagtctctgtttagatgtcacctcctctgggaagccttcccagattccaggtggggctggaggcccttctgcggactcccctggcatcctgcactcactcacctatggcacatatcattggccgcaaaatctcctgggcacttatcacactgcgggttccttgaaaacaggaatcattcttgttctctgctgcatcttaggatggtgactggcacatagtaggagtccaattaagaatgttttgaataagcgaaagagtgcctaaatgagacttctattccagcttgaagaccagcccaccaccctgataagaaagttcaagtgtgggaaccgctggggatcttgatggcctgggacctctggatcagtgcttgtgcaggacagaggcagccccggagttctcatgggggctggtgagcagagtggggccccaggatgcctgatggcccggtctgaggtgtgcaggtgcccctgaggtgggcaccacccaggagatgcatgtatctgtgaaataccagataggcccttagtctaagcaaggaggcatctaagctccttaaagattccacaaggatgttacgttgtgctttgaacaacagagacgtggctctgctgagccccagccaaagctctgcacagggaccttgactctcccttcccgctgtgtggctccagcaagtttcctcccacctcaggtctgggtttccaggcattaagtgacaaagtggatgcgacgctccttctggactgtaatgcgcactgcgtggagatgttcgtgttccagtgtagacagggcgttgtcacatcaggcaggactacagggacaatgtttgtcagcctgtcttctgggcaacttggggtatcctccctttatatcacctcctgcccaggtgctctgcgccgccagagcatcatgtcatttgggatccctgatggcaattttgagactttggttcacagtaaagattggtcctgtgtgatcttaaagtaatgtggcttaaaaacaaatggctgtcagggaattgtaaatcaaagcaaacaccgatgagaatggcccaaatccaggacactcagcaccaaatgcgagggaggatgtgaagccacaggaagcctcactcactgctggtgggaacgcaaaacagtacagccaccttggaagacagtttgacaaatccttagaaagctaaacacacttttaccctgtgatccaacaatcatgctccttgatatttacccagaggagttaaaaaaacttatgtccacacaaaaacctgcacatgggtgttcatagcgactttattcacgattattcataacagctggaacttggaggcagcgaaggtgtccttcagcaggtgaatggataaattagctgtggtgcatccagacaatggaatattattccacagcactaagaagaaatgagctagcaagccatgaaaagacatgggggaactcatctgcatatgagtaggtgagagaagccaatctgaaaaggctatgcctatggaggattgcaactctatgatatcctaggaaaggcaaagcgatggagataataaacagatcagtggttcctacgggttaggagggagggagggatgagcaggcagagcacagggcatttttaaggcagtgaaactgctctgtgtgatactgtagtgggggagccatgtcattgcacagttgtcaaaacccatagaatatacagcaccagcagtgagtcctaatgtaacctacggacttgggtgataatgacgtgtgaagagacaaggcgggttcatccgttgtaacaaacagccaccctggtagtagggagggcaggaggtatgtagagaactctgtgctttccacgcgattttgctgtgaactaaacagctctaaaaaataaagttcattaattaaaaaaaaaaaaaaaaaaaagggaaatgaccacatgcaaagcactgcgtggagggccacgcatcccaagcaagtcagctagagtagaggcaggaaccaaacagctctatgaggttctggatgagaagccgcatgcaccaccccctccctgctcccgtgtgggacccagtgaagacctcctgtgcccggctgcagctgctgagtgtgggagtgtgctctccacagcaaaccagccgtgaaggctgcacaccttcctgtttctgcccagccacaccacagggcactcagcccttttcctgagcacttgaagctgcgtttcctcgagctccttcctgtttaagaacaggaggggagtggcggctcgcttgtgcaccactctccagggcagtggtgtgcgggacaccctgcagcacctttgactcctcctctgggaatgaggcgtggtttaatctgcaaccccttaccattagagtctgcaactagtcaaaaggtgaatctggctgggcgcggcggctcatgcctgtcatcccagcactttgggaagctgaggcaggaggactgcttgagcccaggagtcctgaccagcctgggcaacatagtaagacctcctctctacaaaagtaaacaaaactagcctggcgtggtgtcatgtgcctgtggtcccagctactcaggaggctgaggtaggaggatcacttgagcccaagaggttgaggctgcagtgagccaagatcgcgccactgtgctccagcctgggtgacagagtgagacccaccccccttttttttcagaccgcatcttgctctgttgcccaggctggagtgcagtggcacgatctcggctcactgcaacctccacctcccaagtttaagcaattcttttgcctcagcctgccaagtagctgcgattacaggcacctgccaccacacccagctaatttttgtatttttagtagagactgggtttcactatgttggccaggctggtctcaaactcctggcctcaagtgatctgcccacttcagcctgccaaagtgctgggattacaagtgtgagccacccagccctgagtgagaccctttctcaaaaaaaaaagaaaagaaaagaaaaaaaaggtaaatctaagaggtgaccagtaggggaatatatttgtcgagtctcctcacctcagcactgttgccatttggagaagcataattctttggtgtgtgcggggaagggggggctgtcctgtgcattgtggggtattgagcagtatccttggccctacccataagatgctggtaggcatgtcccctcaactccccagttgtaataaccaaaaatatctccagacattgccaaatgtacccgggaaaatcactcaggttgaagtcactaaattatatgtgtgtacatataattacacatgcatatacatcgcgtacacacacacacccacacacacacacaccttttgctggtggctctggattggtaagctggctccatggcaagaatcagcatcctaatacttgccccaccctttaaaataaacttcccaatcctaggcagacaaaagaacaaccccagacctcctccctcagggtggggacaaggtgagggaggtggcggcccggcaggaaggtcatttctttcttcagtcacatcagatgagctgcttcccctcactaggagtggatggggctgccagtggtgttcttgcaaaataccccttgtgggaggagaggggtggagggagagaacaccctccacacatccccgtgggatgtctggagggaagggttttgggcacccaccctggggagagaggagagcccaggttaccatctgtggtgtcccctcgctcacactcactactgccctccacaaactgccatgcttgcttggtgcacggtgctgtgctgggcactggggcaaggccccctcccccatggggctacagatgctaatctgcaaatcccagaaaagtggaatctcggtggcagagtggatgaaggggaggtgctcagtgctatgaaagccagcagctgggagtttcaggggcttccctagggagggaccctgagctggggtctgaaggaagagcagttcactggggagttagggagtgttctaggcagagtaaacagtgcagtggcagccggggctggcacttttaaagaaagcctcaagacttctctttctgattgtgaagtgagctgagcagactgaaatcaaagatgtgaaaataaagatagaggcgacaggctgggtgcggtggctcatgcctgtaatcccaacgctttgggaggccgaggtgggtggatcacaaggtcaagagatggagaccatcctggccaacatggtgaaaccccgtctctactaaaaatacaaaaattagctgggcatggtggcacacgcctgtaatcccagctacttgggaggttgaggcaggagaatcacttgaacccgggaggtgaaggttgcagtgagccagcctggcgatagagcaagactccgtctcaaaaaaaaaaaaaaagatagaggtgacaggaagaccccaccatgagtggcctccactgagtgcgcatgtgagtgagcagctgtgcggtggtccttgccatcttcccatcagcccctcccagcccctgggcctggagaggctgagaatctgacctaaggctgcccagtggcgtgaggctggcctgccgagcttacgtccctgggggactccaggaccccagtgcttcctactggtggcttcagctcccggtcacttgtcgggaatgcagggctgaacccctggaggttgtgtgggacagggcccaggaatctgcattctagcaagcacctgctccaggcttgcttccctggcagggaggcttggtgatccaagttccttgggtgcagacacttgctgcttctctcggaggccgggctgggctgtgattttttcatccaatgtgctgggctgatttcacttgcggatgcagaatgagaagctgtagaggagatcacggcaagctgtctgcatggacgatggcagaatccggtgtctgcttggccgcgtggtgtcactaataggatttgccgagccttttggatgtttgtggcgcgacggctgctgtgggaacccagaggctgctcatttgcagggaatgaataatttatttctgttttcagatgacttattccttcatctgcagccgagcccccacatgttctgtaggctcctgattaagtgatttcagcaggagaatttggcttaatcccccactgccctggacgcctggttccaggctgctgatttgtcggcctcgtgtcggggggtgtccggagcctctcctctctgggggcttttcttcctgctctgcctgtttgggaagcctctggccactgagcatgtgctggccttgggttttacggctgtctggcaattagaatattaatgtcgataacacagcaggacttgcgtgtgacaagctgagccacataacgtcacagtcgctcttgaacatctcggactttcacatgggccagccacaccccagcctaggttgctccctcacctcctcagggcctccctgatgtcggtttagacatgtgccttccatcttgcctgggccaccatgttgatcctctgggtccattgctcaagagcccaccatggctccctgttgccaaatgcagcctgaattcagtattcaaagccctccgtgaatgggcttggtccttcctccctggcctctcttgcgtggctccatgctctgagctgcctactcgctgactcattcatttaatgtttattctttggttgttgtttcagcactgagtgggtctgtggaatcatttacatgtttattgagagtccccctggctgcagatgctgggcaggggctttgatgtggggagaaagacccccccccaggttacaggtaagccctcccaagtggcccagggccctgggagggggtgaggttgtgtgagatggcagtgtgggagagtctcaaatttttggcatctttaatctgcccactgggtgagattgaggactcaggtgggtgtcaggggctttgaatgccaaaccacaaaggtctgcaggctgggggagctgcaggaggttgtcatcagtggcaggggccttggagcttggtggaggagaccacgcttcagatggccagctggagcaccccccaccagccccgctgcctggaccccttccacctctccatggacccacctcaggccctacccaccctctgcaccgccttgcacggcattgcttaatttcactgcaatggctcactggggctgctttcctccctctcttattgctctctgggtgagagttggtctctggcctccacatgaggcagggacagtgcccagggagtggccagtgggagaagcggggcttgcaggccaggtgggcccaagtgtgattcctggtgcagtgctggtggctgtgtcgcccggggcaagtggctcagagcctgtttctcatctgcagatggggggatggtctgtacctgtccagcacccatgaggagcaggtggaacaggatgtggcagtcaagggctcctgaggggacccgtaagtgccacattcagccttctgtgttaaggaccatgagtccaaagagtagtcgcgtgtgaatccacctccttgtgccagcctcacggcctcctcaggaagggcatggaggagcagtgggatgcccacggtaccgtggaggaagcagtcctggaggaagggtgactggccgagggccatgcggtgacgcactggggactggctctagctgctgtggggcacgtccacgtggagaagcgcttggtgtattcccccaccctctcacccccacagcgttcctggtgctctgggtgcctgctgtttctgagccatctaggtgggcacagggacaacctcaccagggacagtgtggccccatgctggtaagcaggcgatactgaccctggttccaaactgcattcctgttggtcctttgtcttgctcttccggtatcattacgaacacaactttagaaagtttaacagtggtactcagagaggcttgtggccccaactcatgtgacagtgaccaacaggtgaaaggtgacttgtggtctgaacacctgcaagggacacttattccgatgcctgaatctttgcatctctgcccagcagatgacagcacctggagtgttagctggtcatacctggacctgcgagtgtaggtaagacccttcttctcagggcctgtttgctcaactgcacgatggaagggttgggcaagatggatctttcctttcttttcttttcttttctcctttgcagttgaacatttttcttgccactgaaatcacaggtggaggtctgtgtgttcggcaggtgaatggccatgcaggggtggagggaggcctggatgctttttcttccctgcactcgcaggccccccatgggaccctcagcccccagaggacaattggaggcttctggactagggttctaaggtctcctgagaaggtcagaggctcgttgtccggccaagacagacagcagacagttggcgtgtctcagggtaggaggctccccaaatagaaagtactggattgggagcggatttattgttccctgcctccccggggccgtcggcatttcccctgtggctgcctcactgttctgatgttggcaaaggtttgttttatcttcctccttccagaacaggaggtgcctcagtgcctcagatgctgcctgagaaggtcagtggcatctgggagccatggtgagggtggcagtgactgggctcgggaggttccagaattctgttagtgagcagtgagctgttttattttccttcctgcctatggaaggtcctgagtgaacaaacaagtttcagtctcaagacaacacatcgtgtttcgaggtgacctgtccccaccccacccctgtcactgggagaagactgcaggtctcacggtctcccgtctgtctctgctgcccccaggtccagggactcctgcgatttctctccctggtgcctggtatttttgtagcactctctggttttcaaagttttcctacaacaattgtgcttaaaatgaaatataaactccatccccagcccccaagtcccactccctgccgacctcgtctcttactgggaaggcccatctttgtcaccagcagcagctgtgagtgcctcgtcagtgtttaagagtccaggtcgctgcagcatcttggtgtgtactgtggacccattgtgtgtgtgcccccaaattcctgtgctgagaccctcactccgagtaggatgttattaggaggcggggcctttgggaggtaatttggtcattagtgcccttataggaagaggatgcgagccagacctgcctctgctgtctaccaggcaagtatataatgagaaggtgacgtaggaggcgggactcgactccagaggcaggactcagacaccagaccaaattgaggactagctacaacagggccagggtagaaacagctttccctaagacgtgcccaccagtgtgcatgtcagtttaccactgccatggtaatacccggaagttacggctcctttccgtggcaatcatctgacgacctggaaattaccacccttttcctagaaatttctgcataatccaccccctaatttgcatgtaattaaaagtgggaataaatctgattgcagtgccgcctctgagctgctgctctgggcacactgcctgtggggtagccctgccccgcaaggaacagtccctctgctgccgctgggcacagctgcttcagtaaaattgctaataccaccggctcacccttgaattctttcctgagtgaagccaagaaccctcctgggctaagtcccagtttgggggctcacctgccctgcaagatcaggagccatctgtacaccaggaagacagccctccccagaactcaactgtgctggcaccttgatcttggacttccagcccccagaactgtaagaggtaaatgtttgttattgaagccacccagtctatggtaatttgttagagtggcctggaggaagacacagtattaagtaaggcttcgtgtctgacttcactgaacactgcggttgtgagacgcatctgttgtgtggggcactgaggttcattctgattgctttatgggactctgttgtgactgtactccagtttctctgcccgtggaatgtacatggatgtttggatagtttccagggtggggctgggacaaattgtgcagctctgagtgttcctgcacatgctttgtcttggacatgtgtccttctttctgttggacatacatgaaggaggtcagctgctgcttcacggggcatgtgtgtggtcatctttagtaaatatgccagtttttcaaagtggtcatagacagtagattccttttattatgtgacaagagctcaaatgccctggtagtgggagtggcagcaggagctacagtaagacattgcacattctctggaagtcagggatccctgccagtcagttcccagtgccccaggaaccaggggtttggtgctgggcactagtcatgaccactcgcggctcaggtgttgggtggtctttccagaccttcacctgtgtgaagcttgcaacctggatggtctcatgtggacatcttggcttccaccctgtgctctgtgtctggtctcagaccacagcccaccctggtggtctcctcaggacacataggctcctctgtaactcagtttcttgaattgaacaatggaagaaaatgcctctatgaagagaggtcattgtgcaaaacgtctgtgtgacagtattcttggagcaactgtgcttatcacccggaggccacagtggaattagtcatttgaaaaccagtcacctccaaaatagtcataatccaaaaccatccatctttgacttcagactccattataattttttctccctaagggactttgctttgtaattatgttggatttcctaatatattaaaataatttgtcatctcttgagcacacatctgcctgctatgagcaagcaggagaggccacttccggttttctgcaggtcccagtgagcatgtgaagcctgcgcctgggcaagaggttggatactgggaggaagaagcttttccagtaccctttcccaaagaccagccagtgagggaaatgggcaccgaatgcaccccaccccccggcctgggactgggccaagaaggaggaactgaccccagaaatggccccggaaccataacctgcttacactgtgacctgcagtgcccatggtggcagcctgggctgtttctggagttgagcggagagttcctccagtctaaactccttagagaacatgaatattcctgagggcctggggtccggcaccaccttcagtggactggatcaccttcttgaaggcagagagatcttaagagcttatgtctgactgcctacccgatgcccagcactaatctgcatgcaccccactgggccatgggcttctcaaaggtggggacgctgtccctgtacctaacacacatggtgggcactcggcctaggtttgcagggcctgctggggagttctccaaggcagttttatagctcagctccagcaccttcctgggggcccagtcctggatttgaggctgccaggggggtttgcagtcagctaagttggtacccatccatcccttcccctctgtaaggggtgacaagcactaagacctgttatgtcccctggaagctctacactctgtccccttgctcttgtgactctgctctttgctctcctgtccactggcatataggagtaggaggatattgacttagattcctttttattatttttgtttaaatcagctttgtggaaatgtaattcacataccctaccatttacccatttaaagtatacaatgtaaagtatacaattcagtgatttttagcatattcacttgtatgtgcaattatcaccatggtcaattttagagtgctttcatcactccaaaaggaaacccgtaccctttacctgctagcccctctttccccatccgctcttctgccagccccaagaaactacgaatctactttctgtctctgttctggacattttatatagatggaatcataccacatttgtccttttgtgtctggcatctttcattatatttttggggtcttgttgctgtttttgtgacagagtctcgctctgttgcccaggctggagtgcagtggcacgatctcagcttactgcaacctctgcccctccaggtttaagcagttctctgcctcagcctccggagtagctgggattacaggcgcgtgccaccacacccggctaatgttttgtatttttagtagagacgggatttcaccatcttgtccaggctggtcttgaactcctgacctcgtgatccacccaccttggcctcccaaattgctgggattacaggcatgagccactatgccaggctgttgttgttttttaagacgtggtctcgatctatccctcgggcgggagtgcagtggcatgaccatagctcactgcagccttgaactcctgggctcaagtgatccttctgcctcagcctcctgagtagctgggactacccccatgcaccaccatgcctagcttgtttatttatttagtagcgatgaggtctcactatgttgcccaggctggtctcgcagtgctgggctcaagcgatcctcccaccttggcctcccttagggctgggattacaggtgcgagccaccacacctggccaagaattggtattccttaaatatttgtagaattcagtagtgaagctatttggccagggcttttctttgtggatagtgttttgattactaattcaatctcttcacgtgttataagtctttcaaattgtctctttcttgagacagttctggtagtttgtgtctttctacttggcttagattttgcaggcctcccctgctctttcagtcatagttgacatttattgagttctttctatgtaccaagcatttgttgtgcattagctcatttaatctttacaaaaacttgatgagctaggtagtactattgtcatctccattttacaaatgcgggagtggaagcagggagaggtgagataacaggtcaaggtcacactgttaggaaataggaaacagtccagctgggctttgattccagacagtccagccatgcagcccctggccttgccacctccctctgccattctccagagactcggagaggggcctaaggcctgacatgaacgaagggctgggggaggtggggtcggaagggccccaggaaaagcgtgtgtgtgaagggctcagactcccagttggggagttcggatgtccccttctggggctttcatcttctaacctcctctcccaagcgctcagccaaagggcagcacagagcaccctaccctaaggtgtgacgccccagctggcaggactttggagcagtagatctgtgcccagcaggtctgtatgaatcacccaggcctctgcattttgcttttctagaggaagaggcatggcaatttgtaagacaatcgccagacagaaatcgggagcaaccagacataactcaacataattatttctgcataatgacttctgctacttgattctgtctcgagcaatgactgtaatctctatctgtcactgggaagctggtggccagggagcccctgtggcttagagatagagccaggaggaaatttgcaattcgagttaatggagtgttcccaagcagcctgagcgccaattccttcaaggtctccggaacagcagacccccttcctgctaggaagcctggtgtcagagctggctgggcctcctctgcggagtccagctcatccactttgtcacagatggggaaactggaaatggcagaggtcacaggatgtgcccaaggcacaggccaacctggaaccagcacttcctctccaccctcccaccacccagcattttccccttcagctggcctggctgtggtgggacagaggaaagatgcctctgtggagctggtcactgagagtgctggccaggcagggctgcccccaggaagctggagacagtggggcctttgcaaccagatagcgagggacctcaatgtggagatagggtgtgcttgctgagcgtgccagcaggcttgtgctcacctgctccagctgggggcatgcagaggcccctcctaccccaggaggatgcttattcactgcattccatggccttttaaaaatcccctttaggcccgggcgtggtggctcacacctgtaatcccagtactgagggaggccaaggcaggcagatggcttgagcccaggaatttgagaccagcctgggcaatgcagtgagatctcatctctactaaaaatgaaaaaaaaaaaaaaaaagattggggtgcacctgtagtcccagttacttgggaggctgaggctggaggattgcttgagcctgggaggttgaggctgcagtgagctttgattgtgccactgcgctccagcctgggtgacagagcgagatcctgtctcctgaaaaacaaacaaacaaaaaaaaaaccttgtaactaaccagagcagctgaaaagaacagagcatgggtttggggatttgtgttttgggcgccccacaccccatttagccgagtgtcacctgagctggtgtcccggagtctctttccttctccataaacagttgagaatgagctctctgccaggccggtaggaaggggatgatgaaatgaggacctggtacattctgctgctggttccattgctgggtttctcctcgtggagagcccttgaccctgtccaggtcttgatttctcggagtgtcaaagcagtgcgcacggagctgtgagataaattggctgagatcatcgatttgaaaacgccgtgagaaaatatggggcaaggcagagagcacagaggggctttagggcagcgagcccgcgctatgtgatgctgtaatggtgggtgcgcatcggtacacgtttgtcaaagcccacggagtggcccacgccaagagggaaccctaacgtgagctgcggacctggggggtgatgatggtcagtgcaggtccctcagttgtaacaaatggcctgctctggcaggggatgtggatcgtggggaaggctgtggccgggagtggtgtaaggggtgtgtgggaactttctgctcaattttgttgggaagacctaaaaaataaaatcttttattttattttatttttttgagacaacatttcactgtcacccaggctggagtgcagtggtgtgatctcggctcactgcaacctcagccttctgggcccaggtgatcttcccacctcagcctcccaggtagctgggactacaggcacgcaccaccacgcatggctaattttttgtatttttagtagagatggcatttcatcatgttgcccagggtggtctcgaactcctggagtcaagcaatccacctgcctcagcttcccagagtgctgggattacaggcgtgaacaatggtgtccagcctaaaatctatctttaaaacacacacacacacacacacacacacacacacacacacacacacactgctatcttaaaagcatagggaccttgcagtgagaatttctggtgggaagatgtatgactttgtcaggtcttgaattctagcagtgagtttacattccataattggcctacaaaattctatatttgggaaacagtagaaatttaactctgagcaagatacaccctatttccaatcacacgtgatgcatctcgggggcattcatttgtcaaacattatttgttgagcacctgctgtgtccaggctctggacgcatagacgtgaaacggacgatttcctgaccttgtggcgctcacagtcaggggggtgggttggtgggtgggtggaaggaggggagaggtgcagcacccccattgtgcaggagcgaggggagccccgctggcacgccgcactgtgctgaggctgggtgttctagggtgaacaagccacttcgtctagtgggtgcttgtaaagcgggatcgttgctatgagagagagaaccttgcgttgggagaaagtaattagggagtgtgcggtagatgcggaagagaaacgggccgtcaggtgaagtgactgtcaggattccatcctggctcggccccttggaagacacatgatcttgcaggtaattagctcctgtaagcctccatttttccccgtctgtcaaatggggatgatgattgtgcctgcctcccagggctgctgtgtggattacgttggataatgagtacaaatgcatagacagcctttagcaaggagcctggttgtatagagctgtcggcctcaacactgttaatacacatatgtaccagaggctgcaggttcacggaggaggagtcaccaatccatgcccggggagcaggcagagaagagggaggcgggcccgtcccgagttcacgccacgtgaaaggtgcttggaacgcttgtgccagagctggcagtgagggttgagggtgggagtggccgagcacctagacacccgcaatgcaaattttccttctcagtctctggatggttttctgagctgagctgcgggctgaatgtcaggtgatgcgtcctgacctcttcctgagcacctagtgtgtgccctgtgctgggcccaggaggcatgctgggggcaatgtgggcctcaaggaggaggtcgggtgatgaggggccaacccaggtatgccagtcaagaaaccgtggaggctggagagaccctgaagggagcagggcacagtcgtgggtggcaggcctgggtgtgcctgattccactgaaccctcgtaacagccctgggtgcagagtgtagagtgctgggtgaggacggaggctgtgcgtctgtgatggccccaggtgacaatgctgttgggatttgaacctgagtttgtggaccacagaggtcccggccacacttagtttccatgccagttttgtagtaaccagcaacctcactcgaagggtggccagcatcttaccttggggcttctatcaacgttgtcctgggcttctcgcctgctggggtgcagcggccttgggcatgtgcccctgtccatggtggctggccggaggccgggagccagggctttctgtatgtagcatggcacttgcaaaaactgtgatcccccagcaggcaccacagaagcaaccagagggaggggcatgggctccgggccgggtcgtcacagcctgcgtgacctgtcgctcttctcttccaggggcatggtctagtggcccagtcaggacgcggaaacactccctggaggttctgacccactccctctcagcctccgcctggtctctggtaagtcactcccagaggccgactggctcagggtgggtgaggactgaggatggaagtgggtggctcctgctgtgccgtggggtcctgcccatgtgtggggactggacccagctcagcagaaagagcagggaagactgggcgtggggggcagcccagctagcacccctagacaggtcaggaaactgcggctcggaaatgcagagaaacagccccccaggccccacagccatctcagctctcgccctaagctggccaggtctttctgggtaaatcgcgtgaccttcggtgcttctgtttggcgatttgtcaggggaatgaggggcccagaactttgagaaggacgtgtgggtgagggcaaggagggcactgtcttagtgtccgggtttctttgtcttctatcccctgcagcccctgtacctggaagcttccttctcccaggctcctgtgcatggtcagggccactcagccctctggacccccacccacgccagataagctgtctgcgctgggagctgggcatgtggctctcccctcagagcagttaccgtaggctgccgggcccagggtctgtctgaatccgccaccctgcagccccccaggcccctgcctgctctgggtgcgaggaaggcttgagggagggcaaagtgcttacagcttgaatgcaccaccctggcctggccactggtcgcctctcccccagtgttagcctggcttaggggctttttccatccggaatccttcctggccctgcctgagctaactccgtgagctcgggagggctcctcatgaccctggtcatcctgccagctcccgagacaggaaggcctggccatgtcccggggctgccctcgggtctggagagcctgccagccatgctgtggggctgcccttccagcgttgagggtttggttttgtttgtaagcaaggaaccaggtatgcgatgctggagagtgtgtaattctggctgtgcctcttcacagccccttccaatctcgtgcatattaaggttgataaaaacaccctcttcagggtcaatgcgagatcagacctggagtgaagtgtccctgtggtatctggaccagcaggacctggctgccccacagctcctcctctctctccctcctccctctcatggtctcatgactattatggtgactcttgtcactcaccaccctgccccacctgctcctgcatactgtgagcatcagttggggccatggatgtagcaagggtcagctgtcataggctcccggggggacacctgggggagggacatttggggacagagccccatctggccatgcccagcccctgagagccctcatcaccgacttgcatctggtgagtttggcagggtcctgtataaggattaaagtcctccaagtcctcatacaaagtcgctttccaaaagtctggaattttcttggccctagacacgggagatgctctttataattttcatcttcccactcagaaggaaccacctttgaatactcagccaggctaaaatttggacccaaaacctgttaaagcatcactgtcttaatttcagtgttcatgatggggttctgggctgtgtgaggggtggagggcagataccagtggcaggtttcatctgtggccctggtagatgtgagtcccgcagccggtcagcccagggcccagggcagaccccgggcgtggctgctttcccgctgggcaccaacgcacgcacgtggtgtttccagggcaaagtgagctccccaccctctgcccgtcccctgccccgcccttagatctgcatcccgtgggtggggtgggttttcctgccttcctcttcctgagggaggcgatttctccttccgctttctccttgccacagtagctgctgggttgggaggagacatccaggctggggcctcagcctcagggtgccagttagcgtgtggttagctgagaaaaaagtatttttctcagcagaaaatagacacaactgcatgtgaaggggccacttccactccttcattctccatccaccagccttactggagctagagagtgggggaacatctgggtccgtgttacctggatgtcacctgcatacaaatgtcctggcccgaggccactgtcagcacgggtgcacaggggaggcgcctggcccggcaggtcgtgctgaggctgatacccgtgtcaagaagctggagcaggcgaagagatcagaagagggtagaggaggtggtccgaggtgtccattcccatccccagacccctggggcatttcagtgcacgcacagcaaataatatcactgcaccaccaccaccaccaccaccaccaccaccatcaccaccaccaccaccaccatcaccaccaccaccaccatcaccaccaccaccaccatcaccaccaccaccaccaccaccaccatcaccaccaccaccaccaccaccaccatcaccaccactaccatcatcaccaccaccaccaccaccaccaccatcaccaccaccaccaccaccaccaccatcaccaccaccaccaccatcaccatcaccaccaccaccaccatcaccatcatcaccaccatcaccgccaccatcaccatcaccaccaccgccgccaccaccgccactgccaccgccaccatcaccgccaccactaccgccaccgccaccaccaccgccaccgccaccgccaccaccaccaccacgagttgagggactctgggatcagaaggcactttccagcacattcacaccattggccgtggatgttgtgggtcaggtgatgggcactggaagggccttccgcttctctctgcccctggcccttggtcatgtacagcaggccgctccccgggcagtggagaagcagcacctgcatactaaggctcgagtcccagcctcccctaccagcctccctctccacgtccccagacactcatgcgttccttcccttgaggtgggttcatggagcacgtaccctgtgtcagacaagcttccaggctctgggcttctgatggagaacagaccagagtaaacctggccccaaggaccttgagctccactcaaggggagacagacagtgaactcaacaaaacagaaatgagagaaaggatcaagctggaaaggggataaagaatgagtgtcggttttggatagagtgcttggggaaggccttcctgagatgagacctgaccaaaggcctgcaggaggtcagggacgggcgtgcttctagctaaggagcagctggtgcaaagggcctgtggcagacgtgcacccgtggcaaggagggggcgagcaggcggctcagccaggtcggagtgggtcacacctgaggggcaggacgctggcaaccccgaccgctgaggaagacaggtgcgagcagcatctcggcacagccagacccccaccatacggcagccctctgtgtcccttaaataaggatgcctcctcccaggcttaagagatcattgttgctcatagtgatttgtgtagccaacaattcttctggaagaagttagatgaacagggccatggagatttggggccggaagagcaggaccccaggcttgcctcccctctagtgctggccaggccgtggatcccaggcgggcatctcagagagccatctgagcggcctttctggaagtgccctcctaggcagacgctggtcatgaggcagggcagcggggaagggacaatcctcctgtgttgtacattgagggttatatttagggtgacttgggatgacttggcagtatcacttcctgtggtcgtcccctccagccctcagccacggagggcagatcctgtctgacaagcattgtgggcagacacgtgcctgcacacacgtacacacccacatgcacacatacacacacgcacacacatacacacattgtgggcaggcacaacttggcattctcatctgccctggaattggtggagggctggggacattgtcctggcccttctgcaggaccgccaggtgcctggcgggggaatcctagccgtcagcatctccggagcatctgctccatgtcgggctctgtgtgaagggctgcatccagatcccacatgagcaagaccggcctagcctccccatctggttgggagatgccaggcagaggtggaaggaagggcggctgacctgccccttagtctgctcagccacacaggcagccacagccgaggctgcacaaggacactcccctgaccttgctgcctgctggccccgggtctccaggccaggtccgagccagccaggctcctccccacccatgtcaccggcctctctaggtggagtccacagtgatctttgctccccttccccaggcatccagcaccacaccaggcacagggcctggtatttctgggacagcccagattacacgttttctctcagttaccccctagaatattcttggacttctcagaccccatgtgcaaatttttagcttagaagtaatcactgggatcatagacgatgtttagcaaatatctgttcttttgggtgttcctaggcccccagagggtctccgggaaactggctcttttgctgaggctagagactatctgggctagaatgtgtctgatggggctctcggagggtgcacagacagtgccgcggtggccgaagatccactattccaaggccggatctgcagaggatttggaagttgtctgtaaggagcgcctagatcacccggaccttctctctccctccttgacttccttcctgcctctcgtcaaacaattactgtgtgcttcctgtgttctaggcgctgtgctaataattggttatgggattattcctagccacaccctgggtaaatggaacccagctctctgtccttgggaaaagggtcaggagagaactggggcccagctgggaagctggaggcttgaggctgctggtccatgttggaatgctgtctccctctgccatccagcacccaagcccggcgccaggctcagagcaggaactgaagcttttgctgttgttgttgtttttgttttttgagacagtctcgctgtgtctcccaggctggagtgcagtggtgtgatctcagctcactgcaagctccgcctcctgggttcaagcgattctctgcctcagcctcctgagtagctgggattacaggcgcgcaccaccacgcccggctaatttttgtattttgagtagagacggggtttcaccatcttggccaggctggtcttgaactcctgacctcaggtaatctgcccgcctcggcctcccaaagtgctgggattgcaggcatgagtcaccgcacccggccaggaactgaaccttggtaggagaaggaaagaaggagttcctgtcttgctttcccgaccagactggaagcgctctgagggcgttttacacttcggtgtcttcccagcacttagcattgtggcctgcatgtaaggggtgttccgtgactgcgtgttgattacactttgtgtgtatgggtgggtgcgttgccacaactctccctgcagaatctgtggcctctggtgctgtgatttaaagactaaagatggcaaagagtggcttttatgagctgccccactcctgattataaacacactctctatgagtcagaggcctgggtgatcatggataagtcacttgccaacagttaactccagactgtagctgctggggccaccgagggcggctggaacatcaccattctgtgcctagcgtttcagccgggctgaggccattttattaataatgatttattgtttttattgcttcccagagatattaaacatgaatcaaataatgcatgtgatgattcactggaggttcccttccaaatttaaaaaagaattaaagaaaaagtttttgacgggtgtgctggtgtggacaccaggcaggcacctgagagccctcccaccttgagctcagccgtgggcagcacagcacagggtggaccttgccctgcagacagagccatgcagcctgcgcaaaaccccagggaggacgcgcgtctcacaaacacctcttcagtctaacatttacaatggtatttcttacaaatggtttccacccgagatatattacaatgtggccaaaccccattcatttgggacacataaattcaaaatttggaaatagttcctttggggctcatgaactgatcaagtttagtcatttctcaagcagggacctggcagaaatgttgctttttaccatctactaagacaagagctaggcagctggttctgctgaacaaggtcccggggagagggacaccagtcctggctcagtgagcagctcctcaggtgctttggaagcctcctctggggatagactcaaagaagttttctatttatttatttatttttctttatttttaaatgtttttctcaaggatgttttttagagctagctcatacctcaggggccacactgtccaaacacatattggaccctgatgaggaaagtgagagccgtcagggtgtgtgacatagccactgtcacccaggcctccagctccattctgcagttgaaaatgatgccctcataacaaagagttcttttgtgtgtgtgtgtgtgtgtgtgtgtgtgtgtgtgtgtgtgtgtgtgtgtgacggagtcttgctctgtcacccaggctggagtgcagtagtgtgatcttgtctcgctgcaacctccgcctcccaggttcaaatgagtctcctgcctcagcctcctgagtagctggattacaggtgcctgccatcatgcctggctaatttttgtatttttagtagtgatggggttttaccatgttggccaggctggtcttgaactcctgacttcaggtgatccgcccacctcaccctcccaaagtgctgggattacaggtgtgagccaccgagtccggccaacaaagagttcttatccgttcattacaaacgcccactctttccagtccttacctgatcaagaattcagaggcaatttttcaggtatttttttgactcggactttacaaatttgaactaccattcaagtaattggtctgaattcctaagtttcgatggtatttttctcttccttcttctggctgcctctcctccccataccctgcatttgttaatgtacccatttgttccatattctgtttgttctttattgctctatacactgctccataatgttctctatcatttgtccattcattacccatgaaggtacatgcagaggtcaccagcccagaggtttgtagcagggacaagttacttgctggtggtggtctccccaaaagtttgggcctgcgagtcattgacacctacacactttgaaaacaccccaggatgaagtctgggactggaaggagctcccaccttagccagactctggcctcctccccagctgtgtccccgccagcccttctccagccatgcccttttgcctcccagcacactgaggattcctcctggaatgcccctcaccccgtctttgctgggtgagtgtttccccagccccgctgagctcaggtatcagccccagcgctctgggtaagtctgggaccatctcctacattgtctgcaaaatcctgcagaaagcctggcctgtgctggtcagcaggatgctgcgtttccttttaaacagacccaaagcagtcagcagccacagactccccagagacggagatgagaggagggacctcatgccctgaggcagccccagcctcactcccatgccctgcaggcgctgagcagcccccagatcccgggctcctttgctgccccagggtcgggcagttcttgcatcttggaccgagtgggctctgccctgctgtggcatgactgggcttcttctgtcctttttctttattttctctttgaagaacaggagttggaatttcactcaccctgccccagctggatgtgtctaggccaccgtggtcccaggctctctgcccagctgggcctcaggaccaggttttaatgccgctgcttgggtgtgccgagcgagaagggctcgccaggcagtgcagagattccaccgagcccaggccgcagcccccacctcccgccgggctgtgctcagtgtcaggaatcggctcccaagatggccgcctttcttgtaaagctgtgccaataccccaggcatctgactggtgctttccagctggcactccttttacagattccatttccctttatcctcacaactgctcagtagaacctgcaggcagggacccttattcccattttacagtcaaggaaaataaggcccagagaagttgagacagccaggaccatatggctggagacggggcaggctgggcagagcccccagcagggcccctgggtctgcgggctgctcccagcagcacccctcatatacacaccctcatcctgactgcaggcccctgaagctggcattctggttcaattttacagaggagcaaacaggctgggtctggagcgttgacactggcaactctagcccagccttgcctgactccagggcatggctccaagaccctggaagagctgcctgtccctccatggcccctccagggcgtgctgggtgctggcagggcaggctgaggcactcgacagcagagttggccccgtagtctcagttttgctcccgctagggtgaaacacggttccctggggaagggctgttgctcacctcttggcctggaacatcagggtggaatttgcagacggaattctgccatctgacgcgtagatcttccccccaggcatgggtcagtgcttgagtcattctgcagctggcacaaagagccaggaagaatgcgctccaagatgcctgggagctggcatgccaaatcaccaggcgtcatcagcacagccaagccagggtgggggcctcgggcaggagcagcgccctgccagctctggctgactgcacgaggggccacatctagagggactgatgaaggggcgtctaaagcctcagtatctccagcctgctgtgccctcttacattttctcccaaagagcagtcagcttgcagtatgcgccaagtccccgcaaatgggacgttgggtgattcacatggttgtttcagcttttgagtttttgttgtgtgattgaatagtaatagaattattcttggtgttctatggagcattaccgggtagtggggaggtgggcacactgagcctctactgtttctccccttcacccctccttgctgtcatcaacatgcgttctcctacagtcatgctccgcgctaattcctttagtcattccttccagcattactgaaactggaagagtcttttgtggcatgtggggattcctcgtcgtgcagggcttgagtgccacaggacccagtgctcgctgtccccatgccctggcacacactgttccctttgtcccagctggagaactcctggaacctttaagccctggctcagccctcagctctgtcccatcccagctgacctctgtgctctgcgcccgagctcctgagcccacgtaagtctcttcatgcccatcactgctgtttcatgggcgtgtgtggggggtcacttcaaggagccccaggaagggtctgtgtcttgtccatccacgtgtgactacacccagcatggaacaggactcgggaaccactgaggtgtgggtgaaggaaccagtccagagactccactctcacttcagcctgatgtttctggggtctgtcactgaaaaccccaacttcgccttcaaagcgagatcctgggtgggggcagaggaagtcccaggctctgtggccaggactccacacccagatttccaccgggctcgctctagcctggccctggcacgggtgctgcgtggctctgctccccgcctggcatccggcacccttcacctctgtagaaacacggaactgtcacagggacagacgtacatgggtcgggggttgctttcagaaagtctatggtctcattttggtcctgcctttgagcttccttttcctgctgggttagggttccggacggaaggggagcattctcttgggcgtttcccttttcctgtctccctgttctctccccagaggctcatgtatgtccgtttcactcacctccctttctctgcttgggaggcagctcaaagagctcctctccaaagactcaagctggagtgatgttcgctctatgatgacgccgcactggtccagggaatgatctcactggagagtagcaggaagtcccccatcctgtcccccaccccactggctgaggaccatatagctgggatgtgttcacctgggaaggagattggcaccagtttgataaatggacacccccaagtctggcatggccccaaaactctactctgctgcagctgtttccatgccagaaaacagagatttccagaataccgagtctgaatgtgccttcttggagcagcttcaaatctgagcaggagagcacttgaccatcctaacccctgaccttcctccagcaattcctaaaactggaagagtcacagaatgttagaataagagggatcctagaaaaagaaccactcactcattgctttgttcatttgctcaggcactgtgctaggcgcttggaatacacaaccattcattcaaacatatttattgactgaattgtgtgccaggccctgttttgggccctgtgggggtacagtggtgaacaaaaggaggcagacagtcaagagattttgtaaatatagtgccaggtggcaggaaatgctgagaaaggggtcagggtgagggaccagagggtgagggtggatgctctttgaggtgggtccttggaggaggtttccccacgactgttgagcaagaacatgaacttggagggagtgagccttgcagacactgaggggaaggaagagcagacaggtggagggaactgcaggtgcgaaggccctgaggctggaacacgctgagcagcttctctgactgggacaaatgaaggattctccttcccccaggagctcccagtctaatgaaggaaaaagacaaagaagtgacgcgttcaaagctgagttcatactagaaaaacgctgttagaattcaaagggaagagcagttgtaggggctgggaaaggcaagcctgaggagtgacctttgcattgggctttggtggatgagtaggggttggcagggtggctgaggcgagcgtgccacacgggtgaactcatatctgcagaggcacaaggtgtgcagggacagccacccacacattcctcttcctgtcgcagtagcagcttctgcaagagaaagtacagctcttggggatttcccttttcctttctccacctcttccttctcaccagcttcatttagggcatttcagccttgagagggtggaaaagaaggagagattggtagaggaaggggatttctgtgccctgctgggtctctctctctctctcttctcatatgttatgtttttcttgtaaggttttggggagttgtggggagtttaagaggctggggatgggtaagaagtcaagaaggtttcggttggatttctcaacaacaggtcattggcctggagcccctccagtgggtaaaatgccgtgatgcaacagctttcaggaaggcctccagaaatgagctctaggtcagtgggttgggtttaggtgcaggcacgccctggaactgtcactctagaggtgttactaacctcctctttccccggatctgactcagcagggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtaattatgaaatacaaacgccatgatctttcactcaagggcactaaggagtgaataaataaaggataccacagggtgctaatgagcttgaagagtccctgtttggtagccccagatccagggtccctggtatcacccactgaatgctacttctacccagcactgcccacgggaaataaagtgggagacacatacctatgtgattgtaactttttctatagccgcattgaaaagtaaaaaagatgaaatttaaaacttgtttgatttaaaccgttagatcccaaatggtatcatttaccatttcacatgtaatcaagaaagagaaagtattaatgagatattttatgttgttttttttcatatgaagtcgtcaaaatccggcgtgtattttacactaagggcacatatatgagttcagactggcgacggtttatgtgctcagtagccacgtgtggctggttgtgaccatagtggacaaagcagccctagcttataggtggagacacggaggcacctgagaggggcggggtctcagctcaggccctgggagcctgttcaacagctccctctagcgtcggcccagccacacttcagcctggatggtcccagatgcatcggctcctccctgcacctgggtcctggcagccggcacagcctccccgcaatcacccaggggcaaaacgggcccctccttggagaactaccgggaagctaaggctgcaggcagcttgactgtcacttgcttatttggaggaaagaaggacacaggcccgagttgttttgaaaaatgcaatcagccctaggagaggggcttagctgcaggggccgtgtgggtccagcggtcaccgggagaaagaactgggttgggtgctggataagaaagagcacaaacctgtttgtcttccaccggccccttctgccttccaccttcctgttccaccccaggaagaacaagctctcatctcaaatggcctgagccctctgattccttgaagttcaaattcacaacaaacgcctctccagcctcttcctgagcctcagtcttttttttttttttttttttttttttttttgagacagagtctcgctctgttgcccaggctggagtgcagtggcaccacctcagctcactgcaacctccaccctccgggttcaagcaattctcccgtctcaacctcccgagtagctgggactaccaggtgcgtgccaccgcacccagctaattttttatatttttagtagggacggtttcaccatgttgctcaggctggtcttgaactcctgagctcagacaatccactgccttggcctcctgaagtgctgggatgacaggtgtgagccacggcgccccggccagcctgggtctctcataagcatttggtgtttcccacctctctggtcgccttccctcaaagcatctcagagtctggttggcctggcaagcttcggggatctgactgatgaaagcattttggagcaatgggatgagatgccaaccaatgccgtcagccggcactgaggtgggattaacaggacaatcaagccctcggttcccaggagcctcactgagcagctgctagaactgtgccactaaacaggctttaatttacaggcaataccgactctgggttaactatttctcacagggctccccagctgcatgtttacatttctttccttgttcctctttttcttcttcttctttttttttttttttttttttttttacaattcagcagattaagaacaatagcagggtaactgagaaccacagaggtggctgtaagtgactcattaactccctctcccatgtttccatcaccgtgaattacaacgtcatctctgatgccctcagacagctgttactagtttgatccgagccttgcttgaatatgaatctttttaagccgagcaggagatggttctgctctcaaatagactgccctcccctgggcctcccatttcttaccccaccatcctccttggagatgaaagacttcctgagaaatgaaggctgggtttgcctaattactggagcaaggtggctgttctgctgggaaacgtgagtggtggctttctgtctctgcagaaaggcttgcttttgctcggtcgtcttactagacagccaagcaccaataaggttggctcctttgcttaatgaatgacagaggggtcacagcagcatgcagcattccccccgccccccgtttcttgtgaggcagcctgcgtcgggcccgacagcctccaggagagagctaaaatgaggtccttcagattacatatttcatctgggcccttgttaataagcaaatgctggctgtcccagtgagtgactgggagtgtgtgtgtggccgtcaccttcatttggcattcatgggctccatttaccagtttcataaaagttccagtggggaggccatcttgcaaagctgtcctggcgagcacaagcagagtgctggacaccagccaggagcaccctgggtggcctccacggctgcttatggtcttggcatggaaagggcccagaggaggttacaggacaatgggaaggaggtgggctctccactcagacctcctgggtccacagcccaccaccccaccgaagcctcggtcccttgtccctaaggtggagctgacattgcctcctctcggcctagccaggagtgaccccactttcccagctcctagaatcttcactgtgtcctcccctggatgtggcctacagggactgggcctcctgcagcctttgaaatcctccttgtcattcagttgtgattccaaatgccgttgtcctaggcaagccgccgagtgccccgggaatgagcgactcccctggaccccactttattcactttttatgccccttcctgggcatgcctacaccataactcaagccccccagggagctggtgactggggaccggcatcccagtgctcagcctgggattcggcactcagagggcccgacagcctggaatacactgagcaccccgctggcaccaggccccaaggacaggctgatgtttccacttccctggagaaagatcctccagtcccctgctcggaggctgatcccggctggctgcccgcttgctcagggcaaggaggtaggctggagagggcagacttccctcaactcacccatcttctgtgggttcctcaccagccttcctctgggcctgttgttctcctgtccagtgtctttccagagaagattcctcccccaagctttggagatggggctggggtgggggtggttacctgaccgctgagtcgcagtacagggttccatgttggtcaggggtggctaattgctgtaagaagcaagtgccaacctttgcttggcccagtgaagtggtgtttcctgatgtgttgcagtgggatgtcaccgcaggagacgaaggctctattccacgcagtcacgcaaggacttaagtttcttctttttagaaggtctttcgtctcacagcctttctcagccggggttccaggagggaatcaaggactcacagcaaaggcatcatggtgtgcagggaacgactttcctcctgcatacctggaatgaaaccagttacacaccatccttaggtacatgactggttggggaaatgggcacaccagtcattgactgcaggctgtggttcagatgagaaagcctggttgagaaatgctttagggtctatgccctctggggcctccaagtcctcccctggatagtctgcttccaggtgcccagcaagaaagggcaggaaagggcgtgtgcagcaagggctgccctgacagttatggaggctcaggccagaagtgtggtcatcactctggccacatcccattggccagagtgtagtcacatggtaccacctagctgcaagggaggctgggaaatgtagtccggctgtgtgccctggaagaaaaggcaatagagtaagaagagcacatggtctcggcacaggctctattcttgcacattccttcagactctgcctcccacacctcctgaggctctggggataccctatccctgagccttctggaattttggggccccagttgccctgtttctccttcctggcccccctccctgttcagctgtttgccatctccctgcccacttcccactgatatgtgttggggcttgtggatgtgatcaaggtcataggcacagtctttcttttctttttcttgttctccttgttggggtggggattttttcaaaaggaagcggcaaaggtattgtactatttttgggtccctacactcttctgcctccacattcttctgttgtgtttatgctgctagacctggaaccttaggatgagcaggtcttggcatcagactttgtttgcatcagcagaatcctttctttgaaagagaacagatgcagaaacagatcagagggttgctgctctggtctgtgctgggcctggaggcccagagtccttcctcctcccctgcccatcctgtggacccccaaagccttaggaaggtccctggggctcctgggacacagctcagaggctcctggctggtgtcactcctctctgtgaggcttgaattctctcccttgcattccgaaagtgggtcacactggaataccagctttgtccaaacctccctgcctctggagttagccaaaccttaaagcaggttcttgtgcatgtgtgtatacacagcaactgcaaccacagcaagagtgtccattcacccaacacagacacccaccttgtgccaggcccagctgggtcacctgggagagggtgaagggtaggaagcccttccagaggaggtgctgagtgaggcaggaggccgcaggcgcacacgtctgccctctggcacacgcaggaaggtgctgggaatgcagggagcttctccccagcagaccatgatgcactccgcctgttaccttctagcggtgtgctcactgggtttggcactgcccctaatctggtacctccctttctatacgcatctgtgatttcaggcagataagtgttatgagtttggcattccaatgggatcggtaagaacataaatcaccgatccatcctgggataaatttctcccttcgttctgagaggtgatttggttttcactgaggtgagtggattcttaaggcagtgatcctcaactcccagggcctagaacttcacagaaggtggctcattttgataatgaaaaatgcaggggtgcaaatcaggcagaaagggcctgccactagccaacaatgtgtccatcaccatgtcgcccttgcctgggccagcctcccctctgctgcccatgcaaggcctggggaggaggccagaccgcctgggtccaagccctggctttgcctctcagaggttccggggctctcccagggttggtttacttgtggtgaagcgtgactaataggtaaagtatctgacaaaatgggccccacaggccatggttgctgcttctggctgtccctgctgagagcaggtgtaacgtacctggcatcactcctgccccagagacaccgataacacatgtttgtcagctgtaggtcagttccccaagggtggctgctgtgctactgtaacacgggactgcagactgggcacttaaactacagaactctgttttctcacggtctggaggccagaagtccaaggtgttggcagggttgggtgttggcagggttgggtgttggcagggttgtttcctccagaggcccctctcctagaattgcagatggctgtcattttgctgtgccttcacacggtttcccctgtgtgtctgtgtcctcatctcctcttcttataaggacaccagtcatattggattagggcccaccctggtgacctcattttaacctaatgacctctttaaagactgtgtttccaagtacagtcccattctgagggacctggggttaggactttaacatgggaatttgggggaagcacagttgaggccatagcagcagctgtctcattctgctcacagctggttctctctggccacgtgccagagaggagtacgatgccatccccttaaaccacacacggacatgctgccaggaggaacgtcatcacctttcagctgaaaggagtgaggaatgaggacaagcaggtgcagaacacagccttctcacgtactggtccattctgcacgtgcgctgctgctgttacagcggcagacgggaggctgaactagagacacctaagacaaaccctgctttcccctccagatgctggctgcaagaacgccacagtttgagaggagtgtggacaatagaaagccttgagagcagctgagctgacgaagggatgggaaaatgggcccttttgaagcctaggaatgaccaagtggagatgtgcagggtttgggggtgccccagcttgagtctcagtgctctgagggacatagcgcagagtgggacagcccggtgggtcaacccctgcctggttctgcagacttggagaggtgggacttctgccccaggccgcatggagggccggccctgggctgggtgtgcctcacgctgcctgggagcctcaggcaacctgctgcagctgcttgttttgccactcactggcctgactgcgggagctggaggggctgggaggtcattccctactccacagcttagctcaacctcccaggtgccccgcacccccatccctcccttcccataaaaccagttattcctcatcctcataagcgctcctaggacacttgccatgttctatcagtttgggggttctctggggcagccatccacagatccatgccccgcctatgagccatctcccctctccttctcacccccgtgctccccgtgtggtgtcggcccccgaggcaaggaccgtatgggttttgttcactgcccacactccctctgacacacaggaagttctggaaaagcttccgcatggtgaaggagccacatgcggtttggtcgggtgccccaggcctcctcttgatcatcacgaccaccctgccatccctgttattcggggggagtccagagctccaggaagttgaccacctccccaaggtcccccgagcaggggtgggtggaactggctctgagcccacactcaatgcctttcccctgtgccccggagcctggcttggtgccacccaggacttgtttgtggaagtgacatgtgaacacctagcgagctccatgggctctgcgtgtgtacgtctttgctgactcagtggccccacacagcaacccgagggccagggcagaaagcacaggaggagccaccacgggtgctgcagggcctcaggctgggcatccatcctctacctgtccttctgccgtccatctgtgggttctccctcaggtgccacgcaaggctggtccttcacaatggcccaggccctcaaactcagtggtcaggagggttcccaccacctcagggcttagcggcagtcaaggtaacctcaggtcctcaggctacctttgcaaataggtccttgcaaagaccctaattcacattcacagatactgggagttaggacttcaacatcttttaggcgggccatgattcaacccatgcatctgggcctaggaagtggaactgccccagtgagcgatgccctgggcactgtgcagttctgggggacacagccctgacagccggaggggggctttctgggcacagagctgtctgggatccgccaaggcaacacaggaaggagtccagagctcacctgggtgagacccgagagctgtcagtgacagcagaatccagagggagcccacatctccaagccaggtccagagctcttccaacaggatagcagtcttgtcaggcactctgggaggccaaagtgggaggatcactttggggccaggagttcgagcaacctgggcaacatagcaagatccctatctctacaaacaaaccaaaaacctcagtagcatctttgttgttttttctcttctgtcaggtattttggtagtagtgatcttctgattttacattccctttttttttttttccatgtagaaatctctatggccatttcctcttgtgaattaattgagtttctaaagtgaactagctgcatgttagaaccaggacttttttgagccctttagagcatgctggcaggcgtcatccccaagccccagggtgggtcatatttctggatgatggaggcagggggtgcaggggtcccctatctgcacattgttctgagtctgatgtgattcctcaactcctccatgaaacaggggccatgcttgtcctcgtctggggcaaactgcagttggagaggctggcctcctgtggctgcatatccagagctgggcttaactggccaggaggagagaagaatcctctctcttaataaaaagtccccaggggctgggcacagtggctcacacctgtaatcccagcacattgggaggctgaggcaggtggatcacctgaagtcaggagttcgagaccaggttggccaacatggtgaaaccccatctctactaaaaatacaaaaattagctgggcatggtggtgcatacctgtaattccagctacttgggaggctgaggcacaagaatcgcttgaacccaggaggcggaggttgcagtgagctgagatcgctccattgcactccaacctgggtgacaagagcgaaactccctctcaaaaaaaaacaaaaaaaaaagtccccagggcccatgtccacccagccgtctctctccctcccggccaatgttattctttcctcataagcccttccagagcacaaacacacaagcacgtatgtttgtcttcttttctcataaatggtaacaagctctgcttgctgttgtgcagcttctcttttcacataaaaatacaccttgaagattatttcttatgagtacgtaagatgggcacctgagtagtttgctgttacagaccacgtaggcaatggccacctgcacagattatttgcacaggtgggagtatcattagatgtttctggaagtgggatggctgggtcaaggtgaatgtgtgtttggaattttgaaagataaagtcataaagataagtaaaaacacctggcatcttggctcacggctgtagtcccaacacattgggaggtcaaggtgggaggactgcttgaagctaggagcttgagactggcctgggcaaaatagtgaggccctgtttctacaaaaaaaaaaaaaattaactgggtgtggtggtgtgtgcccatagtctcagctactcaggagactgaggtgggaggatcacttgagcaccggaggtcaaggcttcagtgagtcatgatcacacactgcagcctgggtgacagagtgagagcctgtctcaaaaaataaataaataaaaaatagatagatagattgattgattgatatagagaggataagtaaaaacaaaaacatgtatgtactataaaacctgggatgggctgggcgtggtggcttatgcctatactcctaacactttgagaggccaaggcaggcgaatcacttgaggtcaggagtttgagaccaacctggccaacatagtgtgaaaccctgtctctactaaaaatacataaataaataaataaataaatagccaggtgtggtggtgcatgcctataatcctagctactcaggaggctgagttgggaggattgcttgaacccaggaggtggaggttgcagtgagccgagatcacaccactgcacactcctcataagtgcctggaagggcaacacagtgagactccatctcaaaaaaaaaaaaaaaaaaaaaaaaacaaccctgggatagaggcagagaagaaaggaagtggtgggcagtgtgggtggtctgtcttacctttcataatggagagctggtgcctactgtttagaattcacaaacacagagttcaaagtggttgccactgtggctagggtaggagacatctttttatttctcattcttccatgtacttcaaaaattatcacgccctgtatatcagttaactgttaatgtaagaaaataacatgaggtggtgcagtggcagccgtgtgaatgccggttgatcagtcttgcattcaggacttgtggagaaccgccctgggggatggttttgagcagagcagttcctcgttcccacaggtgcctcatttttccctggttccattcagaacatcatttactgcctagagctaattccagatcctcctcccacccggggcagtttatcaaaggcaaaataaagagggtgggccggggacagtggctcacacctgtaatcccagcaccttgggaggccgaggcaggtggatcacctgaggtctggagttcgagaccagcctggccaacatggtgaaaccctgtctctactaaaaatacaaaaaattagctgggcgcggtggtgcatgcctgtaatcccagctactcaggaggctgaggcaggagaattgcttgaacctgggaggcggaggttacagtgagctgtgatcctgctactgcactgcagcctgggcgacaagagcaaaactccatctcaaaagaaacaaacaaataaacaaataaagaaggtgggtgggggtgactccctgaaagtttctagacgcctcttctaaagataaaaacataatgtgatgcctgaaagagggaagaactgccccaaagagtctgggatgtggctgaggtggccactttgccaggagctgatgagggggatgaaagtaagaactgattttaatcttcgcctctcgtacaacccctggtgggcaccggatgatgccctgttccactgattttaagttgcattttcccccccgcatttccacattctccaagtgagaacgtgtcccgcagtgtgagggtgagctgtcgtgatataattagagtctcttggccttcttggtggtccataagatagcggcatgccttccgatgggggacccgggagttgctgagtcgcagcgcttgcacagcgatgggcttatttggtctctccggcacatggctcagccctgctccgtggccgtgggtggcgtccccggctgaccccctgtcttgcaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggtaccggcgcccgaggccccgggtctcaccgcgggcccaggtcccctcccagctcccagcccccagcccagggcttttttttttttttttttttttaagacaggaatcttgctctagtgactggagtgcagtggcactatctcagctcactgcaacctctgcctcctgggctcaggtgatttttccgcttcagcctcttgagcacctccatgccctgttaatttttttggtatttttgatggtagagagagggttttgccacattatccaggctggtcttgaactcctaggctcaagcgatctgcccgcctcagcctcccagagtgctagaatgacaggtgtgagccaccgtgcctggcctccctgtgttctttatgttcactcgacattgggtctttcttggccaggttgctacctggtgcactttggaaagtgagcagttgtcacctgattgggcagacccttgcaaagggcaatggtaaaagccaatgtttattgatcacttgctatacatcagggccgggtggagcactttgatccgttttcatcttcataacccaacaacgtgggtcattctctgcattttacaaagtctgagactcaaatagatgaatttctaaaaattatattttatatatatttggagatggagtctcactttgtcgcccaggctggagtgcagtggcatgatctcggctcactgcaacctccacctcctgggttcaagagattctcctgtctcagcctcccatgtagctgggattacaggtatgtgccaccgcagccagctaatttttgtatttttagtagagacgaggtttcaccatgttggccaggctagtcttaaactcctcacctcagttgatctgccttcagcctcccaaagtgctaggattacaggcatgggccaccgtgcctggccaagaattgtatgattgctgggctccttggcacttgcaagaggtacctgccaagacctggggaaagccctggatttgagaactcaacagatagcttgtgatgtccccaggaatgcgcagtcatcaagtaaaactgaagcattaacgatcacgagaatcagctcagcacgggaaagacgtcactttaggaggcatctcttcaccttcatgcctatcaacagctctagcagaaaggccatgtttcagaaggaaaccaagttttgttcacttggccaggtgcctaggtatgcgagagagagtagagagcagagctgcccctccctggcattcccctgagtgcctccctgagcccaggagcatccaattctagaactcatggccaggcctgtaatcccaacactttgggtggccgaggctggaggatcgcgtgagcccgggagtttgagaccagcctgggcaatatagtgagactccatctctataaaaaattaaaagagtagcagggcatagtggcatgcacctgtagtcccagctacttgggaggctgagatgggaggattgcttgagcccaggagttcaaggtgacagtgagctgtgattgcactgctgcattccagcctgggtgacagagtgagaccctgcctccaaaaagaccaaaagcaaaataagaaaaaaatggaactcttcagaaggggtggtcccatggtagggaacttcaggggtgggcctccagtagcgggtatcaaatccgtgaacttctgcagcagcagtggcccgcctcaggaatgagcgacccatttcccacgtagatggttttcacactgtcagagtaaattaacatgggctcggggaactctggtactgtcgtcactttctggctcttagcttcatgcagtggcggaagtaagaattctattccccaggaatcacccgtcctgtcctgtgtgttaacccttaccctttgcaaataggtgtgcctgtcactggccgtgcagaggcttggtcagaacatcaaggcactggtagaactgttccaagcagtgaggagcagccacttctgtccaaacgggacagcccccaaaccaagtccccaaaccctgaaagccttcccccgacgccatcgatggctccctggccggctgggtggtgtttctcatgggacacttggttgctacctctttctcacaatgagaaaatggtctgttgtcaggaatgagaatatcaagccaccttcacgtggagtgctcagaaaatcccacagcagtgccaccactccccacgcatgtcactctgctcagtggccactcaccagtcccatcaccgtctcctctgtacacccaccagcagcacagagtcacatgccccaggctgggccactcaggcagagacacgcagagagaccagtggctagactgagccctcggctgacagtgccctaaacaggccatggagaccccagtgctgctgcttcctgtcctgtcggggctggtgatggggcttgccctgtgagtttcagggactcagtctcttttaaactgaggggtaacagccatggagtaaaatgcacacagctcagcaggcagtgtggggaatttcacacatctgtgaccaccactctccctcagcattcccagcccccgacagggacacttaggcaccttcctggcactacccacccccaggcagagataccagcaccctcaccaccctcccagtagaacccttctgccagctctgctcttgaacttcacatagacacccgtgaggttcactagggaacattctccccactggggaagggtcccgaaggccaccgggagcccctgacctctccgagccttgttgtgggctgggcggaagcccacccttgctgcacccgcccaagcccccgggcctctgagcacagtgtcattgcccccatccgcaggccatctacaagatggtgtcgtctgtgatgaagatgccggaggatgagtccaccccggagaagcgcacagacaagatcttcaggcagatggacaccaacaatgacggtagtgcggggtgggggcggggctgcatgtgtacgccacggtaggggcaaaaccatgtggtttggggcaccccctcccctctgcagcttcttggtctcctgagggccacccccgcccgccacctgcctggcgcctgccatgcccagggaagagcgggatgcagtcagggacacccgtgctgtatcctggctcctctgtgcagctttgtgatgctgggcatgttgtggcctctctgagccactgtctccccacttatagaatcgggcatacccatattcccgtgggtacaatgtttaggggcagggaggcaagcatgctggtggccctgaacctggaggggttgagatcaaaggatcccagatgttggggtcctggggtgctggccatgcctctcttgctgccatcctgagagaagaagctgcccagatggccccagtgtccaaggggaactgtcaggatgtacgctgccaccttgtccacctacagcagctctgtggagactcagccccactgcagaagtgcaagtctcacgatggtgggtggcagcagtggtgacagggctgtgcctcgagtgccctcctctgcattggctgtgaggtgagggcggctgtgcggccctcccattctgctcttcttgccggctttgtcaagagcagccacagcaccaggtttgctttgcttttgagcaataaagaaacacgaccttaagaagagaaaatacaggctgggcgcagtggctcacgcctgtaatcccagcactttgggaggccgaggtgggcagatcacgaggtcaggagatcgagaccatcctggctaacacggtgaaaccccgtctctgctaaaaatacaaaaaaattagccaggcgtggtggcgggcgcctgtagtcccagctactcgggaggctgaggcaggagaatggtgtgaacccgggaggcagagcttgcagtgagccgagatcgcaccactgcactccagcctgggcgatagagtgagactccatctcaaaaaaataaagaggaaatactccctgggttgtgctggggattaaacgataagctaatgcccaagaagctgctctgcgaagtctggagtgcagccctcgggtgagttaagcatggccccagcgggagacgggatgtgggggagctgtaagcagcaaagagcattccaggcagccaggtcacagtttcaaaacacacacacacagaaaacaaggctgcctggtgcctggcgttgcctttgggctgatgggaaatgtgtgttccaccctccagcctagcagggcacctgctgccgctctcctgaggctgtccgctcctcgtggggatggtgaatccggtcccatggggttgtgaggtttcagcgagatgatgccttaaagcttttagcagggcttgcactccacaaataatggctgttgttcccaacttcacagtgtccctggggaagccacccatggtcactcgctgcccgaatctgcctcctggcttggccctgcccacctcttcagagggcatcttctaggttggttgggaatttggatggcatggtcgttgctaatgtgcctgctgggatggagcacttcctcctgtgagcccaggggacccgcctgtccctggagcttggggcaaggagggaagagtgataccaggaaggtggggctgcagccaggggccagagtcagttcagggagtggtcctcggccctcaaagctcctccggggactgctcaggagtgatggtgccctggagtttgccccaacttccctggccaccctggaaggtgcctggctgctccaggcctctaggctgggctgatgggtttctccaggacacaagtatcattaaagccaccctctcctcagcttgtcaggccgcacatgtgggacaggctgtgctcagcaaccccctcgcctgccctgccctccatcaggaggagccagtggaaccttcggaagctcccagcatctcagcagccctcagagtcgtcctggggcagctctggttctcctgactggaggtccatctgggctggcctgctctctctcggcctgagacaggagggcctggggtcaggaactggaagtggggaggctggggccgtggactctgaggccccacacctagccaaggagatgaccacacagctggctgccctgagtggtcagaggtggagggtggggagccactctctccattggcagaggttcctggggactgtctgctgagggcctggctgtccctccctctccctacccaccccttagcccgggcattgtttgggctctcttggggccagcaggctgcccaggccccagaggcatcaagttcgtgccctggaagaagccagcctgcccaagcctgggccagagtcccatgaggacaggtgtccctgcctgccagtgggctggaggggctgaattcccagcagggccctactgtgcaggggcatcctccgtcctggtgctggtctgagtcctcaaatgcatcctcccaggtgcctttgagatgggtgttcccattatcccaccttcgagacgaagatcctgagacctggaaacgttggtggcttgccatgcgccagagccgagagcccctcctgcatgccttcccctgtgctgggcctggctgcatgcgtctgtgttgcctgcacagacattttgcagggtgccctagtgattccagctgacagcacagagcctcaaacagacacatggaggggctgccccaggaccaggccgccaggacgcagccaacctcaaacctcatccttccccaccagctggagccagagggaccgcctcctgcccttgaggccatgtctgaacgggcagaatccttacagcctatcctgcttgtggactagcagagccagggctatagtgaccacagtgtgagctcattgacagcggttatgggatggggagcggagggtcagaaaacctcaccccacccagctcagccgatcagccttacggagccctgccctaggccacgagcctccagaggccactcagcccagtgtggagtcaccgagtctgtgtcctgggagagggaatatgttgtcaccagcattggatgcggaggatgagggggcagctgattccttagcacgaccaatctttttctaggttttcctctcaccgcatggggccaaaacagtacagagcatgagtttggtaccccaagcctgagcagcgggtctacgctgatgccagggaggatccggaccgtgcttccgggggcccccaaccagcatggccttctcagcctggattctgtatgggttagaggcaaatgcttcatttttctgcacagtgtacacgttccttaataagcgaagtgtggggtgatttctaaaaggatttaaatggccctcatcagccacgtcctgctgagcttgctgggtaagccctttgaggtacctgatgtattgcagggagcagggaaaggaaaaaggattttttttcagaaatgcctgtaaagtgaatggagactagacaccgtccagcttcaagaaggctcaggactttcaacaaagggagcatacctgacctgagagctgtccccatcctctctggaagcataaagaacagtgagcactggctaatcccattgtctctggtcccctgcaggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccagcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcattttctga

SEQ ID NO: 1754 - DNA, 65535 bp, Homo sapiens
ttcattcatttttgagtctactttatttacagttatttatcctttcttgaaaacttttagcatcgccttgattaaaataagttcataaaataatcttcactgtatttgttacatatggcacagaataatttagcactttataaatatgtctcattgatgcacaaatgggaggagcaccctttgctgaaagcagtacagtgacttagttcaatttggctacggtagcactttaaaaaattaccatgagatggcgctgtggccaagtaaatgcagtatgctttaaacagttttccctaattatggcagttaattgcttttttttgaatatagaggaatctatcattcaacttaaagtagagcaaggtttgttactccgttttaatagtattcattaaaagtgaatcctttaatcacagatccataaatcatttgacaactgtgtttcacttaggtgtgagtctgtttaaaaagccatagtagtcagaaaattgccagactaaacaaagggcccaaaggtaccattttatttaggatcaagaaactatatatgtggaccattgttttcgccatcctcatagacttgtcttaaagttcttccacaaaattagattaatttccagtttatttaaagagctgatatttttgttacactttaatctgctttgcagcaatggaaggtcatagaaatattagaacatgaattcacatttaaataaacatgatacaaacatgcacacatgtgtatatactgagtgttttcattgacttgcttttcgtccatataaatatataaatattgaataaagtgcatgagaacatgtctgtacatatatacagctacacatttgcctatacagtatacacttgaatagatacttatggaagaaaaaaacacatacacatttgtaatatataggtagtcaaaagacatctatcaggcaacattaatgtacattctgatcaagattgagtatatgggggtagaatctgtaatcttttccctaatatataatgaaatgtgcagagttacaagtgaaggcaaaatacattagagtggagacattttaacatttatattttcatcagttagtatggtatatcataaggagtagttcagttcaaatgcagccttggtactagcagcatattatacattctatctttgaaacagtgaaccatctttcaacatatctatgaggacataatgagaattttatgcatttccaaattacacaatgacacttcccacattctttagttttcaaatctgtatttttttcccaaaggtttagggcaaacactatttctcattcaatagaaatgcttcagcattgtaatcatatatataacattgattctaataacaacatgcaatttaaccttgagtgttataatatcaaggtggattaactgttgttaatctctttttctctttagtaaccatttcaatgaaatattataatatctgcttttctattagggagcccagtgtcaatgagtaatactgaaatgagtgagtttttggagaaatagaagaaaaattttgctcaaaactatggtagttataaactggcttgagattgaggtgcgtatttctaaattaattgcaatgttaagcctcaagtgatattttccccctcctttatttgtttggtgtttattggtaaccaatcaggaaaacttatttttaaaactactctcacagttgaaacaaacttgtttctgaaccaggtaagaaggaaataagttgaaatgattctaaaaataagtctgtatatattttttgactaagaccatttcagtttagtcattttctttttttctttctttttttttgtgatagggtctcactctgttgcccaggaggaaatggcagtggtgtgaacttggctcactgcagccttgagcttctgggctcaagtgatccttgcgtctcagcctcccctgtagctgggaccacagttgtgtgccacaaggatcagataattttttgattttttttgtagagacagggaggtctcactttgttacccaggttggtctcaaactcttggcctcaagtgatcctcccatctcagcctcccaaagtgctaggattacatgcacgagcctccgtgcctggccgagccatttcgtttgaaggcaaggattttgttttaattatttttatatttctcatatctagaaatttgcttcacacataaatgtacactcaatagatgattgtggaaccaagcagaatggttttaataaatagtataaaccgatggatctgaaagcatcagtttacctgatgagtgtcataggaaagtcacctgctttttacagagatgtcctaggactctaccactgtcagtagccggaaacctgagttcatcctcaatcctgacacagttacatcaatatacatttactgctcaaaagagtgcatgcatgatgcagtcatttcacagcaagttaccaaatacctcgatagtgctgttttagagaagcaattgctagaaaggcatttggtaatgttaaatcatccttttgctagtttacctagaggaacaaatattaaacaagaccacactggaaattcagagtaaagcacaagaagtagaagagaaagcagcaatagttattgaataacatttgaagtctttttcacttctgagaattaacttgaaatgcagcaaatgccagcaaccttgtgaatatttcaaaatggtatctatgaaaaagcaggaatgaaaaatgttgtcaagtatttcatttaattatcttagcaatacagattttataacactgaccttagtggctttttttttctcctttcaaaatatataccatagtaagttttaaagataatttttaagaggccattatattcaataaaattttcactatttatagctatttttatttacagcaataggtaaccaactcaatcccatgtcatcaatgaacagcatagcagcaaggtttccacttgaaaatagaagttaatttagatttacttagggcttcataattatacaataaaagtgaatcattttaaagacatatcatttacaatgttataaataagtatcagaaagctcacagctgaaatgctgtcagaacattttccaagcacacattttgtagcattgaaccccgcttttcattgacagaataaaatgaggcatacagatatgatcgttggttccactagacttgtctaattttttccaatctcatatttttttttttccagataggtgaaaacttgctcagtgtgccttccacagttgccacggcaactagcctatcacacacagctcaccttttcattcactccgtcgctattgtctttagaagcctcttcagaatgctgctttcctagagcaaccattgagcagtcattatctgttgtcttggcatcttgctttgaattctttttttgtcccatttgaagttggctagacttgtaggccaaagccggtattgtgttcactaaaattaactgcaatggttttttgttttccttgtactgacactgaatataccgtgaaaaggctgacctataggtcttgttgaacagtgtgtagactagtgggttgactgctgaagagagataaccgatccaaacaaacacattgagcagggccccaatgacatcctcattgcaggactctttgcagatgacggccatgatgtttgtgatgaagaaagggcaccacatcaccacaaacaggaagaagacgatgcccagcaccttgcatgccttttgctcattgctgatggactgcatagtcctcctgcctgtgtaggaccctggctccctatggatcgaccgctggaagagcttttctgaagacaaagaactctgagggaggaagctgaaagaagctaatttggcccgtgtgccaagatcacttacacacaaagtagcttctttctggagtgacttgatagttagaaagtaggtgatcaccatgatggttaagggaatgaaaaatgacacaaaagagccgatcaggacaaagttatcatcggcgagtaagcaactcccctccttaaagaccttcgaatcgtcctgtagcccaaagactggtattggcatggatatacctggagttgaacagaaaatgaaacatgattattaaggaattaagtatatgaaggcaagagcatcatcacataatattggctattgaaaagattttatatcatcgtttaaaagcttaacatactttgagaatttaaaattcctttggacttacatatgtgttttgtaagtatatattatgtagttacttgtatgttatattgccctatatagctaacccttataaagaagtataataaatctagctttattttttatgccacatttttctgattataatattatacttattaattgaagaaacacacagagaggcaaataaactaaaaattgtccaataacgtcaccatctagagatagccacaattaacaactgatgctgttcattttatttatttatatatttatttatttttgtctatgaaaatctagaatatagatttgtttctttttttgatgctgttcattttagatacattcacacacttaccatgtgcacacattttaaaacagaattgaggttctttttcacaaatagttctgtatcttttttaaaaaatctaataatatgtcacaagcatggcttatatataaaaataactataaaattttaaatatagtttattttctctctagaaaatttgggaggtacaaaaatgtaacaatgaataaagaaaaataatatgtattctcaccagtcaggggcaaccataatttacatttgcatcatttcttcttccacttacatgtacatataaaagcaaatgtgtatatgcagtactttacatgcagtactttgtaccttatatgttttagatcttcctattccatttaacattataaatcatgataattgcacataaaatatttttgagaaatacaattttctaatattaatttaaaataaccaattttaattctttttaaaaaagcttttattatgggacatttttaacatacacacaactaacaaaccaaaaaccaaacccagtacagtgaactcgtcacccagcttcaaagattatcagctcaagcccaatcttgtttcatccatatgtcctctggctgccatccctcccatgttattatgaagcaaatcctagacatcatgtcattcaatctgaaaatatttattacgtagatctaaaagccatgcactcttagacaaacctaatattttcacaataccattctcactcctaaatagaagtttaatatttccttaatattaaatgtagagttagtgttcaaatttccaattgtcccataaaggttgttctatgtttttagtagtagagcattcataaggatggattgcaaaaaacaagacagccatagactttttattgacaaatataaaaagtaggtataggatgagataatacaggggaacatgggcctatatggttcattgctccatcacccagatttgggggatctgtaaggctccctcaggtacagggattaggcagaggaggaagcagaagtgaataaaggcaacccctggcctctaatcatgctatgtgccccacttgatgataggacctttttaaaggaagattcaactggccatgttgtgcagtttcaccacccagcccccaccatggacaacctctctgctcctggggaaataggtgtatctttctctactggcctgggatggttggtccaaggcaatcatgagatggcttattctctctgccataaaggtagaatcaggatgataaaaaagagaggaaacatgaatcaagtactctgtataacttagtttaagattgtttctttcatgaaatggtagatattgcagggacagcctgggagaaaaagtcagaaaaatagttcccttctaactcctgcccatattatcagcacactcagaattgtagaacaaagagtgttgtggttactgcttctgaccgtctttagagtctaatacatggtctcacaccagccaagaacaccggtttattccagaattgggggccactgcctcactcttgccatccatctggaaaaaggtttttggagaatctctaatctaacttctgcatactcagaacagagttccgcttcatccaagcacaggcatgactgtcctaacctcatgtcacctcacattggccatcgtggccaggaaagaacgctgagttgatgtaatattcaacacaaatctttcttagtgacatttgccattatcttcaaagacttaattaacaatatttgtcacttgcctatgcaagcccatccaggattcttggaaggtggagataaatgacatcagagctgttcataaggacacttattgtggctaatgactcttcatttcctccatccctctctgttcctggcccattgtttgcaacattcaagaagagattgatgagctgtgcctccaaggagaacatcctctgagaccctggatattgaccagttttgcttatccttcggaaaactcttgattgtaaaagtaagggcatgatttctaagaagagtgtttttctcccagtgtttgaatctagatctgtgaaagatatttcctgtactcatgtacaaggtcttcttagacagcacagttgctcattgattagaaaggatgctttgttcaaccatttgagacatccctggatttgagtcttggctgtggctctgggctcctgaattggttacttcattcctatagtccccacttcttcatctatcgtgggaggctggcaccaacataccttcatgcatttggtgaggataaaatggatcaaatttgcagagcacctagcacagcacccagtccatagtgatgttctaccagtggtcaataaacatgagagtagctttctctgcagaactatttatattaaatatatcaacattattttattctaatccattttgcttagtttgtatacactagattttatatagcagatctttttaaaccaaaagagactaaaaagacttttggctattggccgtagagttaacactgatgtaattttagcttctgccagggtgacgccgggtcttaatcaattttaattttgtgcagctagaactgttgattactttcctaatgtgatgaattacagcattactattagtcatgatacacagaaacaagatatcaaccgtccaaaaaaggtgtgtgattttgttattaaactcttgagtgttctttttctaattaatacaaaggaagtaactaccttgagagccttttgccctatttgcttataacctagtaatgtacataagtggcaattctcaattaaccagaatgtgggcttacctaaaatgccaaattctttaattatttggaatagtgtctttggttggacacacacatacacacacacacacacacacacacacacacacccttacagaatagcccagtttctgagaggggtgatggagtcatctgcactgaaatagagaatccctctcttaaatgcccgggataaaaagccactctacaagaggatgtggtaagaggttacacgcagagctgttctgtctggaagggggatattaatttggaagtggagaatcaagctgatcagttatttaaatggcctattcatctttacatataacaaaaacatcctgaatactatcgtataccattctttttccatgcctcactcatagtatctggtcagcaagggttgtagaaagaataaccagaaagttaaagtaatactctataaagaggagaggaaattttatgtcaaaaaacttagaacacatagataggctttgtgggtacaatcagcagctcaaaagcatgtgcctctaccaagagagatgaagacatgggctgatatccaatatcgtggtcacagccatctctagggcattaattatctggctgctttgtttgacaatagctgcttttggagacctgacatctcctctcacttgaaatttctgcatataaagcattttcctttatgaacaaaacagacagtaacctgaattacatgactctgcattttgtttaatatattttttctgaagagtggaaaacagcagtcaaaattcactatcagtattagatcctctatgtagcattttattcatttccattgaaactcagacaataaaatgaatgggaaaccttgacacctaagaacacaaaagctttggttggtgtctttctttcagcatggctctgcttacttcctgcacataaactttgcacctctagttaacatcttaccacaggctgcatcaataattcactttgaaccgctggctgtgaaggactggctttattcttaatcttggactttttctgagacagtgtacatttcttgggaaataagaagattgccttcctagataaccattctcttgtagggaacaggacagtggcagtccctagggccctcagctggaaaggaggtggagggcagagaagttatttcggggctcttgtgaaaaagattgaaatttgggttcataggtttctgtttccccaaactgctaccttttctttgaattttaatgcatgctgtatttttcaagttataagaacaaatttactagtagtttgacagaagacaccactggtaaacactgcaggataatcctcatattacagggaaagaagaattgaatatatagggcaactgccaatgggactcactatcctgatacagagtggctaaattccttctaatctatgtatggtgtgttgacaaggcagatgtacataaaaatgagagctacacaaacatgtcagttacccaaaagctgtatgtttctttttctcagattaattccaaatagctctgataataaattgcaacttttcaaggtattatcacacatatttgtttattcactctaaattgatttttacaaaattgttaaaacattacccacaccttcttatggggcagatgaaaatctcactttacagatatgaaaacttgggcctaccaagcttaagtaatttagttagaatcacacagaaagttgggggcaaaatcaagacctctactcagggttcttaattcttatggtggatttttaaaaactgcttatttgttcctttgaaggtagttacaaaagtctatgactacctctgaggtttttaacattggcttcaggaagtctatgataatcctaaaatctgaaaaatttgtatatatgtatatttccttggagatagatctttccttagatgggcagaaaaattctagcccctaatatgactaataagcactaaattacaccaattgatatggtttcattctgtgtctccacccaaatctcatcttgaattgtaatcctcataatccccacatgtcgggacagggacctggtgggaggtgattggatcatggggaggtttctcccatgctgttctcgtgatagtgagagttctcacgagatctgatggttttatgtgtttgacagttcctccttcccacgctctctctcacctgccaccatgtaagatgcacctgcttccctttctggcatgatcgtaagtttcctgaggcctccccagccatgtggaactgtgagtcaattaaacctctttcctttataaattacccagtcttgggcatttctttatagcagtgtgagaacagactaatacgccgatgttgcatgtacagcacaaactctctctctctctccaccacccccaccagtgattttctgtaccttgattttgtttttgcattctttcatctcaaagccacaagttcctctagccagacattaaattcattgaggccagaaaaatagttcaaaaataaaatccttataatcaacatttagtttctttcaaatactagggaagttattctcaactgtagctgcacattagaatcactgagggagttttaaaagttacattgcctgagcctcattctcgggggttctgatgttagtactttaaaaaatataaatgcccaggcactacataaacatgaaaacaacaaccactccagggatctctgtaagcagttgtgcactgcagaagctggtggcctaattgcccccatcatagattccttataaagtggtctctgtctcctctgaccctccttccttttcttttccatttcatagcctagaggttgtgcttcaatataaagatcttgcactgaaaggcgaagagattgaattctggcttgtagatggggcttgtcagccgtcactgcaacacttaagaacccatccacatctctcttgtctcagagaagattgactttcatctaccatttcagcccccagacaatatattacaaaacccaaagagaatctgaaccatataatataatttgaataaataaccagagccttgttttgttgttggaatcacaagtaataaggcaacttctgctgatcactatgttagttagcttaatttcatcattctacattgtaggcatcgaccaaaatatcacatttgtacgtcatcaatgatacaattatgattcacaaatgaaaaataatattaataataaaaataaaactcttcaatgccacagaaagttgggggcaaaatcaagacctgcctccttcttttttaatgagtggatattacactatctacccctagcaggtgctcttttctaggctgcatatttagcaacgtgctcatgagtaaagatttatttagaaaaaaaactcatctctgtcctacattattgggccccatcttgaaagtattgtatcctttctcccatttctatcaagggggcagattttggagtgattctctctgaaagcttggagaatgagtcttacatgtgacatgtctcatttcagagactctggtctagaaggtgtggggagaaacagccatggtgtctggaaagctagattgcggcaggtgcgcacataatctagacccacaacagtcagttctctttcctccagcctcgcttgtatgcagcatcctaaagcaccttttccatcatattacacaagagcctatagtgtccctaacactcgagcaattaccagctactcagcccaccctacagggtctttgtaatctgattttaacataattattcaactttctcaatagtcatatggtgttctctctctgttgctctcttctttatgttatgtcttgaactattcaggaggatattacccatagcaagatttttcaaccagtcacagagtgtgatttaaggagcccccaagtcctgcctcctctcatatatgtcttctctcagtagcttgcttggtatacagtagtcctcccttaagcttgctttccctttccatagcttcggttacccagtcaaccacagtccgaaaatattaaatggaaaatgccagaaataaacaattcgtaagttttacattgttaactgttctgagtagtgtgataaaatcttgtgttgtcctactccaccccacctgggatgtaagccatcccttggtacagtggatccatgctgcagatgctctgtgcccataagtcacttagtagccatttcagcagatcaactattgtgggatcacaatgcttgtgttcaagaaacccttattttacccaagaatggccccaaagtgcaagagtagtgaggttggcatattgttataattgttctattttattattaatgattgttagtctcttactgtgtctaatctataaaataactttatcacaggtatgtgcacatagaaaaaacatagtatatatagggttcagtacaatccacagtgtctggcatccactaggggtcttggaatgtgagccccaagggtaaggggaaactattgtactgcagtgtctctctgttagagtgagaggtccattctgtgtacctataataccctggagggttgactattaacctaagttcatggtgcagcagcacaaagacgcatagtagggaggactcctgagggcataggccttggaaaggaaggttgccctaggagggaagacatacaagattgctcagggatgcaggtctgagggaggtatggtggctgtgccatgctgggctgttcgttaaagcccagagcaccatggggaaggggcaatctaaacggctactgggaggtacagagacttacttttcatttttgccctggaccaattttgatgactttcctttccctgaaatgctacaccaatgagtaggggctccaggatttctatgtagcaggggcttaggagtggcggctggagggcatgggggaatgaggcaacctgtcttgaggctacatttgcatacaaaacacattattgtactttaactgtacaattatttgggagtgctttgggaatctgcagatggagatcatgtttccaaaccacaccctacaatttttttcaaaacgtatctcaaggcacatccgctatatgaaaccttccccaaattaattctctctataataagaactatttttcttactcaatattccttcaacacctccataaataaattatactgtgctagttcacactttcaatatcttagaatttttctctagacatgtcattatattcatgagatgacaatctcattaatagcagggatatctttttctttgtgtattgtaagacatcccagcatcgaatgtgcttctgcttatacttagagcttagtaaatgcttgtgggattgatgggtaaacaaatgagagagaggaaaataaaagagagagttgggaattataatacactttatagacacagcttgaagttactgaataatttcgtaatgcttcccttcatttttgttgggaaaacacagtaatgaggctgccaattagccacatagggtggaaaaaagaaaatggacatttgtatgatacaaaatttgtatactacataattcgtacactcttttaagggaggcacatataggattaaccagcacatgagctgaccaccttaacagctaaaatcacaagggaaaagatcgctgtagaacatggtgcctagtgagaatcaggagacttgcgtttattcctgtctgttctgactcatatcctggatctaggcccgttatttttcacaaagtgtctttcaggtaaattaaacaagtatgtatcagcaaactggagcatgaatatagtgggaaaatcacagaatttggaatcacaagacacaggtttgcctccagactctgttaatcactagctgggtgaccttaggctgcttaactttcaagcttccatctgtaaggtggagataatataaagaggcctcctctaattttcatgcaaggctttggtgaaaaagcagtgagatgatgagtctgaatcattttgtaaagttttaagatttatttagatgagagtgattataatttacttagcactatgtgagactctgggtaaagcaaaagacctttgagacatttcatgatgtctaagatcttttttttttaagctttttattatggaaaattttaaacacacgaaactacagaaaatagtactgtgaaccctatgtacacatcacccaagttcaatataatcatgatgtctaagatcttatagggaaaacaaaatatacacaattgatttaggaaggcagcagtgcaggacagaatgagatcgagaggcaaaatagatgacatagataaattcctatgtgatgtcacagtgcgaggctcattgttggttggcatccctgggaaaggcacaggagctgagctgggcctgtgaatgaatagaatctggacagggatgaggcaaggagacaggagtgatctctccaccctgggcccaggtgagcctggacttgctggggctgaggcagtctgttgtctggtatgcaactgtgaactcaggagcaagtgcacacattgcttatcacttaccagaagcattgagcaggtcctctatctatgatagcaatcagttttgttccttcatccatcaatcaagtagtaattgagcctacactgagctaggtacttgaggaatttgaggggaaggtggttgagtctataatcagttactttacaatctaacaccttcactaccattcattaattcatcactccaaaaaaaaaaaaaaaaagaaaaaaagactagggaggcagaggatacagagatataagcagaaaactaggatcttacagggaaatatatctgcttctgcttcagtctgttgtgaagttacatagcatgtatcctctggaaaactctctaccctcttaaaagggtgaatgggagaaaggaaaataatatcttatcatagtcatgcacccataacaatgtttcagtcaacatcagactgcgcacacaacagtggtcccataagattagaataagattataacactgtatttttactataccttttctgatatgtttaaatacacaactaccattgttataattgtctatggggttcagtacagtaacactctgtacagatttgtagcctaggagcattaggctgtcccacacagcctaggtagggaacctgcagaatatgtttggaaagccactgatacaggagaaaaaaagccattagtttgcaatgagaaaacccaaatttggatcccctctggttttaagcaagtcatttaattggagttttttttctcccataaaatggggattaacagtgtacccttcaagagatgatcatgagaaatataaatgagaattgctacccttatatagtaaatataaagtaaatactatatagtaaatatagtattgtctaacagctggcaattatagagaagaatgttctacagccatccttaatgcccagagttcttcattaaaaatctctgctgtagctgaaacctccaaccactcttgtttggtgctaacagaaatgaaaaccagtttaatatcatctttatatttagtttaaaaatctgtacattgcttgccactttgcacataggtctctgttaatatggaaccagttcatcacccaagataggggtcctgcagagcaagaatgtttcccagaatggctgataatggtctcctcagtgaaaattgaatgacctcttgactgtggatggtgacaatgaagtcaagtgccaagggtgctgagtaatgggtgtgcaatgtcatattgccttaaaagtacacattgggattcacagaacaaggacaaaagagagacttccactgtgtcctttctctgtgggaagaagggtggtcatatgaaatctgggacttttttcacaggtgttgtgttgacaaggaatcagttctttgcacagaggtctatgttaatacggaatcagtttctcacccaagacaacagaaggacctgccacagtgtcactagtgtcatttctgtccagggaattcagtcatgcaagccctggaaacctgacacctcagctgtgctggcaaaaatgggggtggctgactcctcctgtttgttcattttgctcttttccaaattgcagttttgccagcatgctgctctttggtggaactgaggctataagccaatgtcctagctacaaagaagggtgggaatttgagtttcgattcttgggaatttcccaaaatactgaaaggctagttgaaagaaatatggcaggcacccacttcacttgacctacggcatgatttgtagctgctgtaattggggcagtgagcgggggtgcctctttcaaagatagttctgctaggatttctaccctttttcaatttcccacttttttcccctatgatcttcctctctttttctggcatctctgcagtcaacataagttcaagtgtttaacagttaaaaatgaatccatctgtaaacataaactatataccaatagctatcatctcaaatgcttacagggccagtgaagtaatgtaattgagctacctgttggcagataagatggtaggaagggtgttgcttggtaaactggatagtgcctgagggcaatcaagttcaatataataagaaacaaaacacattgtgcaagccaaacaaaacagatctgtgggctagacacatttttcattattcaattagcttggcacaggtttagagctttacaaatttcttttgggttcttctttatttccatctcttatggacttctcatcttggccttgctcttgtggtcactgttctcgtcctgatcagctgacactatttgtaccacgaggcccaaacaactttttgttttgggtcctaaatcctaagattaggcaggatctttcttagtttgggtttcagatgcacgcctctgggattcggataaaaattgttatcatgcagatagattagtgcccctgggcactatttggggcacagaaagtccctaactagcaacttcttcttgtaacccaagctaaacttctgtatctccctcttgtcttacccactgtttcctagagcttctaggattctagaagcttcttcacagtttcactttttatcactcaacagtctggttggctgagacctccaaacttcccatccagctcaggaaagcccaagatgaagaccttttggttttactgtctttcagtgagtgatatgaaagcctctactctctgagatttcatttactccatctcctaaaaagttgtacataccctgaaacattagtgatttggagggagaattttttgttcgttttgcaacattgtagagtcatttctatggtttaatttctgcttgtgaaggccctgtcttccccagtcttaagtatgcctttagtttgcagaaagatgcactgagttcaggttaaaagcagctttaatcaagaagtttatctggttgttttcaagatcttgtacagatttttcttgaagagatgaaatagagcttagcgattatctaaggaagcagctttctttcacagttaatgagtcaaggtagaactgttaagctctctgtgtaagtttaataggtaaaaagtgggggaaaaccccacatttacaggtgtccacaatgcaacagacactatgtaggtcttcacagatgtcagcacatttcatcctcacgaggaactcacaaggaaggaattattattcccattttacagatgaagaaaatatactctataacttggtctaggccttatacttaataaatgcacaagctaagactcaaatctacatctgatttgttttcttctgtacttccattttttgttagaatctggaccttatgaaccctaatctagtgttcttttcatgacatcagaagagtttagttagctttttcattgtttcattttgtagttcatactttttgggttttaaggattaagagtgtttactcgtaaagaactttgagatgcatatggaaattactgctatctgatattacttatacgtgggaagcaggaatagaaacaggagataggaaactgaaaataacaaaacctccaccccaagggctaagcattgtcataataagtaatgaacaactgagacatttagctgcctccttggcctctcaatttggatgtctccgatgggcatccctaaccttacaccgtcacactaggactctgggttgcactcgctcaccccccacctttccttatcccagtaaatggtcctaccatctatccagatacacagcttaaaaacttaggagtctctttccattatcctgcctttgcaaaagactcaccagcattctaataagtctacctaataatctatcctaattttacctgcaaaatatactttttgacctaatctgcctacttctctttctccactgccatctctgtactctaagccactaggactcctgcctgaattaccacaagaccttccccactgccctcaaggggctcccatccttacctgtgtacctctgagcctaagaccctcagagaccccgcactgcactgagaataccatccaaactccttactttggctgcaggccctcagagatgtggctctgctgacctctccttccccctctcttctcactcccttcctttcttactacacttgagctggactggctgctttctgctccttcaaccccgtaagctggttacttcatcagggccttgggacttgctgttcccactgccaggaacacgccactctctactgatattaccatggctggcttcttcttatttggtgtccatgtaaatgccctctccccagtcagccttcctcaccctgcctgagtcactctgtagcggatttctctgatttgtttttttcctttagcagttgccactgtatgagattatcttgtttggtctatttatttgcttgtcatctctctgtttacgtgaatgtgagctccataaaagcagatacttttcctaagacagtgcatggcacatagtatttaaatattaagcatgaaataaagatttctggaataaatgaagaagcaaatgcagaggcctttgggaacacatacaacataaaaagaagaggagagaacaattatgactacctagtagacttccttattaccttagttatcttggcaagggcaagaaattgcccaaatatagatcatttgggggctaacaattctgacaaagtagggctttatagaagttgaaggtaaagctagttaatttgaggactttccctagacagagccctttctctaatatcctagttaataataatcatccatctttacatgctaacagtgcatcagggaggactatgtcatggtggtggtagtaaataataatgataaaaaataacacaatcaaatacttacatggtgcttactgtgctccaggcactatcctaagtgctttatacagatgagctcacttactcctcacagtcaccctatgagtttgtgctattattatcactgtttgctgatgagaaagtggaagcacagagaagttaggcaagttgccaaatgtcacacagtaagtgctgaaactagaattttgagccacagcctggctctgtagtctgtatttttctatgctctgtagcctcagcacactttcgccatcaggtatgcaggcttggggatcaaacttcctcacttcagaaaagttgctgcttgaagagttgctgcttcattgctgctcaaggctggctcttagatccggagcctggaattcatgcagtgtcctacctatgaaatctttctgtggggacaggcctccttttatctgtgcttgtgttgcaggggctatacgtttctcatttagagccatttacatgctatctatgggaagactggctatagaaaccatcttttaagaacttaatgctaaggaccagttatgttttactgcaagtctttaatgcacaatgccaagatcaacattttttgaaattacaattttctctgctatttcttacaatgcttattttctttccatggttcccagctaattggtgtcccgtacctgtgctgatgttgaatgtttttcctccaaattaacctatagatgatttctggggtgggggtgaggatggggcagaaaccctttgaaaaggagtgcaaaagttcatgttcatgtgactacgtacatttttcaggaaagaggtaattatcccaatactctgcaacacaaaaaagattctgaatcactgagcctgggtgtacaaacactatgtcttgtgtgtatgtgtctgtgtatatgtgtgtttcctagtaaaaccagtttcatatcttcatagttctatttcttctggatagtacttttctagagaatatggcagtaatttctaattttaaaagacataagaaacaaaagtcacagtaaaaatctaatcagccaaatagtttataagaaaatgcaggaaaaagataaagaatgagctccttgatacattgtatattctggttcaaacatagtacatgcacagatacatacagcacaaaacacactaactttaatatcctgtggagaagttaatttgctggattacacatatgcatgttaaatgggagcatttattagaataagtcagaccaaaagaacactttcgcacggaatatttatataatggaaacagggatttctgaaaaattgcttcagttttccaggtggctttacaagggcaggatggatgtagagtaactgggagagagactctccttttagcaacattctgggcatgaaaggcagttgtggatccagccaaataagctgcaaacttcccgatgatatattcaccgcttttctacattttgtgatagtaataaggaaggtgttagctctagcctgctaaatgtttgaatctgatgcattttgtaatcagcagaataatggtccccaaagatgcctacgcctaactcctggatgctgtgaatatgttgtgttatatggcaaggataaactaaagttgcagatgggaattaaagatgtcaatcagctgagctggaaataattagagtgccctggattatccaggtgggcccaatgtaatcacagatttccttaaaagtggaagagggaggaaggtgtgttgggtcaaagtgattcaataagagcaggattcaatctgtactggctaccttggaagataacaggaaaaggaccgtgggccaaggagtgtaggtggtttctagaagctggaggggccagtgacatattttttccctagtgcctccagaaagaacgcagccctactgacaccttggttttggcctggtgagaccaactttggacttttcacttccaaaactgtaagtaataaatttgtgttgttttaagccaacagcagaggtgtcatttcagtttgtagtcattgctacagcagcactaaggagctggcacacattgccgggactcgctctggcgcttgggcggcactgtaggtgtccacgttcttggaggtagtcagcaaaggggggctctctcggctgggctggccacgtctgcttacacagagtgctaccctcttcccactgcggtaacagccttgccttagcccctgtgtgtttggagtggcattcgctacaaaagttctttgtcaaagggacaaacgatgagctatgatgccattcagactgatgtgttaacttctaagctttcctatgattaagataattgttctatgatatgaggagcggcattgcatgcagtatatttctttatgtgctgttaaaatgcagttcacggctgtagacaggtggggtgaaattagcaccagactgggagacagaagccctgatttctttccttggcctgtccacatacaagctatgggtgtaatgaacttttgttttcccataaacattttaaaatcacttagtcatgctcctcaaaaaattttaacttttggattaaaactgttgaaactgtagataatctggtggaaaatgaacaccttagttctacagttaacaaaggtaagttatctcaataatttgaacatgttatatttttatctacttaggtcttgtctgtcctataatagttctagggcttttttttttcctataaagttcctggtaattcttatctgatttttctttttctccttaatatagtgcattattctgaattgttaggtaaaagttggtctgcttgttgtcagtatcttatagagtttgtgcttctcatatgcctagaaattttttcttgtgactttatatccccttcaggggatataagatgccgtgattaatatcgtacaccaggagaaggggttacagcctgtgcgcctcctggtgatcttgattaggaagaaggggaaggtggaccttagggcagatggcctctagcattgaaatgtgggctcccagatcctccatctgtccacatcttgctggacacctccatactcatctgcctgggccacttctctgactcccaatcccctaacccttgggctgggaggagaaagagctcagaagccagcaggttgctctcttcccttgctgtgtgctctcagtggttgttggcagcacactggaatcacctggcagccttaaatactgatagtgaattgaatccatagagattctgattttgtgcattccaggtgaggccaagtgtatcaggctgttttaaacctccccagatgattctaatgtgctgctaaggttgagatccccagtcccagccctctcctgaagccaccccactggctggagaagatactgggctgacattgctttttctctgccctgccatggtcactgggtgggcaggcaggcccctgtccagggtagcgtggacactcttccaaggcagcatctacgactctcagctgtcactctcagctctcctccatctaaaacatcttagttttacagttgtgcttttcatatgcctagaaatttctgggctacatttctttcccatatatggacttcatgaccgtctattttcccagaggttttttgcagtttttatgctagtttttgattcaccaatcttttccttctgttaggtttaaagaaaaaagtctacagttccagttagtctacttttgtaacaggacctgacaactccactctacttccaatcctgaaagactacaggaaaaactagcccaagtgactgagctggggggtcccagtcatcggtagcatgggtattttgctttggaatattatcaaatagcagggggaccagcacagtggacttagtgtcaagtctaggatttgattcttagctaacaaaacaagtttcctctctgagttgtgacgattaaatgcaataaaatggaaaagtgcccagcagtgatgggctttcaggagatgccatagacattagctgaatttgaacattttcaacttgaatgggacagaaacattaactggagttgacaggaggatcagcgatgtatctaataagcagcattacaaatagcacaagcttaggtgttcctcagctaccacaccttagtgcttgctcctctgttaggattatctattagactttgctatttacttttattagatttttatattacaagaggggcacataatagagctcatgcaatttggttcatttcagacttgggccagctttaggtgaaagctgctggaactaatttttatagccaggacttcaaatagtgactttgagcctatatcagaacaaaatatcattatccccagccctggctctgacatcagttcttttgaggctgaaagttgccctggggttgtaagatcttacacgaccaataacagaagtcagcagagactcctaggcacagagatgtgataccataattaatattttgatagcattccaaacagcaacagaataatgcctttggccaggaaatcacagatccctacccaccctgttatggtggaactgtgtcccctcaaatgatccccagtagctgtgaatgtgatcttatttggaaatagattcttttgtagatgatcaagttaaggttaagtaaggtcattagggtgggccctaatccactacgactgaacttataaaaagagaaaaaatttggacgtggacatgtgtacgctgagataacattatgtgaagatgaaggcagagattgggagacggaactataagtcagggaacaccaaattgactaatgtccccccagagctaagaagaggccatggaacagcctctccttcacaggtcagaaggaaccaatcctgccaataccttgattcccagaattctgacctccggaactgtgacacaagaaatctgtcagtttaagccaataagtttgaggttctttgttacagtagccctaggaaaccagtacacccccttttctctcactctgccttccaggagaagtgatactatagattgctcaaactcaagggaactccttcagtttttcggttgaaacatgtgaaaaggctgatatgtaaccactatgaccttcagaaggggcagtttcacaggatgtagtcaaatatattttctggtgggtggagctttgtgtgagacataaatcaatctcactgggtagctgtctcaatttccactttcccagttcagtgtgggtggatggggaaggtgctctcaactgggggggtacacaggctgcttttctcattggctttcccttatgcttccgggacattcttcattctgtgtggccagggaacatgtaaactggagacagaacccaaaagctttccctccctaaaaaaggcctaaggtgggatggccagcagggcaggtgaggaccttgctacaaaaattttaggaccgagaaaagtaagtactgctcccccaaaaattcaatctcaaaattaatatttaacttaaatatctaaaatataacatgtccactagccagatcagctgatagtagggcatataaagttatgtttaatgtggtgtattgtgtataacatatgatgtgggtggggtccgcaaaagtaagggtgccaaaggtctgaaacagctctgggcgttggagcaaatggtctttctcctctggctactattgtcttgtacttacaccttcttcctgactgctgtgttctttgacattccaaaatagtaagattagagacctagtgtgggtttgggacagaacaggtagaataaagcaatcccttaccctgcttcatccctggttatatgttgatcttagaaaacgaagagtgctctggacagtgggtggagaagattcaagtacatcttccttgctgacaatatgctctcctatcttttgtaagagtacacaatttaaatttctaaaaattcattacaatacaaagcaaaacaatccctcgtagatttataatcaaactaatatgccacttagaaaagatttgaaataaatgcaaatacctaggtacaatgttttatctttttaatgacacttcaataaacctaattacttttatttttctgaacaaagcaagtggggagaaaaatgtaaagtgtttcttcatacactgcaagtttatgaaattcaagaggtagaaaatgcagcagggttttgaagaagagccttttaaatgaatgtgaggcttggctatccctacacttgggatgcaggtcttctaaatggatgtaagtcttgggtataccttaaagacgatgacagtgaaagtcagcaaatccttccccagtaggctttaactctcttagttaaaaaaaaaaaatacaaaaaaacactaggctgaatgggccatttgtatcatgtagtacgatgactcttatgtatgtacttctatcctgggatgaaagtccttaatgaaggatttgcagattaggttaagagggttatcgttatctaattacacaacaaatccattcatctggcaaatacttagtgaatatctactaagtgccaggcagaatgctaaacaaacttgtccaaaacagccacatgatagcaggggcacgataacagtccctgttgtgcagctcagttgagtaggaggcatctataattccatgtgaggatgagggcagtgcaaggtgctggggggagccctagcatcttcatccattcaggctgctagaacgaactgccacagcctaggtggcttgtaaacaatagaaattcattgctggctgggcgcggtggctcacgactgtaatctcagcactttgggaggctgaggtgggtggatcatgaggtcaagagatagagaccatcctggccaacttggtgaaatcctgtctctactaaaaacacaaaaattagctgggggtgattgtgctcccctgcagtcccagctactcaggaggctaggcagaagaatcacttgaacctgagaggcggaggtttcagtgagctgagatcataccactgcactccagcctggtgacagagcaagactccatcttaaaaaaaaaaaaaaaaaatcattgcccacagatctcaaggctggaatgtccaagatgaaagcaccagcagattcagtgtctaatgagggtcggtttgcccatttcataaatggcacctgctcactgcatcctcacaggatggaagggccaaggcagctctctagggcccctttgataagggctctaatctcattcctgagagctctgccttcatgatttaaccacctctcaaaggactcacctccaaatacataatcacattgatgattacatttctacctgtgaattttggggagatgcattcagaccatagtaagtagggaggggcatttgacttgaatttgagaactgatcaaaaaggctttctgtagaaagtgatagtgaggcctcaaaaacaagaagggcttattcagacaaatgaaataaatgccctggaggcaagaaagcacagcatataagagctgaaagtaatttgatatgaggtaaggatcctccagagagaggaacctggggaggtggggagaagccacatctcgaagggccttgcaagccatatggagaagattcacctctaccctgagggcaataagaagctactaaatgactttaagcagagaatggaaatattcagatgacagcctggctgtttggtgggtggattagagggaaactagaccagtaaagaggctgctgcagtaagcaaggtgggaaatgagaaacattgccactggggacaaaagtgggggactcctaagacagtggcagggagcatcagcaggatttagtgattgggtggaggtgcaagtaagaaaatgaaggttaagagtttagctttgtagagtggtacctctctgtggagcttgagaacttggagagaagaaagctttggtgggaaggggacgattcagttttagacatactgatttggatatacataaagtatagccaagcagagctgcttggaaaacaggtacctgaatctgacgacccctctctcaggcagctctcagggcaagggattccaggaaggagtactgagctgccttgaaggatgaagagtagtgggagggggtgtggcaggaaatgcttggaagctggggaatgatgatgagacttacatgccatgaggaattgcaggtagtacagagggctgtggatggaaggcagggaataattcttgatgggttttgcctgtcatgttttatgcctaaggaatgagatagagctaatataatattttagacaggcgagaaacctgatcatatttgggttttaggaattagactggcactggcatgagtgtgaactggaaatggaaataaatcagaccagttaaaataatctagttttatgcctgtcaaaagatcaagtcctaaactaaggctgaacagagagggtgaggaagaaggaatgaattttagggataccgaggtggcagaaatgacagctatagccatggactaaatgtgggaggtgaggaagatggcaagaatgatattcagagttctggcttggctgatggtggaccatttggtgagatgggcactacccatctcagaggtggaatggcaaggtacaggtctgagaaaagcagggcagatgcgccataaaccctgatctcacaattgactgaaaaatcatgagtcactaagacgttcgaattcttgatccctgcaaggaacagcaattttaattactttcatctgcagtgaagaatttggcatcactttgccctttttgtcaatattaaggcttggaaatcagttctgtttgcaaaactactttatcttttgaaagaaacagatactcaacatgttaaaaatggccaaaatataacttggtatttgcagggatctctctttcccaaataatcagatatctaaaatcttgtgttgaagagaagtacctataatttgcccaagccttcaagatgctatcacatggctgattcctctcattcttcaagtttcagctgagatgaaaatggtcagaaaagcattttctgaacaccttctccaaacaggtcctgttattactatcatggctctacgtcctgtcatccatgccatttcatcagcttaaaagtatatttttatttacatattactctcttcccactatgattataaggtccttcagggttgatagggtttggatctgtgtccctgctcaaatctcctgtgaaattataatctccaatgtggaggtggggctggtgggaggtgactggatcatgggggtggtttctgatggtttaccaccatccccctagtgctgtttcatgagagagttctcaggagatctggttgtttgcaagtgtgtagcacctccctcaccttcctcctgctctgggccatgtaatttgtgcctgcttccccttctgccatgattgaaagtttcccgaggcctccccagaagccaccatgcttcctgtacagcctgcagaaccgtgagccgattaaaccgcttttctttataaattacccagcctcaggtatttctttacggcaatgcaagagtggactgatacaaggtaaagattgtgcctgcttcttttacctgagtatagccagtggcagctttatgccctggcctatcatcaccatcctataaatactaattaagttcacggctaaagaacagtcacgattcctgttctcaaggctctttttagccagtatcatttttatggccatgtcggttgttaaaattcaaagtccttctgtacttaataacctctgctcagagccctggaagtcccccagcccttactcattcttctatttgcccttttcgaggaattctcagaattctcctcaacccacaacttaaggcctaatacctggcccagtgtgccctagttctggtgctgaggactgtgtgtgttggttggtgtctgtgctgtacaggttggtaaatgttttgaaggtcatacctgcctagacttctaatccaaacccagaatctactttctgttgctatataatacatagaaacttccataataatgacatagagtaacataggaaaagatccctattgctaatgatgaacaagttaaattcatattaaagcaaaaccatagcctcagatagggtaaacagatgggcaggtctgtgtgaacgtgtttgtgtcagggttaggagttagggaggtctgtggcaagggaggattgcagaacaatcacctttatgttcttttggattgaagacaaagtttcatctctttcaaggagagagaagagctttattgaaaaaagtcaaacttcaactgcgaatatattccttaagtggagagatcctgggtgagactccatccagaagctggcttaattggactccaactgggcagaatgaattcttaatcagaacatattttatttgcttaaaatgaatattattgcagttacccccgatttatcaacaaagtggccattaacagccatcagtggctgaccttgacagattccattactgaaataatgaaatttgatgggttactattattaagatttgctaatggttttacattgcagagcttgagaccagtgaaacagagctgcttactcaggcaggctgaccacagggaaaatgagagggagggagtaatgaaaagcacagggagcttgatgaaaaatgaatggctcccaggcagaatttccacaaatgaaatgcaaattcagatatatatctcttaatcaccaaactgaaaaggttgattacttaaaattagactcaccagatgtttttgttgtaggcaggaatggaaagctgactaagtgggaaaatacaaatttattctttaaaaggtcctagttatctcataatagctggtaggaaattgaactgaagtcataaacggaaagcagctagattcagaggggaatgaggagaaaagctcagaggcaagaaaaggagaagaaataagacaattctattgtgttagcattcctgatatttgtaaacttgggctgacgtgcaaaagaagtgatttactttttttttcctaaaaattcattggttagcagctttcttctcacataattttagattgtaaacattttacttcccttatcctcagagccattattaatttccattaccttcagacatgacccagctacaagaaacaccaacccaatttcgtttgagtggaaccagctgtgggcaaaggagtaaagttgcttctgggatacagtttgggagacattggaaaggcctgttcttagattgtctccctcaccttcctggttttcccatcaaagatttgtctgtttggatctatcaagcattttgaacttactggcttctgtttaaaatgcaaacacttccgaagaggcaataactgagaacctgttaggcttatcaactaatacctttgcctaaatagagattctgtcaggacaaaagttttgaggagtggattatttcagagcaattagtgtttgggagagggaaaaaggcactcctaagagttggaagagatcatttttacctatcttacaatttccaagaggagggcccttctgtggcttaactagtatttattgccaaaacttcatggattaaaaactcccaaactgaagtcagttttggtttcctcatgcctctctatatggcaaaagaaccctagataatgaggaatattggatgcacatggagataacctccttgtttgtctataagatagaaatagattctgtcttgctattattgcctgtcctttactttctgggtcagtggtccaggatcctgttaatttcttacataacaaattagctgtggacctcaataaccactgtccaagtttgtaaaacagagaacgagatatgagtaagttccttgccagatctattataattaagttactgtaacttctgtaagtgtacttaagcctaacagtcagtacacagcatataggaaatgcatatgtggttttgaaccaatcagcttaagtatattgtacattagaggagataggctcaaagcaagtaattccttttaaaatgtttttatatgcatcacatccataactaagggcctactgtgtggtaggtatcacaatccaggagtgcaaaggtaagaactgtgtaacatatgggcctgttctatggaaatgaatgtattagggaatctgttatattttgctatcaaggttaataaaacaaaaacagaaaaagttagccagggggaaatgtattgtataatccattttgggatagataaaaggtgactttggggaacatagagccccttgccccgcataagaaactccagaaatagaaaagagaaacaggaaaaccaaaactggctggccactcgggagatcacatttgttagtggcttccgctaagtgaactatttgagacaacttataacttatgttgggtcaggtaactctagaagtgccctctagttggtaatagatagcttgtaatatgtctggttcatataataaaaccttatttgaatgccactattgtcagaacatgtagaaagatactatatttgcactacctataaaatggtatttgttctacaaaggtataaaattatagggggataattaaaatgcttagactcttcaggcacttgacagtcatttctgtgtaaatgacttaaatcactaattgtaaaacatttcaatttaatcctcaagatacctcaaggagctccactcgctgatattctttctggtataacactagttaccattctttctggtataacactagttaccatgtgcattggagaataaaaatttctctgaaataaactgcaattgtgactctttaattcagacttattttctcaacaattagtcaaaattagtcaaataaggtgaaagtataaatggttatacaaaactcttaatttcttatgaagactataagggcaattatacatgaaaaataaaaggcttaactctcacttttaaaaataagagaatgcagtttgatagctctgatgcttaaaaaataaaaagggaataagaacaaaagttatcttttcttagagcattttcctttgtcaacttgtaattggcccggtgtggtggctcatacctataaatttcagcactttggaaggctgaggtggaaggattgcttgagcccaggagttcaagaccactctgggcaacatagcagcgcctcatctctacaaaaagtacaaaaattagctgagcgtggtggagtgtgcctgtagtcccagctacttaaggggctgaggcaggaggattgcttgagcccaggagttcaaggctgccgtgagctatgaagtaagctgccactgcactccagcctgggcaccagagtgagactccctcaaaatgaaaaaaaaaaaaaaaaaaagaaaaaaaaaaaagacagtcatatgaaaaaagctcaacatcactgatcatttgaaaatcaaaaccacaatgagataccatctcatgccagtcagaatggtgattattaggaagtaaataacacgctggcaaggttgtggagaaaaaggaacacttatatactgtcggtgggagtgtaaattagttcaaccattgtggaagacagtgtggtggttcctcaaagatctagaggcagaaatatcatttgacccagcaatcccattactgaatatatacccaaaggaatataaattattctgttataaagacacatgcacacatatattcattgcagcactattcacaatagcagagacatggaaacaacataaatatccatcactgatagactggataaagaaaatgtggtacatatataccatagaatactatgcagtcataaaaatgagatcatgtcctttgcagggacatggatggagcctggaggccattatccttagcaaaactaaactatacacatgttctcacatataagtgggagctaaatgatgagaacacatggacacataggggaacaacacacaactagggcctgttggagggtggggcctgggaggaagttagacgatcaggaaaaataaataatgggtactatgcttaatacctgggtgatgaaataatctgtacaacaaacttgtgccatgacacaagtttacctacatgacaaacctgcacaggtacccctgaacttaaaagttcataaaatccttgtaattataaattctttctttggctctttgagatgaaaaatattttaaaaggccctcgcaggtcttacaagccaggagtgtcattttctaggaccaaggagccatctctctgacgtaaaggagacaacacttctatcttgcggcttcggtaagaaggtaggagcctaaacttccgaggatcctcctcctccaacttgcaaaactacttcttgtcattaagatatgagaagtttgtttttccctttataagacactaattagctaacacagatgttcaccccaattaccaggtatatttaggatgaactatgtgaggcacatggtgctgtcaagtccttatgtgaggactagctagttgtttatctagagaatgcctatgtaataggatgcatctgtttggctgtataaaagagtgagattcgtctttgcaatccctcagtggattccctctatgtgtatcatattctagtttagcgtttattcaataataaagctgctttctttctctactatatttgtaaagaggtttttttttaggttggaagatgattttgtctttaaatttacccaacctaacctcatattgattttagatatatttcacgtgctcttaaactatgtccctaaaacccgagcagatgttaacattagctttactgcctatgggttaaccattcatgtcaacactgattctccttcctccggatcttggtgaatcaccctagaacatgttttgccacccttcctcactcacttcctggtattatcactgataatggtctgcagctttaatttaaattagaggattaattttatgatatctcaaataatgtgataacagcaagtagattgtcttaaaagtcatgtgtcagctagctgagaaagactgcaagtgatagggaggaaagaggctgagctgttagggatttaaggtcagtgagtacatgacaaaaaataaaatattacatgcctagaaaggcaggacaaaatgaagcaatgactcaaagttcatcaacagaaaagaatataagagatttcagccttcagtcctagcaacagcctgcaatacaaaacaattctggctctactaggtgaagatgctgacctaaaccagtcctgggtcacctggactgtacttggagcagcaatgtccattggaacgttctgtgacggaagggttccatatctactgcccaatgtactagccaccagccatgtgtgtactgaccactgaaaatgtggctggtgtgacagagcagttgaatgttaaatttaagttgataaaataaaaatgaaatggcaatatatatgactagtggctactctattggacaacacagaactatatgattcaagggaagatgatttttggggtcatttacttaaatattacaaggcttgcgctatttggagagaaatctcctgtgtaggatactgatcagcatttatcactgattggaagatgtacagatactagagttgaagtggtcctagatgttgttggcagtgatgggaacatttgggtgcttgagacgaggtaagcttttctgggttctctccagccatctcatgagacttcttgctgtatttttcacatatttcattattttcaagttctactatctttatcttgctcacatcctgggaatcataagaggattaattcgtgagtttcataaattgttttgtagattaaaattccctattaaaatgtctattactatcagcagtcctgacttggagagattagacttctgacaattcctgtttatagggttcggagcaatgcatctgtgctattagcccaggaggcaggcccacacagactcagttagattaagcaatcagcttcctgataggcttaccgagaaagctgactcgcccttcagcctcagcctggcctcgtggttcctcccttctctgcctgcttcctgtcctagggtctgtcagccactctgcagagctatcctgtactgcctgaggggctgtgcaatcaactcaggcctcaggggagagagcagctgaggaatgtaaatggtgcacagtgtaaacagtaatgcacttgaagtcacaagacctggctttgagtcccagacttgccttgttaattatgaaattctgactaggtacttagtctctttgaaacttacttttctcattcccattcatttaacaaatattgagttaggtactgtgttaggaactggggagtcatcagtgaactagactaaaaacttctaccctcatggaatttacattttcagcaagaggaactgaaaataaacataataaatgctttacataacacatcagaaggtaataagtaggccaggtacggtggctcatgccagtaatcccagaactttgggaggccaaggtgggtggatcacctgaggtcaggagttcgagaccagcctggccaacctggtgaaacatattctctactaaaaatacaaagattagctgggtgtggtggtgggcgcctgtaatcccagttacttgggcagctgaggcaggagaatcgcttgacctgggaggcagaggttgcagtgagtcgagattgcgccactgcactccagcctgggtgacaagagtgaaactctgtctcaaaaagtgataagtgagggagatagataaagcttggtaaactggatggggaatagatgggagacaacatggtttttgtgggggaatcaggataagcctcactgagaaatagacatttgggcaaaagcttgaggaaataaggcaagtacctatctgtgaagaaccgtccaagtttaagtccagacataagacagagaaacctgaaaataaaaactggttgatgaccctcacctagagataagttacccttaaaatgcctactatgtgctaggtgccaaatacttacttacatttaaaggctgacgctgactgatttccttcatcatggaaaatgaaggttatccaaataacttgacaagttaaaagcatctcaggaaagggatcattttcaatttgaatctgtcttgttccactgtttactatgaatttgtagcaatattatgagatagcttggtgcatatgtgtatgtaatatataaaactgttagccaattctgcatgggaatctgagttgctaatttctccagaacatctcttgaaggatttttgaatagtgaataatctttcaagatggagatagtgtctccatctggagcaaaggtcaggtttgtttcctgctcattatgaagatttgggtttgttaagctcggttttctttcctgtatacaatccactgtgtctgtagttgccatatggccctctttacatcaccctgtgaaaactgggacttgtgcaactactgcaagaaagtggcgatactctggctattgtagtgaatctctgatccaagagtctcatgtcttgcagcaagataatgtgttagcctgcaactagaataaaatccaaaacctgcctttaagtcttgacatctatgatttgagatagagatttttttaaagagaactaagtgaactttttgtcctgagtgaagcacaaagtacccacattgtaaagtggaaaatagaatggttcatcaattgtcccagcaccactgcaaagagacagttaagtagctggtttccttaggcaactggaaatctagataatattgtgaatttaattgaccactaatggaagttctctatttttaaacatttttctttccatctttctgaagcgataggaataccttttccctagaaaggtcagacttcaggaagcacataacatttaaataatctgaaagctcagcatccctggatgtgcaaagctgccagagctgggtcagagagtcaagctgaatggaattactgaaggcagctatatggctggaaatgcagtcttaagatgaagtggaaagctaagctctgacagcttggtattgagatttaacatttgcacaaggttgttgaggataaaggcaattgccaagaacaagtaaaactattcagaagttcatagatttgagggggtcattcatacgaccaaaagaaaactccaactcaaggaactgtgtattacttgtgtctaatatttccccaaaatatcattgctaaattttttttcttcaaaattagggaattagcactcttacagatatatcatttttactattaaatatagttctttgaaagaacctactcacgggggtatatatgaaattccctatgttcaactgagtttctattttatcctgtatgcagcatttccattatttgtccttgggcaattcccaaaggaagtctagggcagtttttcatccttgaagcatctaaatgtgctctataaactatattctatattcaccagctgcttatataatgttatttctaaatgtggaacaaaaaagttatttactgccactattggcacacaaattcaatatgtattaaaatattcttattaagaagtgttagaaaaataaaacttcatgaaaatcttttaaaattcccagatatattattaaataataagcaagcaaacagtgactggacttatggtgataaagtagctttacagaatctgaagagactaaaaagggaaattatattagagaaatacaaagtgattgaagtagatacgtcaccaaaagcacaaacaaaaacagaaaaatagataaaccggacttcgtcattattaaaaacctttgtgcatcaaagtatgttaccaagacagtgaaaagacaacctacagaatgagaaaaaatatttgcaagtcctatatttgataagggtttaatgtccagaacataaagaatttctaaaactcaacaaacagataaaacagcccaattaaaaattgggcaaagaatttgaatagggatttcttcaaagaagacattacaaatgaccaataaacatatgaaatgatcaacgtcagtagtcattagggaaatgcaaatcagaatcacaatgagataaccacttctcacatactatgatggctataacaaacacaaggaaaatattgttgaggacttggagaaatcagaacccttgtacgttgatggcggaagtgtaaaatcacacagatgctgtagaagacagtttgatagttcatcaaaaagttaaagatagaactatcatatgacccagtaattccactcctaggtatattccccaaagaattaaaaacaggttattaatatgccaatgctctgaattgtaacattattcagaatagtcaaaagcagaaatccacatatccatcaacagatgaatgaataaaatgaggtacatatatatataatgaaatattattcagccatagaaaatgaagttctgatatgtactatactacagaccctgaaaacagtatgctaagtgaaataagccagacagaaagagaataaatgttgtataattgcacttgtataaaatatctggaacagatgaattaagagacagcagattagaggttaccagggagttgggttggaaggagtggggagttattgcttaatggttacagaatttgtttgtgaaggcgaaaaaatttggaaatagatagtggtgatggtagcacaagattgtgaatgtaatttatgccactaaatcattacacttagaaatggttaaaatggcaaattctctattatatattttactgcataaagtacatgcctttgtgacttttaaaaatatgaattctaaactggtcaaatatatataatggattttttaaaacaagaaagtgaagaaattattggggtctaagtaaacatacctgagataattacaggcaattgaaactaaaaggacagatatagactactgtagggatagaataaaataaatcagatcaaatgctaaactactgtcttgaacatgctactttatttgtaatggtcaagactagaaacagaattggaagaatagttaacagattgtggtataccaatatgagagaataacttgcaggtattaaagtcattataaagcccatgtagaaaaacaaattgacaatacaatgttatgtgaaaggatcagaatataaaacagtatattacattattgcaactttgctaagatacattgtatgtggcagacaaaatatgaaaacagttgtgctaggattaaaacatttctactactgttgctttattgttaattcaggtttttagaaaaaaggatacatgaaaacattggtttaataccttgcatctctattagtaattatctattgtgcaaaataactttggagattcaggctagcttctctttactctagagttgtatccatcatatactgttttactatgcagatttgttatgtctaaattgggctatgattagtgacattagagctaagccagggatttgaagaagttaaaagctaaagaaattccacaatgagttttgcttgggatctcactaaatattcttatttaactccaatatttcaagattcaatatatatataactaagattatatagtttgaaattagcttaggaattcagtagtccaagttcttttaacaaaggaaaaaactgaggtatacagcccatgtgctgacaaaagccagacagtagccaagcttgcctgtcttaatactctgctcattccattatgccagagcaacttctcatctatcctcaaactccacattaccatgtaatatagacacgtgcctgcatgagcttggtgctggaagacataacttcaaaaggatgctagcttattgctgtttacttgtactgaattaactgaacccattatctctttgacattgtgagaattacttcaacttatcagtgcaacctgattcagatttcttattccatccttgtgaaaaagctattccaaatccataaattcagtgggtcagttttgacctgaaaaagtgaaatcagtaatgaaaatattgcctccttttatgattattcaattctacttgaagcaagaggctggattgaaaaacaacctcttttggtccatcagttctcttttggtctaattttattgccaaactattacaggctgctgaaccactgatcaggctgctaactaatcagttttctaccctatactcatccatagtggaaaaagaaaataaacaagcaattcagaaaatacattatttagcattactctttcaatagggtctatgacttagtttattacaccaagaaccaacccaatttcaaataattacaaagtgttagtaaactctccaggtaggcacacagagacatgagttgcagataacgctgcatgcattggtcaggccagtaagaggtttcagtatctttccctgcatttttgacacctaactggctgagtatggctctgcgggtcatgtggaaacttagaagtagaatctctgccaacagaacaaaagcatctttgttcagaggcttgctgacaattttaggtgttgaaacccaacagtagaaaatggaattatagagctggaaagaattatcaaaatgtaatttaattctagacatatcctgcataagacatgattttctgaactatttcagaagagtgccagggaaattactttagtcgtatcttttatttttcctctttaaattccgacaaatatcttattaatggacagtgatatctttacaataccatggtgttctttcaaatatgagaaggtacttttttactctgaccaatttggaatgaaaactacacttaaatgtagactttaaatcaaagataatgtgagagaaaattataagaatcaaagtgatatgcaccagcttaaggaaatcagaattggttatcaatggccagttctagcacttattaagcacctgttttgctagtggtgaggaactcaaagacaaataagacatagcccctgtccttgagaggttataaaatctagcatgctgtattgcatggtttatttgaccactctgtatattacaaatggaagtgctaatattaacaagcgtatgtgcaaaaaggatatatgaaaacattagtttaatactttgcatctcaattagtaattattatgcaaaataactttggagtttcaggctagcttctctttattctagagttgtatcaattatatactattttattatatagatttgttacgtctaaattggactacaattagttatgatttgttatgtctgtttatttgaccactctgtatactactaatggaagtgctaacattaacaagtgtacgtgcaaaaaggacacatgaaaacattggtttaataccttgtgtctctgttagtttaataccttgcatctctatatacaaaagccccgaaatttaaaaaagtgtacatgcagtataattcatgagtagatgttaaaagtctgctccaatcctaaactgatagtgtaggcagtgcttctcagagtgtcccaatttttggacttcccattagttcctactcagattctctgggaatgggccctgagaatatgtatttcccagtaattattattattattattttgagatggagttttgctcttgttgcccaggctggagtgcaatggcgtgatctcagctcactgaaacctccgcctcccggttcaagtgattcttctgcctcagtagctgggcgtgagccaccgcacccggccactgccattgtttcctgactttgcctagaaaagttagccttcagagacaaattctcattcaaaggtgaaatgatcttcagttatgagtgattatttttgcatctattttactttcttttttttttttaaccttggaaccagtttattctggtgctaagaagaactgtaaaatagttaaaatgtcctatcaagtaattcactgattacatagacaccacttttgttttttattccattttttgttttaactcatgtggtagtgatatttaatactttctgatcaaataggttcaaagcgaatctttaaatttcaaatttctttttttaattgtgataatacattttatttaacacagtatatccaaaacattcccaactgtaatataaaatttattattattattattattattattattattattatactttaagttttagggtatatgtgcacaatgtgccggttagttacatatgtatacatgtgccatgttggtgtgctgcacccattaactcgtcatttacattaggtgtatctcctaatgctatccctaccccctccccctaccccacaacagtccccagagtgtgatgttccccttcctgtgtccatgtgttctcattgttcaattcccacctatgagtgagaatatgcggtgtttggttttttgtccttgcgatagtttactgagaatgatgatttccaatttactttcaaacttgtctgagaatggttactctggatgttcagaaacatttcactttcacagttcagtcatattcttgtctttcattcaaatgtccgcaaaaataggcaggtgagcaagtgctggctaaggcagttcagtgaggaaagggctagaggggaggagttctgaaggccataaccagaatctaaaagaagttcattcccctgaggaaaattccctattaacactgttcccataattgctttcacttttatgagaaatgtaaacagtcagaaatgaaacctcattaatataatgaaaatatttcttgctggaattaataaaactctctcctgctgagtttaaagcaccaagttattgaaaagacaaaagtgtgactttcagcttttgcctgacaattggaacgtgaaattctcatggtatgtctcttattcttagcttcggtcttgccaaaactatttccatggaaacagacatcaaatctgaaaatactgaaaaagctactatggggatgatcatctaaactcatttgctatacttcgccaagtaaggtcccgagtgtaaaaaggcgaacacaggctggcatcctagtgtaaaaatgactttgctatcagggaaaaaccacaagggcctcttaggggaccatgtttcttccttctatttctctatccctcttttgtttctttttccctcccttctcttctcacttattcagtcattccttcacccaatataattgagttcctatttatggttaaatatatgtacacatatttgttttctcccatgtaagtcaggaacactgatgcatggttttcagagagaaaccaatagacagatactgtcttgcattgtatctaggaagcatgtctgtttaaacagatgcaaacaatggaagggcaaggttggtgtcttgccatcactggcatctaacacaaaatggctccataaacattaggaatcctgatgcctgaacagaatggttggagccatagtagaactgttgaggactggtataggaaatgtgttggagagttagtgtagctgagaaacacaaaaggaacctcgtttcctttgagtgaagaagccacaggtgtgtggttggggaattcagaagcctgtgcctaaggtggaaatagtagacttaaaaccacagtgcttgaagcacagccaataaatgaggatcaactctctttattccagacaggattgaacatcttctctcaaatgaaacaactttaatacaaaattacccttatcatagaaagatggattaattggtctattagaaaaataaagaacacccctgagtagacagacctttgatttctgtagcaactgggtcatgtccaaaagttctttattaaatgtatagcctgagtggtttccttgaataatatgtcgagtgggaattaattgcacaatgtattaattatgggaatatagcctacaaatgtagtcagtcatgtaaacctttatagttgttcatctgggattttaaaaactttcaaatgtgaaaaggaatcatgaatctacccccacataaaatagggaatggtaggagaaaaatcaattcccatttttaaagaccttttaaaaagtggagaatggcaagcattcatgattgttaccctaaaggttcttattgacacaggctaatataaattgagcaaaaaggttttgttcatctttacatctcaccatagctaatggttctaactcatgaaatcagttattaataattaaaattaattttaaaagacagtagataattgactttgaagacatcactttttaaagtgccaccatacttcatgtttctcagctcctcctggttaaaacaaaagctattatagacccttaaacagggccctagagtgtgaggaaaggtcagaaaaatgctgccttatgaaatgagagccaaggaggatcatcataaaatggatgaaaatgttcacctacagaaatcttcctagaagtgactcttcagaagaaaggttttgaaaatgtttccgattaaaaacatagctccctgttcatccaggactccaaagtggctctccaaaagtaatccaaaacaaatacccacagcacaactagagaaagcaggtgctaattttggaactgtaatagtaatatatgttataacagacaattttgatgattgacaagagatactgaaaaagatgagttcaacagctaaaaagtcttcagcattctttccaggggagaagacattctgattttagaaaactgatcttgcttatctaatcacaaatatccctacagtggaaaatggtgattcatcaatgttatagagttataaaaatatcctttaaagaacatcttagttcatatatctcaatctgttgcttatcgagccatatcataacatctttcttccatattattctatcttctttgaaagttctggcctattctccatttctactgttgaaattctgcccatccttcaaggttcaactcaagcatctccctcttgacacaaccatctctgatccccaatttttgccagagttctctgcattttttttataatggcagattctgctttctcagaattagcagtttcttcattcaattgtaaggcatttgctgtgtgcttgtattttgattcatatatatatatatatatatttttttttttttttttttttttgagacagagtcttgctctgtcgcacaggctggagtgcagtggcgcaatctcagctcactgcaagctccgcctcccgggttcacgccattcttctgcctcagcctcctgagtagctgggactacaagcgcctgccaccacgccctactaattttcttttttttttatttttagtagagactgggtttcactgtgttagccaggatggtctcgatctcctgaccttgtgatccatccgcctcggcctcccaaagtgctgggattacaggcgtgagccaccgtgcctgtccttgattcatatttttaacaaaagttcgtgagaatatatctgtcaaactcttttgctagatgctttatgttcactgaatcctcactgtgtcccccacatgcttgtatagtcccttatccactgtggacccttactaactttgcattgccatttaatatgaccagctgagaagattctcttatcaggaaggtgtgtccctgcaggtgaatggatccaggaaaatgggttcctattacattcattttaaataagtgagcttattggaatttgagtcatataagccaacttcccagagtgcaatcatctctggatgaaggggaaaacatagtatatctaaacttacaagttgatgcctagactgtggaatgtggggactccactaatgagtagctgttatgatgagacccatgaggcctctagaagctatactgtaccctttcttatatatattttccaaaagcatccaatttaaagaacaaaaaaactgccctgagatgatatgtgtattccaatacggcagaactcggcttagatgagaacgattcttgcacgctttccaaagaaatctcaaaatctgaaacgaaagctcaccaacttgattggggagaaattcaaaataaatcaacagctcaacagctcaacagctctttttttaagcagaccttactaactaggccttcataattacaacacagtgatattaagtagacaaacaaaagtagtttattcttatataaaggttaggctttcatttaaagtactatatggggaaagcaatctaaaacttttgaaaccaagggcacaaggaaacaaatttttttcaaagtgcttgcagagtcagactccagaaattaatttttatatgcaggtgtacctggataggcattttctattacatagtttgtactcaagatgaagtacattttctgctttgctttccattccttgcactctgaaaatttgtgacctagtaggggaataaactaatgattataatcgaatatgtgaaaatatagagatatggaggggttttggaagaatcaaagcagggcaagtacctcatttatagagggaaggggaaatgtgaaggcttcctggaagaggtgatgccaaaatcataggaaagtagaaaagtagaaggcagctaggcaagaggatgagaaggcttttcaagcagaagattaaaaaatgaaagtgtgggagtgaaatgacatgagaatgatgggaaatttattgcagctggagaataaaagatgaggcaatatacagtaagagatgaaatagaggtatggaccaggtccatatttatggggactttatgcctttcatttaaggatccgtactttatggggcaagagagacactcaagagtttcagtcaggagagcaatttagttaaacctgtttcatatggctcacttcagtggcaaggtagagaatgagagcaacaaccctgtggacagggaaatgtttgcattagcaccagagagagatgatgagggctgactgggaggagaaaactgatctaggaaacagtgagcaagtaaaaacaaaagaaccactcaactgcttgcatgtggagcttaggaggaggagaggaattctgtgagtctaatgggctgagtagatgttgatggcagatgctaagacagccttcaggagaaacaggtagacaatgagtagagcttttcacctgagaagtgtgggggacttctggctataagcagccacagggtacttggatgccgggggttgaagccctgggaagcacttcatgctgggatgtggattattaagcagtttgtcagtgttctaatagctgaacccacgaaaagaaaaggacccagcagaagcaagaataaaaaatgagaaggtagagaatgggtctctggagaatattaccatttaaggaagaggagaaaaggagtctgcaaaagccacagaggaagaagatctagggagtgggaaggagctgaggaagaagacagatgtgaagaaatcagtccacagaatcaaacaattgcattaaagagtaacactagatgagtatgtgcatatatgtgtatgtatacacatatgattctgtttttgtggatcaagatagtatctgagcacaagtttatactgcctcacccctaaaattctatttaatgatacaaaagaattagaagaaaaaaatcagaattactgaaaagaaaatgtcattttattagtgttttttaaatgatggaagaatttctggaagacagcagatgggatctggtttagagggaaacagaacttgaagaaaggacaaaaacaaatataagaaactgcagcaaatgtcagcagggttttgaggaaactgcatgaaatgcaggataaaaggatatacacatggatgggaattaaggggcattctccaagggctgaaatctgagggagctttgcttggcagtgctcctctcctgcctatgctctgtattggggaggaacagcacagttcaaggttaacacaagagctgtggctgctgatccagagaggcagagagggatgaaggataacttcactttgtattctctatagtcctgagctgtttctttcatgttgagaatgtatttgtgtattacctgaatgaattgttgaaatagaaatagtctttcggattcaactggaaatgcagaagggcttggtgaccttgacaagaacaataaaagggaaggaggctgcagccaatgttgctttgcgacatgaatgaaaggtgacaaaatagaaaaagcaagggtaaaatcttggggaaattaacataagttggagagagatggagagaaatcaaattcttgggaaggacaggaggtagagacaggaagtacagaagatcaggggtacaattggaagatgggagtagaaaaaaacaattgtgcatgatggtcttttcttggggaagaatgggacatgattatctgccttagacagtggcaatcaaaggctgtaaaaaggacctaaacagaaaaatctgaaaaaatccactacctggcacagtggctcatgcctgttatcccaacactttgaaaggctgaagtgggaagattgcttgagccaggagttcaagatcagcctgggcaacacattgaaagcccatctttacaaaaaatacaaaaattagccaggtgtggtgacatgcacctatattcccagctactcagaaggctgaggtgggaggatcgcttgagcatgggaggctgaggctgcagtgagccatgatcacacccctgcactccagcctaggtgacagagtgagaccctgtatcaaaaacaaaaaaaaatccaagaacaaattaaaggactgatagcaatgaacaagaggatctagctgaggttaaaaaccacagataggtggtgtgcccaattcgcagagtaaaattttctccagcaggtctgagttacttgagtgtagcaactgtaaaggctggtttgtcagagccatccaggttgggttttggttaggccaatgaaggagtaggatactaggacacagaggatgctggtgacaataaactgatcagaagatccaccttagctccttgcatggtgacgattcctatctcttagcccagaaaagactgatctggagagagtggaagcctcaagagcatacaggatcctgacgcagcccaagggcagagggtgggcatgaaggggcagcatgcagatgttattcctctgctttaaatagccagaagcaacacaagtaccctgtcccttctcttcttcttagaaagaatatttagcaaaagaataaagaaattcatagtccataagccaggccaaatcaacagactaacaaaaaatgaagcacttctgaccgggcatggtggctcacacctataatccctgcactttgggaggccgaggcaggcggatctcctgaggtcaggagatcgagactagcctgactaacatggtgaaaccccgtctccaataaaaatagaaaaattagctgggtgtggtggcgggcacctgtaatcccagctactcaggaggctgaggcaggagaatcacttgatcctgggaggcagaggttgcggtgagccaaaatggtgccactgcactccagcctgggtgacagagggagactctgtctcaaataaaaaagaaaaaaaaagaaggcacctctttctttcttatgacctgatcgtttcttaattattctcaccagtttccagtggccatggatcatctatgctgtgctaagtgctgttttattgagcatgttttcccaaagatgaggctgaagtctgccatgcagagagaagtcagctgccactctggcaggctctcagctgcctgggtcattaaatgacttcttatccatgggttaatgtcccgaaggacaaccgaggacatgtctttcaagagcagaggttttcgtgatattttaccgtattgtgcttctaagtatgagacaactggccaggcaaggagatgtccctaaattctcttgcatctgtgggcagaggaggggaagggtcactgcactcagggacaagagaaggggtgggccaagtggtggccctgcggatcctttgtttcagggtagtgacaagcatagatggccacttgacacttgacagctctccagcactgccatactctagagacagtagcactttctctcaacatggctatgaacatctctgttcctggatgccaagccactcagctgcaggctggggcagtgcctggatctctctctggacctctggggagggaaatgaagtatggcaggaacaaaaataaagatacaacaaatggaggcaatttcacttcttccccctaggagagaaagtgaaaagatagagaaaccaaaggagacttggactaattcaagtttccgtttgtattctggtagatgctaacttaccatatgatctcccagaagtggaagtgaggacaggtaacccaaagccctttctgtcctggttgcctgaatagtctctgacatgtacttcttaggctgactaatagccgtataaaggagttgggcataaacctggagggtcccaggagagacaatctcaagtggattcctcagatagtttgtttcaggctgtggggctgggaatgtcctccagtgtaaaggctgacagaacaccatctggttttgagtctggtttactcagttgatttattttttcaagcattttttttccagaagatacggtatcataggaaaatatattttgctgtcattcctcttggacctaaatgagcatgctattttttcaacctaagtgcttagattttatgtagttacatttgcttgtatacattcacttcattccatatagaatttgaggttgctcataaaaaaagaagtaaaaaataagaccaaaaaaagtgcaaaaagtatgccagtcaaaaggtctagaaagtagatacatgaagttacatgcaattccaagtatagtagtttttgggaaattagaggctgagttttgaaactcacaagcaagtgaaaatggtcagggaagttaaaaaaaaaagagaaagtactaaatcagagacaataaaaaaatccttaattaaaagtatgttgtggtgaacgactagacagatcagtagaaacagtcaataaacacctaaatacacatggaatgcagtagatggcaaaggtggtatatgaagtctatggggaaacaaatgatgctgggacaataggttgccatgcagaaaaagataaaattagatcacgtgttaatttctaaatggcccaaagacttaaatttataaaacaaaaccataaaagtaatgggaggaaacatttaactttatagtggaaaaggcttttgtagcaatgattcaaaattcagaagccataagagaaaggaacattaataaatgagactccataaatccatgtggaaaaaaacaagtaatgtcaagtgacaagtaacaaactgggaatatacaggtaagatgtgataacacaaagagcttaatcccctaatttaccaattaggaaaaagccaagacaagagttcaaattatgttgaaaacttaattaacacttatatgacaaacattacatttactcaatctttaacctcataaagacagaaaataaattagcatctattttcttttctcacatggctaattagtatatgaaatagaatccaagagagatccaccatgcaaacagaaaccataatgtaggttctgttaccatctccattttatcaccaggaacctgagacacagagaggtgaagtaacttgcccaaggtcacacagcttagaagggacagagccagtattcaaatccagatagtgtggctccagacattttgcttatattcaccaagtcctacagcaaaaaccatgggcagccaattatagaaaataaaaacataacatgaagcgatgctaaaacccccatatactaaatcaacacaaaactacaatgagattttatcattttctctgtccttcaaagcttcctgaaacatctgcactgtctaggaaggcagctatttgagctgcatgaaggcaagaggttaggtccaggaaggttaggattctatgtaaggtgtcacagcttgaggggaatggccccaaataaatgtaacccagcttgcctttcctcccattacaaaagtaataatgcagaaaatacatgattatgtttatccttgagggaaaaaaatctatttagactgacggtacttcaaaattaccccataaactgcaaatatatttctgaaatgaaataacatctggaaaaggaatttaaagtggtatctttggttgcctgtcagaatacggcaatgtgagaatagtcattttcaccttttctgagatatgtctttgctaaagacaggaaataaagtagcttctattttctcttctcatggcattggcagatggaaaaaggatacatcatgaagggtccatgagaaaagaaaccatcctgaggaaagggtttgctcattttatacgttgcggtgaagtcacagttactgctgatcatgggaagtaggtttataaagggaaaatgaaatccatagagaatactaggatcactctctctccaccccgcaggattattcttaatccaatgcttcaatctcctgtcattgctgctttactcagaagctcccacacagaaaacacaatgatttgcaattatgttccttttcctcagaattagatggaatccttcgcaagcagtgaagtgaccacactgataatggtgagcaaggggaaagcagcagtacatttcaggagtactgagtgcaggaaaacttgactaatctatgatgtggttaccgaggtgaaaatgtgtcagatccttgctaactttgaaagttggccgcctcatccaagaagctgtctttgacccatgatgcagttataacagctgcattatggatcatctgaaacactttggaataaaaatatttgtgacaggccgggtgaagtggctcacgcctgtaatcccagcactttgggaggccaaggcctctacttggtatggagggcaatttaaaactttcaaattgtctacttcttgaattttccatttaacaatttcagactgtggttaactggataaataaaacaatggaaagggaaactgtggataaatggaaacaactgtagtctcaacttaatatttttaagatcttcaaaatattctgcaatttagagaaaagtgagatatctaaacaaatccaaggtgggcggatcacgaggtcaggacatcaagaccatcctggctaacacggtgaaaacccatctctactaaaaatacaaaaaattagctgggagtggtggtgcatacctgtagtcccagatactcaggaggctgagccaggagaatggcgtgaacctgggaggcggagctcgcagtgagccatgattgcaccactgcactccagcctgggcaacagagcaagactctgtctcaagataaaaacagaacaaaacaaaactgtgacaaaactatacagaaatgcttaaggaaaaagatgacaatcctgccattctttctaatttaatcatcttgataagtgtgaagtcttttgacagattctcagcacttgtgtgtgtatttgtgtgtgtatgtatacatatatatatatatctccacatattatcactatattatcattagtttaccagaatgagctcacaccatgcataccactccaaaacttgcttcttgcatttaacattatgaacattccttcacttaaatatcaaatacagtggtccccccttgtctgagggccatacattccaagacctccagtagatgcctgaaaccaaggatactaaacttgatatagactgtttttttttcctgtatatgcgtacctatgataaaacttaatttataaagaaagcacagtaagagattagcagcagtaagaattaaagtattagtaaatgattgagtaaaataaagatgactggactacaagcactatgatgccatggcagttgatcagatgactgagatggctacaaagtgactcacaggtggatagcatctgcagtgtggatatgctggacaaagggataattcacattctgggtaatacgaggcaggatggcgggagagtttatcactctacttggtatggagggcgatttaaaactttcaaattgtctatttcttgaattttccatttaacaatttcagactgtggttaactgggtaaataaaactatggaaagggaaactggataatggaaacaactgtagtctcaacttaatatttttaagatcttcaaaatattctgcaatttagagaaaagtgacatatctaaacataatccaacctttccatttctttctgaagaaattgctgcattaaaaatcattacatgtgcttttgtttttctatagaatagattctctcaagtggaattggtaggtcaagttttaatagcttttgctagatggcccaagaacaaataattcacatttccacaagcagggttttgagagagtgcaagtggtgccatattcagggcagcactggctgtcttcactaacttcattttgccaattggataagtgaaagacgttactgcattgttttagattatattgccatgactgtttaagaggctaaacatgttaaataagttttattgtccatttcaagttatgtttctgtgaattgcctgaaattttagtttgcttattctctctgttagattgtttccttttcctctttttaaatatgttgctatttgtattttaaggttattaacccttggtctgccaatcatatacattgcaaatatttttcgtttaactttgcttacactgattttagccgtatcaaacttatataactgtttatgtatatattcttctttatggcatctgcattttttgacttgcttttaaagatctattctgccactaggttatttagaaattattggaaaacttgtgaattgggactcagggtaatgaggaaataacttaatgagattatttattttagatatattaatagaaataacgtgatgatttgaaatgggactgtaatcataagagcaatggaagagtcccataacaattcaaactaaccgggttggaggaaggaaattaagatattgtgcaagtcagtaaatagttcatttaaaaatgagctattaaaatataaatataagatggaagggctaaaactgatgctgattgtcacaaatgtgggcaggtcaaatttcaatattaaaaaggcaaagactaacagattttgttaaataaatctatccatatgttacttgtgaaaatgcacataaagcaaagctacaaaaacatattaaaaatgaaaaggtgagaaaatagcctggggagagtcaaacaaaaaagatagagtaatattagtaccacataaagcagaattcaaggtcccaaacctgtccttggggtcagggagagaaaaagcaattggtgagagggtaccaaggtagccaggatgttaagaagttaagattctggagtgaagggaagagcaagaaagcaaggtaatactatgagctacctttctactcaggcagttgccagtttgttaaaggaacagattgagagaccgaatagctaaagagagttagcagtagtcttacgatgttgaggatatgaaacttgaagctcagagctcctcaaaatggagaacacgtcaggctttcatctgggatcatgaaaaaatacatcctaggtataaaggcaaactagaaatagactggcttttataagaaccttgccttaaataaactcaatcccttattggattaaggggaactgtgcttactttaactgctgttaatgctaaaagactccactctggagaaaggcagtatcaacaaaacacccaaacattttatttcagtgtccagtattcaattaaaaagaattaccaggcggccaggcgcagtggctcatgcctgtaatcccggcactttgggatgccgaggcgggcggatcatgaggtcagtagatcgagaccatcctggctaacatggtgaaaccccatctctactaaaaatacaaaaaaaaatttagccgggtgtggtggcgggcgcctgtagtcccagctacttgggaggctgaggcaggagaatggcgtgaacccaggaggtggagcttgcagtgagccgagatcgcgccactgcactccagcgggggcgacagagtgagactctgtctcaaaaaaaaaaaaaaaaaattatcaggcatacacagtactcaattaaaaaaattaccagacatatcaacagacagaatgaagagaaaaacaaccccaaaactcagaaaagagaaatccctaggtaatcccacaacccagaaaagagagatccagataacttgtgattaatatttaagaaaatagatgaaaacatggagaattattctaaaaacctggaatttataaagaattaaatgaaaaaatctagaactaaaagtgtaggaattaaaattaagaaaacaagagatgggtcttaggcagattagaagtagctgatgagaggactagtaacagaagaagaaaagtcagtaaagctatctcaagaaataaaaggagaaaaatgtacaaaatgtagaagtgtttaacactgcatgttctcactaatatgtgggagctgaatcgtgagaacacgtggacacatggtggggatcaacacacactggggcctgttggtggggggaggtgggagggagagcatcaggaagaataactaatggatgctgggcttaatacctgggtaatgggatgatctgtgcagcaaaccaccatggcacacgtttacccatgtaacaaacctgcacatcctgcacatgtacccctgaacttaaaagttgaagaacaaagcaaaaaaaaaaatgtagaagtgcttgagttataaagaacttaggtaaaaggtttagcatacatgagattggagtcccagacatgaggaagagagagaatggggcagaagcaatatttgaaaagatggtgaccaagagttttgtcaaagtggccaaagtcacaagtttaagaatcagtacatacaccatgcaggataaaaacagaaactaattcacaactaagtacatcatgataaagttgctaaaatagagacaaaacattctgaagcagcagggcgtggcacaaggtgatgtttctgaaggaataaaaataagactgacagctggattcttacaaacaaaaaatataagcctggaatgttggatttgccacctatgaagtgctgaaaaaaaaaaaagatgactgtcaacctagaattctatactgaacaaaaatgtgtttgaaatgaaagcaaaataaagatgcttaggataagaaaaacagaacaaacgacatgatattctagaggaaattcttcaggaatgaggaacccaggcaaaatcatgaaaatgaagaaagcaataaacagcaacaggggttaatatgtgagaaatagtgaatagaatggctataatgatgtcttatgggtttaaaaaagacatttagtaaatagggaaaaacccaaaagacaacagggatagatggagctaaaaggttctaaagtttttgcactatccgagaagtgttacaagtaataatttgttttagactctaaggtcaataaggaatgttgtaatcattgaagtaatttaaaacaatggataacaagctcataaaggggaatgatgaattgacaattcttgattagtccaaaagaaggtaagaatgaaaagaaactagaatatagaacaaataagaaaatagcaaattgtaagataacagatttaaacccaaatatgagttaacattatatgtaaaaggactaaatactccaactaaaagacaaagatggggttaaaaacaaaactttatatgctgcttacaggctaacactttaaagtcacaaaaggtttgaaagtaacaggatgaaataagatatatccaaaaatgataatcaaaagaaaattaacgtagctatactaagatcaaatagattttaaatcaagaagcatcactagatataaagtgggacagttaatgataaaagaatcaatgtaaaggttaaaatttgtatgcagctaataacccatgaaggtatagaaaatgtaaatgcaataactatagaagttagaaatgtaacttaaaatactatttaaaaaggagccaggatgaagagatttggaaccaagttctacataacctctcaaaaacatgtaatttctacttaaagacttcaagacttagggaaagtggaaacttctctatcatttaataaagctagaaaaagaaaacttgtaagaatcataaaccaaccaactttgtcatacaaactcaatattccaggaatgtaagacagtattacatttagaaatttaccaagagagtgaacatatcaatagcttgaagagaaaatatcaattgagtctaaaaaaagctttagttactagtagaagcaaacaagttagatcatattttaaaattccagctagactaaggatctaaattaaaagaaaccacacacaaagcaaacaaaaaactaaacccaaagcaaaataatcaaaacagaaacactagaagaaaactcaagagaatatttgtgctgagtctctgtaggtccttcattagatctgcctttttcctttttacattttccgcttgccccctcctcagggcacacacctcagacttctagtatagattctatgtaacttttttttattcttttgtttccttgtcttctcctaccttactgtgagagatctttgaatgcatatctttttcatcttggtctatacagtgccaaacacatagtagatgcacattacaagactggtcaaatgtgggggcagtggctcatgactgtaatcccagcactttgggaggccaaggtagggggatcacctgaggtcgggagttcgagactagcctgaccaacatggagaaaccttgtctctactaaaaatgcaaaattagccgggcgtggtggcacatgcctgtaatcccagctactcaggaggctgaggcaggagaatagcttgaatgcgggaggcggaggttgcggtgagccaagatagcaccattgcactccagcctgggcaacaagagcgaaacttcatctcaaaaagactggccaagtggatggatgaatgatccctgcctggcaccaccacaatcattccagcctgcctgcctcctgtggtgatagtctgcctctggctctttctggctatcttttgtgcagtggaaagagcatgggctttggactcagattgacccatattgactcctgattataagtgatatcatcctgtgcaactgagttctctgaagctgattttctttaaggggctttgtatactactgggtccgtactcagtgctcagaaactgttaccttactactggtgttatcatgaagcctgaatgagatgggggagtcagtgtggctgaggaaaagatggttgaccttcccagcatttgtctcaccaatggcacagtatattggggtaaaactatggacagtgtatcagggtaaaaataaatagcttcatttgctccctctgcattaatcttgattctcctacttatcacgctgaccaccctgaaaacctgtctcagtggtcttcaactctgactgccccttagaatcacctggcctcaccctaggcaattaaatcagaatgttcccaggggcattttatgtgtaattgggattgagtggttactggcccttcactttcttgctcttagtagaatgagtccaacttgcacagtcccagaaactacaagcattttctaggagcaaaaactgtttcctaaggaaggtacagaaagaacagggcatggtgctggaagtttagagtcctagtcctgctgcaagttggagacatgatccagtaagccacaatacctctgtattctggtttcctcatttatcaaataagcaccatagaatcttctatctcaaacggtaatgggaaatttaaaataggaagtaggtaagactttttaaacatttgaaagtgacacaagtgtgatttgttagtgtttccatcagatgttcccatcagaattcaataaaatccttgttgtgctacttactggctgtggggctttgcacagctcattttgctttttgaatcccagtttttcctcatctataagatggagctacttactcttcaaattgcataatagttcccattgctagcagcaaagaaaacaatgggaactaaaatacacaagatatagtattattgtgttggctcttattattggtactattattccaatgctgtggataagctcactcaagcccttgatttcaagcggtggaatctcatagtctctcatattagcggatgctggcactggcgtggccataaacaggtgcaacactcctgcctgctaagcttttggattttaaaatgaatgtcagagaatctttggttaccaaccaagctgctgaggttgacaggtacaattcacttcactgcctgagacccgcccccttagcttccattacctgggcttttctgactattaggtgtgtgacagaagatcaatactggcgagagatgaatatatgtaatcaacctaacagaagcaagttgaaatcctttggtgtgtggtatcataaaaggaggaaggtcaatagggacactgggtcggactgaaaagcagccttgccccaaagcaaatcctggcactttcctctggcccaccttttccctccaagctacagcacatggtacctttctctagagcccagaggctttatgttctctagcaaagtggtctgcatccttacgttgatcataagttcagtgattataaaagttgaggtctttgggaaacccaagaattagagtcgtggacttgaaagtaagaaatagggaaaacagcacagttatttctgactttttggctctactgtttatagttttgcctgtgcaaagcaatacaaattcatgttgtcagccagtgacataaacagatttttctttcctgaagcgaatctgataattatgatgttgtaacatatcttgcaccacccaaaacagtagattgaggatgtcaggtttcagtacaacaaaatggaacaagtcttttcagaaagcacgaactgtcatttcaaatgagactctgaaatatgttgccacttacctactgatatggtccaaacagcaatgattttcagaaatgccttagttctggagttgaagcggctgtggtggatgggattctggatggcgacgtagcggtccagcgagatggcgcagaggtgcatgatggaggccgtggagaagagcacgtccaggtaaatccagactgcacaaagcttgctcggcagaggccaccggtaccctatgaggcagaaggttggtgtcagtgagcaaccctgtgcctcctggagcacatgtatccctatcctatgacaatttccagctctgggacaggcacaggtggtggcaaagggcaacacaatatatttttagtatttgaaaaaagcccactggcaactgtacttaactatgataagctagcactggctgatgaatgcagggtttgaaaatttctagtgtctggagttatgtgagtgtggcacggtaagcttggatggtctctatttgggggttctctttcttcccccttacgcctggcaaaacatttcttttgttaatggcttatgtcaaaatttgtgttttggctcctcttctggagcacctctcacactgtactgtcaggatttagtcacatatttctctggattgtatttccctaaggttagtctcacctcttagtcattattataaccatccagtcccatacagtgatggcaataaattgcattagtgcaaatgactaaatgactaaaaattcagattgtgaatatgtctgtttgtaaaaatgaaaaataatgatctaataatgctttgggtgccaaactcaaatttggggtatgtgtagggagagctgaagacaagggtgaagaaaaataaagaaaggtgtccttgctctgagctttgttttagggaggcatttctcaaactttagtgagcatcagactctgccacacctcttaaaacacacactgctggacctccgtccagaggttctgatgcagttagtagggagcaggctgtagaatttgcatctgaattagcaagctcccgggtgatgctgatgctgctggtccagggaccacgctttgtgaatagctgctttagggtagtggctctcacccctggctgcacatcagtatcagctggagagctttagagaaggtcctgatgcccatgccaaacccagcccaattaaatcatgtttggagggtgggctgaggtggacatcaaatgtcaaagcgtttgcaaagctttttccaagctccccagacaattccaatgtaagagatactgcaggtcacctgctatatgaggaaggttagagtgtgctttatggacataaacaaagtgtcctggttttgtgttttggagggggattaagcagttatgtaaaccttaattagttttgatcacagtataagcagcggagttagatctgcctgcatgtaagaaggaaaattttaaagtccacttttcttattacagacccacaaagccgaacaaactccaacgcaaacgtacactctctaccaaaatgccacaagggatatttagacaagtaaagggcgtaggtacaagcctaatttacagccattcacatgtattatttgcaaagagcttgagccgaaaggaaagccttttcctttgcagcgccttatgggggaagccacgctctgtctgttcggaacagatgtcggccctcggaggggtttctctgccaggaggcggcccaggcctcagtccgtgtttctgatgcgggataaggagggggcatttccttgtgggagaagccccatgccccacgccccgtgggctgggggaggctggaggagcagcctagggaggggcggggctccggagggaacgggctgctctcagagcggcggccgccagggggcgcccttgctccccaagcgggtgacgccgggggtcaccccaccctccagcctctgttttgggtcccgctctgtcactcctcctacccccactggagtttgccccctaggggagggggtttgggaagcgagaatcttccccgggatgccggggaaagggcaggcaaattaaatgaaatcattccggtgtggcatttaaatggtcaagtgaaggctggacttggaatgagtgttactagctttgtgcaaactggcgcctgctcgcccttgcgtaccgccttcctccttcacattctctagggctgggttgatgttttttaatcttagcccctaagacttgaccagaaaatttccctttaaagatagctatcataacctgtctctaagctctgagtgactgctgcttgtgcctgtgtcagcagtcacaatagtctctcctttaaggaggtatctggctgtattactcataatttggaaagaatatcacattctggtcccttgctgagaggtctgactgtttcaaactctgttgagaagaaagcaagattaatcccttcccatttgtttcccaccctcctccaaaccagactggaggagtttatgcatatgcattttcaaagagttgaggatataattcaaaggcacatttccaaattagcttctctgggcagggaacaattaaaactggagtaattcatttattctaattgaggttctgcatattttaacataaaacctattgcaccactaatgttctctctgcaaatgttccaaagtaattgggaaggctttatcactccattaaaagtgctgaaaactgtgtgacaaagattaaaactgttctgtcctgaaggctggaatattggttgggaatataaagaagcaaaaatcaagtagattcagaatgatgggtaagttattggtttatgactgtatggggtaatttataaaaatttctacattaaatgtacatgttttgaagcacaaaactctccaatgatcatttttacacaggatgtacgcgttttgaagcacaaaactctccagtgatcacaggtcatagactgtctgatttttatgtgaaatcccattttaagagtaaaatataagtaacatagtaggctctagtctataaacaaagacttctatttatagtttgtttgccccctgagccccatctcatctgctggtggcatgcacatgctctttattaccagtgcgaatatagctgggaaactaatgccactcaccatacaggatggttaacatggacacgggcatgacaaggaaacccagcagcatatcagctatggcaagtgacatcaggaaatagttggtggcattctgcagctttttctctagggacactgccatgatgacgagtatgtttccagcaatagttagaataatcactacggctgtcagtaaagcagaccagtttttttcctggagatgaagtaaggagagacacgacggtgagaggcacccttcacaggaaaggttggttcgattttcagagtcgactgtccagttaaatgcatcagaagtgttagcttctccggagttaaagtcattactgtagagcctggtgtcatcatttaattgcattagggagttcgtagttgagctcaaagaagtattttcttcacaaagaatatccatgtctaagccagaacttgtagcagatgaggtgtagaaggactaacaggttatagtttctgctcaccattcaccttgatgtacccacactctgtaacactgaggctggtgtacatgctgttctcccggggctggatttttgtcttccattattacaatgatagttaaagaactgaactgtggtggctgtaagttttcttcattcacaattttaggagagtccactgtttggttttattattttctcaccaaaccgaggacaaaaaagcagaatgaacttttagcatagaggttgcagggttttttttgagcgctcgggaagataaatgtcctggacaaagaagaaaagttttataactactgggactcttgtttaactatatctcattttgttggttatgccgatggtactagtttagcaacagtattattaaaatagcatgcaatcagaaacagtggggatgtacacattctacattaagaaagtcaattaaaaatacatccagtgttaatcccatagtaattggatgtactttgggttacagttctcagccattcttaagctgaattgccacagctgctgtcaggaatttcagctcctataatgttgcttagctaataaaaggaaaacaaaaaagtcttaagtaaagattagcagacaactttcctccctggaaattctcattgaaatgattacatgttggccaagcatgatttcaaaccggaaagaaaattacacagcaataaaatatagcggcatgagaacttacatttgtcttcagggtccacacatgagatacatttgttattctgtgactcgctgcatctctcacagtaattaaactggtgtagagtcccctcttcttgatcttccaccagcataatatgatagtaatttggtttctgttttgctgacttcaaaaactgcatgcaagagctgagccagctcccgcactgctaggatcctgttggcttcctctggcacggctcggctgggttcctccctccctgtgcggctcgcctcagcaggcacacatttagaaatcattcacgagcccctcaaagtcgcacaaaagaactgcatgggaaagtaggaagagctgtctgcaccaagggactcctggtttccacgggaatggagtagctctctgactgtctcgttcatttcatcag

SEQ ID NO: 1755 - DNA, 65535 bp, Homo sapiens; identical to SEQ ID NO: 1754

SEQ ID NO: 1756 - DNA, 24828 bp, Homo sapiens
cgagagcctgaattcactgtcagctttgaacactgaacgcgaggactgttaactgtttctggcaaacatgaagtcaggcctctggtatttctttctcttctgcttgcgcattaaagttttaacaggtaagtggtgtattgaatatttcttattaagttataattcaagtaaacattaagaaaaagcaaaggtagaaaaattacgcacccaaaagacagtggttttggtttttgaaagtaggaatagtttcaggatatggccaagggcaccatgtcactcatgtcactgtggatggcattgagtttgcattgctgcctttgatactgtgtcttgagatgaaaaacatgtttcatcagaccattaaatttttaaattacctgcttggagttacctgtcagtggataaactagcagagtggcttactgttcttagagaaagatgaaaggcaaaatgacttgtgtcaacagaatgaaaattaaatagctctggcatttggactgggaattctttctgtggtagaaaataaaatgggaagtctttgaaaagaaggattttgattttaatcttacctggatgatctgttatctgaaatgtccagggcaccatagagtttttattgacactaagtatcagagttcaccctaaaaagccaaggaggaaaggataatgtaaaaatacttcctagcccctgtagaccttacaaaaaagatcattctggagtccctgattccttctcttgaatggcatatagcagactctatatggacaatttaaataatgctacatacaatgtaagttaatacacgtgtttctgctgctttttactgtatataatttgtactacttttgttttctctttcacactgagccctattcttgaggttgaaaaaaggaaagttaagtaatattaaataacttaaataatcaaataaactaaaagtgaaggcagaacttttagtaggtatgatcctatctagggatacattttttcagtggcaaaaaaatagaccttactgttcttacaaaaaatgaaaaaaaaatgaaatcaaattgatcaaatgtttcatcttgtgctggctcaaagtgagttaagtgcagttaagaggattgaggaatgtagaatgagcacaaggacagttttgggctacttgctggtttatgccttttctagaatctcatgaagtcctttagcggcatgaatgacatgagcagctttggaatttatattcattcttcattcatccatttactcatgtagcattgagcacctgcctggtagcaggtactgtgccagatggtgtatgtacaaggatgagcaaaaccaggtcaacccctgttctttggaaggtaactgcatggtagagagagatatattaatcaaataatcccattgattaatgataattacaggcaaaactcaattatatgagggaatgtaacaaggagcttgactagactgggtgggtgtggaggtgtagctgaggagcagggttcattgaagtctttcctgtgcaagtggcacttgagcggagatttcaaggacaaggtagcaatcaatggggagaacggtatgaaggtagggaagaacgttccataccatggaaggaacaagtgcaaagagcctgtggcaggaaggaatgaggtaaggttagggaactagaagaaagcagacagatgtgcctgagcacaaagagggaagaggctgagcttggtccaagatgaccaactggtccaagttggtccaaggtgaggctggaaaggaaagtagaggccagaccattcagaccatatagtctatgttccagattttggatattcttccaagaacgttggtaccattcgtggaagggtttgtttgtattgataaaaatcattcaactaggccaaaccaatttgggcagttctggttgtggtattatgctcaggagaattaaagtagcatcggtgtcaattctgtggaaggtgagatccagccttaggtaggattgttttaagtttccagattaagctgacgaataatttgtattctggaacaatattcatcgtagattctaaatgaatacaaccaatgttcactctcattataaagaaagccatgagatgtggcatgctgtttggcatgtggcaaacctgaggcacgagtggctaaatggtaacaataaatctgctagcaatgatcctatttaaaatatctccacaatgcatgtatccagaaactgccatgtaaaagctctaaagaaaaagagccaaactcaagtaaactaagtacttgcttgtcctctgttgtattttcaatcctcccaatttacataggctttctcatgccatgaagatgtaggcattcttacctttagtcagtgtttgaagaatttccaaccaggaaaggttaagtgatttgttacacagtagttggtggcagaaccaaagttagaactctaatgtgactccaacatctacattctttctaaactgtgttgaagtagtggaggtgtaacataaatctaaaggaacgtaaatctcaatgattctgatcacctttgttatttggttgtgaattaagaaggatgggaatcttgctgatttctagtctttgatggatctcaatgtagaatttaacaaagtcttgtttttttttaatgaacttggagcaataggacacttttaattataaaaatatctacgaaaaatgtgaatgtctaactacattttgaagaccctctttgtagaccttataggcaacagggaccatatgagtgatgggacaaattctggttttagaaagactactttaaaagcagtgtggataatacaccagattgggaagggctgatggcagagggtgtctaataaacgtgcatgtattatgatgtgttctgtgaggaagctgggaggatagccctcaaggccactttgagccttcctttgtcactgaggcattccattagtgactcctgaattccacttgggaaaagagcccctcagtgtctccagcgtctgagagaagtctgtgaagatgactgaccttggagcccctcttagcctctccacgactgagtaaatgtcatctcctgacagcacccccttccagagtgttcttgttagatttaacaaaaatcccagttgtcaattttttcttttgatagatgaattcaggccattcccagtcagcataagcctctacttgattttatttctatgtttatttactacttatttttctttgttgtatcctctttttctcttttatttttgttggtgtgatgaaatttcttttgactctcctctttgcctccggttaatttggaaggtcgactacagttcttaatttactaagtaattgacatgttcaaagaatcttaattgaatgtctacttgtttatcattgtatgaaaataatgaaaatgcctttgtctgatgtgcctagtccccatcccctgcactgatatgagaacttaagaatgttcttcctttcccactctcacacttcccccagacagtgcaccctgctccatacgtgggttttgtggaaataatttaaaacttacagttgcagatcattgctaggtttcctcttacagtatttctcttctgtttcaagaatcctttcttaacacttacatcacatacgttcaatgacaacatcattctggacatctgctcctgtcttgtgatctctgttctaatctaatgatcagaagacttctcttattttcgttaaatacccccaactctctgaattccagtacaggtaagggtgtcttccttttaccttgatgagtgactgatatctttcctgggaataggagtcctggatggcagcctttcttcttagtggttgcagatattcctccactgtctgctggcttctagggttgtgggtgaagagtttgatggtagtctaactctcattcctttgtaaaaaaaaaaaaaactctagaatttcataatcttgaaagctatttacttcagtattggaattcaggaattcctccaggatatgtgtaactctctccctctgtttctctttctgtgtgtttctattaattttttttttgaggcggagtctcactctgtcgcccaggctggagtgcagtggcgcaatctcggcttactgcaacctccacctcccgggttgaagcgattctcctgcctcagcctcccaagtaggtgagactacaggcacccgccaccacgcctggctaatttttttgtatttttcgtagagacggggtttcaccgtgttagccaggatggtctcaatttcctgacctcgtgatccgcccacctccgcctccgcctccgcctcccaaagtgctgggattacaggcgtgagccaccgcgccccgctgttctattaatttattattattttttttaagactgggtgaaagttttcaatctctagactcaagctttattcttcatttcagtcatttttttcctagtatttgtttaatcataccttatgctgtttttccccactctttctagaaatgtctcttattcttatgtaagatcttgagtcccttattttttcatcatttgtgaacaaaatggctttcacaacttgctgttgcttgttaaccacaactccttcagatgaaatggatatttcagttttaagttactagtagcatattcccatttcttggtagaaacaaaatgcaggcatgtaggggggactgaaattcttatatttactcactgtaagattcatagcattatttggcttaaaaaaattcatcccagtattcacagttgtaaacagcaaaatctacaacatatactgcttccctactctaagaatattgagttttatatgcaaaatgacttactgggctttgcaaatttttaaaaatgagttttaaaatcatttgtagcttgcaataactgaagaaaagatcacaatttctctgtaaatggcatctcagtactactgctgttctaataaactaggtctgtcaaatggcactttttggtcattcaaagtgaaaaaaacatggcatttgaaaccttataaaaattcacaattatattttggaaagtggaacttaagtatgtaggggatatgtcacacaaattgaaagtgttagtcaagaaatgattttttttttcaatagtttggcctgtaaggttgaccaaaacaggtaaagatttgcaagtttagagagtcagaaactggggatatgaacttccttctggttcatgtataacataatgatgcttgtatctactttgcttgaggaaaaaaaagaaacacgttgtccccaaatagggtgatagaccaggagtttccatccagttgaccacgagtgttgttaggatctgtttatttgagtcatgttgacacagacacagcactttcaataagcaattaatgatcatttaaaggtaacttttttgaatttgataaatagattttttttacagcctgtatttgtgttcttctaggactttgcaacaaagaatctgtacatgcaaaaacaacaataacaacaacaagctgtctactgcactcacagttaaagttctgtttactttgcactatctaggactaatgcaaaaatctcatagatgtgcctatttgcacttatttaattatgatgaaatttacttctatatgtgaatccatttctgtacatttctacaggcagataagtgatgggaaaatcattaagaatttagacttcatcagagaagaacccaggtacaatgacagcccagcttaatacatgatggctgatgaatgaaaatgtctagggaaatgagtgtgttatgtacaatgtaatttcatatctaagtcactttaaaataattttttgatatataataaccctttcaatcacagaacacatatgtggcaccaatgtgaatactactttaagtattaaggtgataatatatccaatatacctagaaggaaaataaatacctgaaattcattttcatatctagcttaatgttaaaagcttctttttgtttttttatttcgtagcaaatctctttagctctgatgctttagtttctgtacaatgagaggattggactagattattaggtgaagagattaagtaagtgtgtgtaccctggtgtcaaattatcttattcttttttctttgtttttgttggactgggttaattcgaagaccttgtcttcaagctctgaatttctttcttctagttgttcaattctattgctgagactttccagagcatttcacctttctaaaattgtgtccaaagtttcctgaaatttttattgttttttctttaagctatctatttccttgaatatttctgccttcacttcttgtatcattttttgcatttccttgcattgggcttcacctttctctggtccctccccgattagcttaataactaacctcctgaattctttttcaggtagatgaagaatttcttcttggtttggatccattgctggtgaactagtgtgattttttgggggtgttgaagagccttgttttgtcatattaccagagttggttttctggttccttctcatttgggtaggtgctgtcagaggggaggtctagggctgaaggctgttcttcagattttttttttgtcccatggagtgttcccttgatatcatactttccccttttcctatgtatgtggcttccagtgagccaaactgcagtgattgttgtctctcttctgggtctagccacccagcaaatctacccggctctgggctggtattgggggttgtctgcacagattcctgtgatgtgaaccatctatgggtctctcagccatggataccagtgctgttctggtggaggtggcgaagggtgcaatggactccatgagggcctttagctttggtggtttaatgctctatttttgtgctggttggcctcctgccaggaggtggcgctttccagaaagcatcagctgtaatagtatagagagggtctggtggtgggtggggccctagaactcccaggattatatgccctttgtgttctgctaaccagggtgggtagggaagggcagggctaggcatgtctgagctcagactctccttgggcaggtcttgctgtggctgctgtgggggatgtgggtgagattcccaggtcactggagttgtgtacctaggaggattatggctgcctctgctgagtcatgcaggttgtcagggaagtgggggaaaaccggcagtcacaggtctcatccagatcccatgcaaacggaagggctggtctcactctaatcatgcctcctctaaccgccccaagtctgtttccaggcaaagggcaagactggcttgaaaacttgcctgaggctttctgcctcccagctgtgaaagaaaagggctttagtttttcccctgcatgtgaaatctgcatgctggattcacggcctccccccagttcaggccaggagacttcttgccctgttcaaatagttacaaagttcagctagagaattccttctccctgtggagttttataccctgctcctctggccaccctccagatggatccctgtggtgcctggcaagaatgggctgcttggggacccattgagctcccagagcctttctgcagcttcctctacccctgtattttgctccgtttggctctctaacttgactcacctccagataaagtcggaaacttctccacaaacagacgctcagcttctccggtcagagtgtgtgtttgggagaggagggtctccctttcccgtgagtcttttctttttgactgggaaataagtatctcccaatcttcagtaaataggatctttgctctccttttcccactcctcttcttggcccattacaaagatatttaccaaacatgcttagcctttatattcttctgttaatattaattcttttatttaatatgattgagcttccactatgttcaaggtcctgggattttttaggcaactgtaatgcagtccttatctttgtggagctcatggttaaatgaggaagacagacaaaaataattatgatccaagatgctatgtgctaaaatatactggcctaaacaaagtattattgggagcatagaaataagagtctttgtctggtggtcttggaaataaatatctcaagagagaagttgacatttaaaatggttcttgaagagtgaatgagaatttcttctcagattaaggggtaatcaaatattttagttcatggtaacagaaataatgaaatgtgaagcatattctagtagtaaagaacagaagtgtgaaagaaatggccaaaaagttcagtgtggcttcaatagatggcctatgagattgtgaaagcattttgtgtcaagccagatatatatattttaaaacaccttataagcaatagaacactaatagagacttttaaactggggagtgaaatgcttttctgaaacataattttgggagcagcatggaggagggatggggaggagagagatcagtattgagaaggccagtcaagaggatgcttccacagataagggaagacatgaaaaaggtgtggattggcaatgggaatggagaaaaagaattgaatttaagagatattcatgagctggagtcaactggacttggtgaccaattggatgatgaaaatcagagagaggaagaaatgaggaagactctgaggttcctagggtcagactagtgactccctgaaaagacagggtttggatttggtgaatgaatacagtcacgtgccacttgacgatgggaatacattctgagaaatgtgtccttagtgattttgttgtgtgaacatcatcgagcgtactgacgcaatgatgtctactagatggcagagcctactgcactacctaggctatgtggagtagcctattgcttctaggctacaaacctgtacagcatgttactgtactgaatactgcaggccatggtagcacaatggtaaatatttgtgtaactaaacacataaaagggacattaaaaatttctgtattataatcttatgggaccgccaccatatatacagtccatcgttgaccaacatgtcatttatgcagcgcatgactgtactgagctcagtttggaaaggctatacatgatgtgttagggtaaaaccagatagtgatgttgaaaggaatttggaaacaaggaactagaagtttgggctggagagaaaatgtgggctcctgggggtagacatgagagctggagccataggtgcaaatgagttcaggcagtgaacaccctgtccatgtgcccaaggagttttgcacagtagctgagcaatggcaagcaatgtgggtattcagaggtgtggataaaatcctctctccctcccactctgtggaagagagttgggttcatttaatctcatatgatttccctagtacaatagtttcaaatcaaaggcaatgaagtaactaacaaaataacttgtttgtaaattaattgctttgtgaatattgatacaaagttttataataccactgggattttttcatttttcatgaagaaatcagttttaactaggagaaaatcaatctttcatttttcttattatacacacttagagaaccaaagggttgttttgtaccccctatggagttccttggagagtaaaacaatgcacacattgtgtgtgtgttcatgagcactcttttggctttttctcctcacttttcttcttcccatttttttttttttgctttcttttttttttctccaaatgttaggcatttaggttagattgggtttatcttgtctatcctccctcccttccttgcctcaattacttctttagattatgggtgcctttgaatagcaatgtaagtttagaaatgatgcatatataaaaatctactaaccagggatctaaaggttttagctggtagactcataagacatgacattgcttttatgaaaggtgagaaaagtggtaggaagtacttttttttttaatgccagaatttcttagtaaaacatcaaatataactaaaacctaatataaacattgcaatttttagacttttgcctcttgtgtcacattcatgtgctgtgctaagctaacacttatcattgtttgattacagaaaatgtgtttaataagcactatcaatgattacaaactcaggacatcttatctttccatcactctgagacctttgtggaggtttgtggttagaagtctgagttaaagaaaataaaattacatttctgatatcttgcacgctctgcactgagtgggttctttaaatgtttcctccagaggattttcaaccaggaacaatacaactgcttgcaaagagtcccagcaggatgggtctgggcatgagcatcttatactggtgaaatgaagtagtccagatattaaaagcatcaacttgcaaatgaactcatctgcactatagtgcaattctcaggtgaatgaccttttcttcagaaattttcttaatagtcccccaaaagaagaagaaaatgttcttgtgctttataaattttgaaaacctaaagagatcacttaatataaagatttttattttactcttgaaaacattagtctattgatatcaacagtaatattataaaaattattattattattattttttgagacggagtcttgctctgttgccaggctggagtgcagtggtgcaatctcggctcactgcaacctctgactccctggttcaagcgattctcctgcctcagcctcctgagtagctgggattacaggcacacaccaccacgcccagctaatttttatattattagtagagacggagtttcaccatgttggccaggatggtctcaatctcttgacctcgtgatcctcctgcctcggcctcccaaagtgctgggattacagggcgagtcactgcgcccggcctataaaaattattgttagcagcagttaacagtcttgagcctctactgggaagaatatgccctgttagacacagtattctatgtgatgaagaaaatatagtacctgttctccagactgattataatctagggtttccaataaaaagtaaacagatatggtagcaaaacaaaacctcatgtttaatattcagattttaagactcatcaccaggatccaagaccacatattcctttttgtgattttagtaacatattaagtgctaaaagatataagatgatgtttatatcacaaaccactaacatgctgtgtttataaaacatcttggtatattagaacaaccattggtccaggggttcttgtcctggtcatatattgggcaaatgtaatggctgcgctttgggacatccaagtgagcaaccaggtttgttgctcacttggatggaacaaagttgtcctgccctccacagacatataagagccaagagaattatcaactgtctaaataagtatttatgaacccagtggatatttgaaggtaaagaaagtttttctttaaagctcagacagataatttccattagaacatgacatctcagttggggtagtgtcttgtatgcatgattgtgtatcttcatacacttgtttccagaagaaaagcaataatatggcatagctaactctgggatcatgccccagctatgagctatgtaatcctgggcaagatagtcaccttttctggctctagtttaatttgataaatgcaaatggaaaatgcaaaatgaaaggtttaacttgtcatttctagaagcccttttggctcttatattataaatcctgtgcttcatctcctcagatttaaaatgtcaccgtctatatattcatttgttcgcccatccaaccatgctttcatccatccaataaatactgattgcagcttacaacacaccaggtattattgtagatacttgggatggatttgtgaataagaccaacaaggtccctggttttaaagcttagagtggagtagccagacaataaagaagaaaacaatcagataaaccagataatttcagacagtgataaatgctttatgtcagttaatgtactagataatgacctggatatattctttagattgggtggccagtggtcactgaagaagtgtcattactcttgaacgatgacaaagaagcagccatgtgaaaatcagagagaatgttctaggtggagaaatgagaaattaaaagccctgggaacctgctttgtgtgtttgaggaacagaaagaagggcagtgtgactgtggtgtagtgtgtgactggtataaaatggggagaggtaggagaggtcatgcaagtcatgggaaaccagggtaagaacttagattttactgtaagtggaatgagaagcacctggaggttttataagcagaacaatgactctattggattatgcatgtaagaaggtcattctggtttctctgtggagaatggattgtaaatgggcaggagtaaaagcagaagctcttgtagtcccagagagagatgacaatggtttggaccagttgaagctgagatggaggagaagtggatagattctgttggacataaaacagaggtgctggaaattaggcgttcttcctgctcacagatttttagcactggtcctgtaacactcagttgttagtgaccactgtctagcttcctgtggttgcctgcttctattatacttctgttgattgttgctagtgacactttgactgtggattgaaccaaaaatctttcatgcacccaggaagctgtgtgacctcgggcaaataatttaatctgtctgggccttcagttgtctgtatgtacacaaaagaggtcaccagatctgactgtgtatgatgctgagaagaggttgaatcatgttacaggaaacaaaaagtgtaaagctgagggtatttataggatgcctgaaacatgaagtgttgatgaaatttattagcaatggaaatggtatgttaggaagcatgaggagcatatcaaagatagtatgagagaggatgttttggagaagattttatattaaaggtggtatgggaagaaaaggcaaacatgagaaaaaggaagaaagaacaagaagagagagattggtaaggggaacactgacaatttttaactactggtatggcaacagaattgaccaaatagatttgacaccttaccaatcagagcagacactatctataaaagtggtgctatctatcataccagcattccaggctgagtattagacttggagataagaacatccaagaaggatggagaaaagatcctagatgcttttgcagttataagaaactaacgtattcagatcttccttaaattgtctatccattaaatgctttagtcatggttataaggggcagtctcctttaatactattttcaaatgttaccaaaggctaagaagaatttgtaatttgtcatttgagcattgtcttagtccattttctgttgctatcactgaataccggagactgggtaatttataaagaaaagaaatgtatttcttacagttctggaggctggggcctaagtctaggggtctaggggcctaggtctaggctgaggcctaggggcgaaatctggtgagggccttctttctggtggggacactcatcagaggcccaaggcagtacagaggattacatgatgaggaggttcttgagagacagccaatctggctgtttataacatactaactctcatgataattaacccactcctgtgataacctattaatctgttaacccattaacccatgaattggattaagctattcatgggggttctgccaatcatctcttaaaggccccacctcccaattctattacactggggattaattttcaatatgagtgtcagtcagagggggacaaacattcaagctatagcaagcatatctgttctatatctgccaaaatagttatgaaataattaattaaatgctatagttaaaaacattcgaactgcagacttagagctgtcaagcggttttccagatggaaagtttaaacactggatatgtggaaacctaagtcagccttctgatcactacatttcataataaataggcgatccaggtagtttttaagttaaagataaaaaaatgagtaattaagagcgtccaggccaggtgcggtggctcacgcttataatcccagcactttgggaggccaaggtgggcggatcgtgaggtaaagagatggagaccatcctggccaacacggtgaaaccctgtctctactaaaaatacaaaaattagctgagcatggtggcatgtgactgtagtcccagctacttgggaagctgaggcagcagaatcgcttgaacctaggaggcagaggttgcagtgagctgagattgcaccactgcactctagcctgctggtgacagaacaagactccatctcaaaaaaaaaaaaaagagtgtccaatagaaatgacactctgaaatcttcagctgatgtcagtggcacacactctcaacatgccattcaagaaaaattgaggcacggcattcctggtcctacctaaatacttttgtgggcaagaaagacagtctcctttattttaatttattctgactttctggaatagcccattatgatattgagacagaaagtggttaacaggaacattgttttccctttggaagacttacccaacagcaaagaattagctctctcagttgtttgcagtcttatctggatatattctgatgctgaatccagagaaagcaggtgttagaaataacattaagatgtttttgtttcacttcttcatttcacggatgaggaggctgaattccacaggggtaccctagccacagagccttgctagtggcagagccagaatttgcctctggtttccttgggatccactgcaatgcacttccaccacactgcaccgccaaccattcatgtcctcttgtgtttgccacagtgcgggcacaatgggggaaaaatctgctgagaaaatcatcttcggaagtagaagacaatgcgtctatgtctgtgtatacatggtgaccacagacgctttggctccaagatcattgtggtttacttgctgccattctaaagtctctgggaaattttttgtgaacatttctaaaggaactgagaacccgtccactgattttatcttctgcagcagacggtagagacatacgcatcaaagcaacagtggggcaacatattttactgtcagacaaataaagccccaagcaaaataccctacgttttaatctaatgtagactgcacctgttctcatgccaacagtttttttttctttgcctctggataatattgttccttccagtttttaaaacgaagcaagtattattttccttctgtatgcttttaaacatacttgttattataaaacaaaacatacatatagaaaagtgaaaaaaatgtataatttaatgaataatgctaaagcatactatcttaccctcataatcaccacaggtcaagaaatacaagactgtcagcacccctatttccttctgattccaactctttctccctctttagacaaaaccattaggctgaattttgtgatactaattcagattatattaactatttctattttttagtaattatggaagaaatcaaaacatgtatacttcacttagaaaagtttcaaattacatataccttcactatctttctagacaatgtgctctatattgacagatgtttcttttagcacattggaggtatatgttataattccactgtatcagggcttttattgttgatgttgaaacagtctaatagttgctccttggaaggtaatcagtctcttttctctggctgcttttaggattttcactaagatacatctaggtgtgcatacttttaaaaaatatgcttgtgaattgttgggattcttgaatctgtggagtgtgactgggttctaactaatttttccaacctatctgctggttcaccaattttctctttaactctgtctaatatatattaaacttatctattgagttttaaatctcagtgcatttttttggccgattcttgtaggttctttttcaaattagttgacttaaattttcctgtgtactacagatattattacaagtttttctcttatttgcttaaacataataagcttaattactttattttggggacctgataattcaggtatataaatcatgagtttgtttttgtagtttgttgtttctgttgttcccttgttttcttgtatgtctcattatttttgtgatgtgtttgccattgaatgtgaatattatttgtatgaaattttttgaggcctaggatgtaaaccttttcttcttgtaatagtttgcatttttactttcaaaagctgaagggtaataataatgcaaatctccttaaagaaaattcaaggattgaggttttctaaccattgaagtccagaagatttttctggaccatctaatctgaatgaggtctggtttatttctttacctgtgctccaagaatgtaactctttggggtcccaatttattggggagagggttttctgctagatcactcactctgcagattctgggagttgagacataaaaacaaaagtttgaatttgaaagaacagcaatgctttccgagtaaaagcagcttccaagctttgcctgtctctcggggttctggttctctcttcaaatttagcctggtaatttctcctcctttgtgtcattctttaatgcttttaataatatttttggacatttgttcaacatttttggttgttttggcgtgagaattagtttgaataatagggactgctataactgaagactagaacacttgtgcttattttcacaatcaaatcacccaaattgaagatatatagggaaaatataaattgaagcccagggtcattaagaaaataagtaattgtgtatcttaaataaaattaaggcaactagtgtaagtagaggtgtgacaaatagcccctcctgcataatgctaatcctgttacaaatttcagaaagcaaaatggcaatacatagtattataacttttaaacattttgaccaaatgtcataatatttacataaaagcaaaatgctgaaaataatcccaatatccaacgttagtattttagttttaacaaattatgatagattaacattttggccaataatatagtcattaaaaaggataattatgatgactaaaaatgaaatgtttatgacataaaataacaatagcagaacacaaaataacatgtttgctataaataataagtatgtttttgcaagataaagagcaaaaatatacaaatagtatttctatttcactgtagaactaggtaatttttttccttaaaatttttttacacttacatagttttctcaaaaacaaagaccaagatttcaaaacttaggaaaaaaccagcatactaataattttcccaaacaatttcagcatgaaaatttgtcatattaaaaaggaaaataaaacaaaaagaaagagaaggcaatgagcagtttgaatttatagtctaataactcagaatctgcaaccaccaggccaaggtgatttcagttttttccttctgtgattcccatgtagcttgcaaaaacaaccttggcttcctataagcataaatttatttcagaaaatgaaaaagtggggctgggcatggtggttcacgtctgtaatcctagcactttaagaggctgaggcaggaggattgcttgaggccaggagttcaagaccagcctgggcaacatagcaagacctgtctctacaaaatttctttttcaaagttagccagatatggtggtgtgtgcctgtattcccagcttcttgggaggctgaggcaggagggacccttgagtcaaggaagtggaggctacaacgagctaggatcatgccactgcactgtagcctggggaacagagtaaacccttttctctgaaaagaaaagaaaagaaaagaaagagagagaaaaagtaaacaaaaatctggggctttatctttattatcaggccttgattcagttctcagtggatgaggtttggagaaaatacatttctgtcatttgaaaatgattagtctgttcttttactctttagcaggaggacataatgtatgtgtgtatatatgtatgtatatgtatacaattatttgtatatatacacacacatagtctctatatattgtaatatacatatacatataatacatatattttaatatataatatgtaatatacatacatatataaaatatatatacaattattcatttttaaactacttcgtacttttacaaagtgagcaatttctatctttccttttatctgctttactgatgtacatcagtgattatttactcatcagaagtacacatggttcttgtcagagtagtttgatcaacaggtagacaattccttctccccaagatatacctactaataaatgaagtttttcctaaacttcaacttttcccatatctctctgtttagctaagtgctactaatcctttaattccaattttaaaactcacttcctcaaggcggcattttctgattctataatcaaaattataacccacctgactctaccaccttcatttaaatagtactccattcctatcacaaattatgttgcattactacatatttattcctttaccatctgcctccaatatgaaagctaccaaaggacagaggccataccagtttgattcatacacactatgtaaatatattatttaatatttagtatattctatattcacatatgacaagcaagtttctggttaggatttttttttctctaggacatagttttatcttatgttcttccttgaggggtggagggagaatgtgaagctgtttcattttggtgcaacagagatgactttatgcattgaataaattgcttttatgttaaaatataattattagggcaacattataaaatgtcacttttgctttgttttctttctttttatgcaggagaaatcaatggttctgccaattatgagatgtttatatttcacaacggaggtgtacaaattttatgcaaatatcctgacattgtccagcaatttaaaatgcagttgctgaaaggggggcaaatactctgcgatctcactaagacaaaaggaagtggaaacacagtgtccattaagagtctgaaattctgccattctcagttatccaacaacagtgtctctttttttctatacaacttggaccattctcatgccaactattacttctgcaacctatcaatttttgatcctcctccttttaaagtaactcttacaggaggatatttgcatatttatggtaagacattgctttcatcttccaaacttaagagtatatatatgttttgacaacttttctcactaataaaatcaattagacaaataaatatcttttgtgttggagttcacttagatgcagttgatggtaatcatttataatgaagatatacaggtgatgatttactattaatcataattagtattattcagcaatatgcaatgtaatcccatagactgctaagtcagaaatagatcatattgccttttaaacacatatgctattaaaaatcaggaaaaacattaagacaaatacttaaacttatggcttaataatgggtattatctctattcacctaagatttaaggtttggttttgcactgtgtttgtggaatgaagtatgatgattgaaaatcatagttttataacattacttttactattacctcttttataaaaatataggcagaaaagccctttctattaaccacatttgtaaatacattatatgcataatcttttaagttttagttcctggatccttgccataatactgagatgatgttagtctaataacttgcccacttactggatttcatgactataataaagaaaagcttcatttgattaaatagctcttttaaatttggtaagagaacttgtggttcagcagaatttttcattaacatacctttttttccaatccagaatcacaactttgttgccagctgaagttctggttacccataggatgtgcagcctttgttgtagtctgcattttgggatgcatacttatttgttggcttacaaaaaaggtaagcgatttctatctttccttgtatctgctttacagatgcacatcagtgattatttcctcatcaaaagtacacatggctcttgtcagagtaatttgaccaacagggagacaattccttccccccaagacatacctactaattaaactaatcacttggaacagaaatttatgtatttgttttatagcccacacattccaaagaggacttgacttgatggcttacagagagttacattattattattattgttcaaactagatgaggaaattgaggtcaagagaagactaaaggtcaggaggaaggttaaaacatcaaaatagatgactctgatttttaaaaaattattatgcatgggctgcgaatttgaatccaaggttcctgagaggcagggcagagatgaaacaattagttataagttttgcttagctggtaagttaaaaacagtcagcaagaaagccttctaaggtgtcaattgtagctgagaaggaaattgacaacttttttacatggtaggttattagactccttgcttttaaagaaaaccactgaggagctatttagaaagataaacaacaatgacaacaacaaaaatctccctgtgctgggggatattctttttggtctcttgcattacaggttctcaatcaaagaactgacaccactctgcatattacgcgagtatgctagtactcaagtatatccacagtgtggtcattggccagtgtatatctgtgggagagtggaatttggaaagagacataaagaaggaagagaatgagatagcgcccatggtctaagtctgctgggaaagaaacaataaaggcaaaaacgaggaagaaagttcagtagaaagctctttttatgtaaagcccttttcatattgtttttctacttagcctaaagccaggaacctaagtcacattatcatgtttttgtcacataccacttcaacaaagaatagaaaacagtcaaaaaacaaagagatggagaagaaaagatgaccaagcatgtttctggctttttctttcagaagtattcatccagtgtgcacgaccctaacggtgaatacatgttcatgagagcagtgaacacagccaaaaaatctagactcacaggtatgactccatttgggggtttgggaagggaagaggtttcttcacagtaagcctggaatgttaatttttttttttttaattttaaaggaaaggaaaacatctccaaggcctaattctagaattttctgtgaaaatctggatttctcacttttaactagatttatattttctgcagtatattgaaaacaaacaagcaataggtttgtaagccactattgaaactaaacacacaaacagctcataaaccaccatagtatcaaggcaattttcccattgatgtttcaaaagttgggatgattctaagtgttttttgttgaagggttcattcagtcattcaatgagcgtttattgagcatcagttaagtgtgagttactgagtgaggcactctggggaatttggacagatatatgctaattttggactgagattaggaagagagatctgtgctggtactgctagagggaagaaggagaaattgatgaagatatctggttattttgaggtaaagagtgtgcaagtttagagaacttggatggctttagaagtctcagtaacatggaaatttgaccttttctgttaagagtcagaaaactgaaagttgccaagtttgaggagcacccagaaagtttgaagcttccattgtggaaaattcatgtcttatgcccttgaggttcgaatgatgtgcgatgtgtaatgagacagaagccactgcatttttccacccctcagtggctacagattatctaaaggggacacacatagcttgcgttgtcatggaattatagcatgggatgggagctaaaaaggatccttgagttcacatttcatgttttagatgacagaaattgatgctcaaagtgttcagtgactcttttggttccctagacagttaatacctagctttgacacttgcaaagagcttatgtttcattactttgctgtttaaaaaatatatgatctctcaatctctttgcttaatgtgttctggctgtttggatccccacaagcagaacctgacataaggacttgggtgcaagtagtttatttgggaggtgatcccaggaagaaggggtgagggggcagggagagtgagacagccaacaaggagaagcaaatgaagggcgcattattatcaaggtctcagctccaggccacagaggcctgacttcattggacctctgagaagtgtacagatgcctcccagaatcattctcttgaaggatggcaaccactggctccatcctcactgatttggggttgcctgcggagggcattagctttccctcatctctgagctgtgcctctacttgggatgagcctacttgggatgagtcttcagagaaagtctggaggcagaaaagcagtgaaatgcagtggggctgttgtgctagaacagtcagcccatgcagcgctttctgccccagcagcagctgcaatcagaggtggacagtttcaaagtgatgagtttagataatgtctgttataggagtcgagagctaaacttctctggaaatggggaactggtgctgggtgttgaagcataaagatgagtttgcatggtgtgtgtgtgagtgtgtgtgtgtgtgtgtgtgtgcacgtgtgtgtttgtgtgtatgaaaggcaatggagaggggaaagcttcttgtagggaactggcacatggagagcatttagataatttatgctgaatttttgttacagatgtgaccctataatatggaactctggcacccaggcatgaagcacgttggccagttttcctcaacttgaagtgcaagattctcttatttccgggaccacggagagtctgacttaactacatacatcttctgctggtgttttgttcaatctggaagaatgactgtatcagtcaatggggattttaacagactgccttggtactgccgagtcctctcaaaacaaacaccctcttgcaaccagctttggagaaagcccagctcctgtgtgctcactgggagtggaatccctgtctccacatctgctcctagcagtgcatcagccagtaaaacaaacacatttacaagaaaaatgttttaaagatgccaggggtactgaatctgcaaagcaaatgagcagccaaggaccagcatctgtccgcatttcactatcatactacctcttctttctgtagggatgagaattcctcttttaatcagtcaagggagatgcttcaaagctggagctattttatttctgagatgttgatgtgaactgtacattagtacatactcagtactctccttcaattgctgaaccccagttgaccattttaccaagactttagatgctttcttgtgccctcaattttctttttaaaaatacttctacatgactgcttgacagcccaacagccactctcaatagagagctatgtcttacattctttcctctgctgctcaatagttttatatatctatgcatacatatatacacacatatgtatataaaattcataatgaatatatttgcctatattctccctacaagaatatttttgctccagaaagacatgttcttttctcaaattcagttaaaatggtttactttgttcaagttagtggtaggaaacattgcccggaattgaaagcaaatttattttattatcctattttctaccattatctatgttttcatggtgctattaattacaagtttagttctttttgtagatcatattaaaattgcaaacaaaatcatctttaatgggccagcattctcatggggtagagcagaatattcatttagcctgaaagctgcagttactataggttgctgtcagactatacccatggtgcctctgggcttgacaggtcaaaatggtccccatcagcctggagcagccctccagacctgggtggaattccagggttgagagactcccctgagccagaggccactaggtattcttgctcccagaggctgaagtcaccctgggaatcacagtggtctacctgcattcataattccaggatctgtgaagagcacatatgtgtcagggcacaattccctctcataaaaaccacacagcctggaaattggccctggcccttcaagatagccttctttagaatatgatttggctagaaagattcttaaatatgtggaatatgattattcttagctggaatattttctctacttcctgtctgcatgcccaaggcttctgaagcagccaatgtcgatgcaacaacatttgtaactttaggtaaactgggattatgttgtagtttaacattttgtaactgtgtgcttatagtttacaagtgagacccgatatgtcattatgcatacttatattatcttaagcatgtgtaatgctggatgtgtacagtacagtactgaacttgtaatttgaatctagtatggtgttctgttttcagctgacttggacaacctgactggctttgcacaggtgttccctgagttgtttgcaggtttctgtgtgtggggtggggtatggggaggagaaccttcatggtggcccacctggcctggttgtccaagctgtgcctcgacacatcctcatccccagcatgggacacctcaagatgaataataattcacaaaatttctgtgaaatcaaatccagttttaagaggagccacttatcaaagagattttaacagtagtaagaaggcaaagaataaacatttgatattcagcaactgaa

SEQ ID NO: 1757 - DNA, 9098 bp, Homo sapiens
ttaactttgcaagaaataaatttttatttttcttcattatcatacagcatttaagaataataaatctgtcttgaggtttcaaatctgagatatctatggcaagtttataaaaagtacattgatcaaggtacaatttttaacattaatatacacattccataatctcatctatttaacattaacacaggcctttgttgttgttatttttttctccctacaatatttcctgactctgtaggacagtggtcctcagttgggggttgactctgtcccctaggggcatctggcaacatccggcataactgtgggtgtcacatgagagggacgctgctcaccatcctgcaatgcacagcacagaccccaccacaggggttttatccagcccaaatgtcaacagtgtcaagtttaagcaactcttaccgagtgggactcaattcccattttatgaacacctctgtgctcactgtaattctgaaaacacagactttgctaactggtaaatactatttacaagaagattcaacctaatcaatatcacttatcaaaagcagtggctgactgtaagtatcaacatgtttccagaatgaataaaccacacaatcaactcagaatgatacaaattagggtccatatcatttaatttcccttgaacctgctctgctagtttaatctgctaatatgaaagttaattaagactgttttgaaggagcgagacaatagtttcctttgcacatttttctgaactatgagaaaaatttaatgatacataaagcacctggcaaatagcaagtcctctgcaagtgctccggaaatgtttatcacagcctactaaaaacagagtttcactcatttgttcaaatttcccataagtatgtatctgcaaagattaaattaagttttatttgctcgctctcattttacaataatctctcacaaatgtcgcttagaaacagaacacatatccagggtgtgtgatacaaaattataagttagttttttccacacaagttttaaagtatcagtgtatataatacattaatgatagtaccaaatgatagaactaaatttaatgataaattaatgatagaactaaatttaaaaggaaaaagtcattctaagtttgttaagcagataaatttttctgtaatcatttacctacatattcacattctgtatattttctcatggtcaacaaactgattcaaatgatttaagttatcccaccatttaaagagaaaagtcgctgcaataattttaaaccatggcgttatcttaatttcaccactggctgcttttttcagaagttcttttagttcttcctttgacacataacaatagcttttaatctcattgggatctggattcaaagttacattcttcctcaccaacaaaatgtaatcaatttcatgttcaccccagataccatcagactgagctttgtagtgaattcgtgttaaataattaatttcttctggaggaacctaagacattaaaaaaaaaaaagtaattaaaacatcggccaccgtaacaaaaaaaatctaaaattagctcactgtattacagcgatatctcgaacagcagtatagttttaggattagaacttggttaaagcattaatctcctatcaatggtatatggaaatcttaatattatatatggaaaaatgattacatcattagtttcaagtgtttgcgtttttttcccgatcagataagtttttttttttttaatgttaaaaaaaggggcagtcactcaaactagaaatgtgacattcttctttttcttcttttttttttttttgtgagacggagtcttgctgtcacccaagctggagtgcaatggtgtgatctcagctcactgcaacctccgcctcccaggttcaagcgattctcctgcctcagcctcctgagtagctgggattacagacgtgccgccccaccatgcccagctagtttttgtatttttagtagagacggagtttcaccatgttggtcaggctggtctcgaactcctgacctcgtgatccacctgcctcagcctcccaaagtgctgggattacaggcgtgagccaccacgaccggcccgacatttttctttttcatattttaaaattgctttttggaaaatatagataagaaatactttatttatccaggtcttatttaagggggacaattccaagaaaaaaaatgatttcaattaaaccaatgagatttatggttcatattcctaagagtttccatcagaaaatcttcaccttttttgtaggtggggagttttaggtgagaactggaaaacctgtcagttaaattctacaagagctgtaacacttgaaaatactcatcttagatttgatcaattatagaaatattcaaccttatatagtgcttaacagatcaatccatccccgtattgagctaagttttgacaagtgatattaagaaattaaaatttaaataatctttattcaagatggtttgtggggctaactcataactccggaggttaccaagcagagaactacatttgaatttaaaaattttattaaaaacctttttatagtatgtttaggtttcagcttgtatggttgtgtaggagagctggttacctcttccaagggaattcctagctcagctttcagccgtctctgtgctgctcgcctcactccaagggcgtcactttcctcaagctcggctggattgcttaatggatgactacaacacgtattcgtaaaacaacctggaaaatggtaatacagagacagatcaacttttcttcaaagtaggtctgaaagatcaagaaaaagttttataagtaactgaaaaatgaaatgatttttaaggattttaaaatcagttataatgggctatcagtaattattttaaggattttaaaattggttataatgggctatcagtaattattttaaggattttaaaattggttataatgggctatcagtaattatgttgtgaaacagactacatttgtaggtaggttccttattaatacttctttaaccaaaaaagatcaaagtgtagataatacagattaaagataaatatgtaaattatacatattgcccaattgcttactagttcttattttttcttgctgttgtattaggttgcactcattgtgtaaactcactttatgcagaatataaaattatgccattcacaggatttccctttgtgaccttggctccaagaattcagaatgataaaaagtcaaattaatgtacaaacacaatattgtacattaaaagtgtactaacctggaaaggtaatcttagcatctgatctttgctgtagcagaagcttattttcggtgttgaataagaagacactaaaagctcgatgcaataatcctgaaagcaaaagaaataacaattattttagccttaagtaccagttatttgccaaattctctccctgcagttcagaataacattagtaacttgctgctgcttttgctttttcccatggtttatccacatgcatagtctctgcatggctatggtgaggaagagctctgcactgggcaaggaagttggccgtcgagtgaaggaaatggtgatgctggtggcccctttccggcagtcaagttccctatcaaggacattcagttctcggaaagtggtgaaggcacatgcttccctgcatggtgcccgcctctctccactctctagaaatattagaggctaggctgctgctgtatgtcagggctagtccctcttctatgaatccagaataactctgaagaagccgagtaacaggcatgaagtgaagagaaatcgctgtaacaggaagacagcaaagcagatgctaatgaccacactatttaacgaactggaaccaacgagaaaatacggtattactgaagactgcacttccttgaacagagtgctcttctcagcaaatcggaaatgcctacacaaatcgctttacaagaaagactgtttcaaagcagcacctttctcaatgttctcgttcaggtgacaattcttcttggtctcagctccaattttattgtcattttcatcaataaggatacacatctctgccaggagttgaacctgttgcttgtcgaggtggttagtgtttatttcaggcatcattacaaaatgtctgatctgttctagaacactaatattaaaggaaaagagaaagaaaggccatcatatatttttctgaatgtcatataaacacaggttaataatgatgctgcttccccatctgcagttgtaccactctgcatccccacagggaccccaagaacgctgccagccggctgctcagcactatctgggtcatcatttctcctacaggtttcacagctggccttttatcacagtcatgctcctgaaggccaagctcaacgttccgctctaaattcttgacctctgagatcctctgcagcacttgatactcaatcctttttccagtgtacttttcttctctggtttttggccccaacctaacttttcatcctgcttttctacaccagcttctgtaatctctagaatgtgctcccattgccatcctgaattgtttttcccactgcctgtctctgcatagttgctcaagattgccacaggccaatcttggttgaaatccattttttcaaggcacaactcgtgccagacattcaataacctttctaccaatgtcacagtaagacttaatccagtttttctcaacccaagctcctgggttatcagaaaaattatttgtatgagttttgtcaatttcccccaggacagtacttagctgatatcattctagataaacaggagaagacttaattcgttatattcaatagatgctttaaggcagtgcttggcaagttttttctgtgaagggccagagagtatgaactctgcctctgtaacactaaaatagtcacaggcaataggtgaactgggcagtatgtaaactgagtgtgggtgcatgccaatatttatggacactgaattacatttaattttcatgtgtcacaaaatattttgattcttctccatccgtttaaatatgagaaaaacactcagctcacaggacgtaacaacaggcagcaggccagatttggcctataggccatagttggcccattcctaccttagtgcatcaaacattaattttctgaacccccatttatccctcccatgtgattacaacgtaaagcacttattagggtactttcagtattctgactcacacttttacatatctgtatccagcagcgtctaagctttctaatctttgtatccttcagggcacctttacatagtctgaccttgaagttttttattcccttttttcttctcctttatttctgaatgaataataatttttgttttctgatttttctacccaatatattttgaagatcccatgtgctctactttctatgtgactctatttcaaatacatagattttactgaaatacttttttgtttctgagagggagtctcgttttgttgcccaggctggaatgcaatggtgcaatctcagctcactacaacccccacctcctgggttcaagtgattctcctgctttgacctcccaagtagctgggactacaggcgtgcaccaccacgccaggctaatttttgtatttttagtagagacgaagtcttgccatgctggccatgctgatctcgaactcctaacctcaggagatctgcctgctttggcctcccaaagtgttgagattacaggagtgagccaccacacggggaccactgaaatactttcaacagagttcaagcatactgcagaatgtacacaaagtgtttaaacagctacttaatacaaagttctagacccacatagggtctgggtgtgtgtgtgtgtgtgtgtgtgtgtgtgaatgcgtgtgtcaggagtcagtgatgatggagatattgatatctaatacaaaaaatctgaaataaggttaatgattaaaacaaatcaagagggaaaataatgtgaaaaggaagtcaacttcagagttagcctcaattttagaaagatttccaacttctataggctagttttatatacagtcatcctttggtatatatgggagttagttccaggacctcccacagctaccaaaatttgaggatgctgaagtttcagatataaaatggcataatatttgcagatcacctgtgtatatccactgtgtacatacatgtgtcacatgatggtgtttcggtacactacagactgcatatactacagtggttccataaaattataacagaactgacatattcctattgctaatgatgttgtagccattgtaacatcggagcacaacacatcaccttttctatgtttagatacacaaatacttgctgttgtgttacaactgcccacattattcagcacagtcacacactgtccaaatttaggcctgaagcaacaggaaaaacagcctaagagcaactggctacaccacacagcccagctgctccactgtctgtctacaccacacagcccagctgctccactgtctacaccacaccgcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctacaccacacagcccagctgctccactgtctactgtctacaccacacagcccagctgctccactgtctacaccacacagcccagctgctccactgtctggtcctttgtctacaccacacagcccagctgctccactgtctacaccacacagcccagctgctccaccgtctgtctacaccacacagcccagctgctccactgtctaggtctgcgtcagcgcactctgcttccacaatgatgaaagtacctaacaatgaacttctccaaagtatccctgttaagtgatgcgggccgaacgttaaattatcatctgtagatgatctcttatagtatctaaaacatgtaaatcctacataaatagttgtgctgtattgtttacagaataagtctgtatatgttcagtacagatgaaatttttttccaaatattttataatgtgcagttggttaaatccatggatatggaccccaaggatacagtaggccaactgtatattaggtgatcactaagataggtttcgttactacataattactagactttttgacatgactttttttccggggggatggggctgggtcttgctatgtctgtcgcccaagctggagtgcagtggcgcgatctcggctcactgcagccttcgactccgcctcccaaagtgctgggattaaaggcgtgcaccaccgcccagctgtaatgacaattgctctttcaggattttcagaattcagattttaaagctaagctgcataatcacaagataaaatgaatacgtctatttatgcgtttaaagaataccatgtagtagacgcgggaacacatcatccaacccaagaaaaaggtctagttccatctatgcgatgctccccatctcttctcctgctccattcccaggagaagcgccttgagtgtgttgctgtcaccctcttgcacggacgcaggtgtatgcacccgcgtcacacgcgtggactcggcacggggaggccggtgtcgtcacgctcgtgtttctgacgatgctgtctacgcttgtttctgaattctctaaggggagactcgcaactcttagtctcctgcgactcggtttccagttccacgagttcctaaacctcaggtgactgtgcgcagacgacgatcttttccgctgacaaagaatggcaacgtctctgacgccccgactcacgcctccgccttccacggggcgcgggcgcccaccacagcccgggaaggcccggcctccctccagttcgggagaccaacgccgccacccccagctgtccaggcctccgcgccgagacctcacgggtggctcagacctcgggcctcctccccgccccgtcccgcagctccccgatgccgccctgcccctgtctcccgaactccgccgcccgtccacagtacctgatcagcctccggccacagacaaccgccggtcccggatggcgcccgctttgagcacagtctgcggcgcgcaccgcccactggccccgcccccgggccgcgcagccaatcgctcgcgccagcgccagtccacgccacatcgcccggccaattggcgcccgtacgcgcttgacgacacaatctcgccaagcttcgcctggtggtgccacctccctggcctgtgacaacggcagacgcgcgaagcaccgggaacctgag

SEQ ID NO: 1758 - DNA, 51630 bp, Homo sapiens
tgcagagtaaaacaatcattttattgattcttatgtcagttctgtagcataatgaatacattaatcataatcatattaaatgtttaactgatagtattttaaaagaatcttcaatcaagtgctaatcctcatcactaaataaacagcattctgaatagtcaagattgggaaatgtgataggtaattctacccactttttgtattgtttctttgttgaattatttttgaaaaccactacaaaattccttattttgagacaaggcaaatctaagcctttgtgcaccatcattgttccccaagcctggaaaacaaaagagagagcaagaggaaaattaaatgtacatgcaattaaacattcctgttggctaaagtaaaatctggcccacagcaatttactcacctggccacatttgcagatgatttcaccatttatttgatagtcggcacacttcttttgcagtgctttgttttctcttacaatgtaaagttccctataagtatcaaagggaaagaatcatcatggagaactgacaaaataccagtgtgtagttcatgggttattggacctggagctcatccgcatgcctgcggtattctacacggcattccttccttccctcctgcttcccaggcttgttattgcaactaaggcaatgcttctcttctacacatacctctcaaggggcatgttgcctttcataacttctttcaagtctgttggttatattaacttgactttagttgttcaaaaatttgagaacaaatgatgagcatacaaaaatacgtgccttggatcaaaatggctttggttcttacacttctcttttcctgccccagtgcagtttatttaaaacatagacatttaaaataggaatataattgagaggctaaaggagaggaagttgtaaaataaatgaatctcatttgcactattttgaaagaacatttacaatgcaacctgcttcaccccttgtggaaaaatgtaaaaatgggtctttctggactcacttgaattctggggtcatattgacgtgatgcattttctcaattacatggatatcttccccagaacaggctagcacactgcagtttttgcaaaggaaagttattagtgatgggttattcttgtaatgcttggcaatatttctcttggttttcattttcttttccattatactttgcatctgtaattccaaaatctggacagagaaaggaatagttagtggtttcaggtttgttttcttttttcagtttcatagaagtaagtctcctgaaatttggaggtcttagttgtgaaaatatacccttagcttatggtctaggaaataaaaataatgaggtaatgaccccccaaagaatttggtatataatcatctcctgtaaccatgaaaatgtgcagtcttcaggtattcaaaaagtagcccattccatttcagaaaagttctattgtgagaaagtccttagcaatattcaacaaaaattctctgtctagcctacccatttgttatttatttatttatttatttattgagatggagtcttgctctgctgcccaggctggagtgtgttggtactatctcgggtcactgcaacctccatctcctgggttcaagggattcttctgccttagactcccaagtagctgggattccaggcacctgccaccatgctcagctaattttcatatttttagtagagatggagttttgccatgttgcccaggctgatctcaaattcttgatctcagtgatccacctgcctcagcctctcaaagtgctgggattgcaggtgtgagccactgcgccagcctacccatttgttttaattctgttccataaaataggtctaaacttccttccacatggaatctctttactaaacactgttattacattaccaagtcttctctaatctatgctaagcacccaaatgcctttaatcttttttcatgctttataattttcagacccttcaccatcttaatcagtctactctttacacatttgtagcagaaaccactagtttttcattcagtgtccatttttcctaacagaaccataattttattctgggtggaaatatgctagctaaatgactacatttccaaaccagcagtcaatgacatgtaaaaagctgttgagtggaattttcagaaaatcttcttaaaaattagatagctggcatgtgtacctttcgccctttccattctcctcttacttcctgcctagaatgaggatgtggcagctgaaattctaaaagccatcttcgaccatgagaatgaaagcccaatgctataacagcataaaaaggagagaaaaggcctggattcctcataacttcatggagccaatactgcctagattccttctgtgagagaatatgcccatcaacctctttattctatgctctgtgactagcagcagcacttattttataatggaaataatctagtttatgtaacatatgaaagttgacatagggactgaacagtgtttataccaacacaacttcacggtagaaaaatctggttcttgaataatttaccgccaaactgacctctcatagatgacatatttatattaaattatggaagaattaattgttttctttaagaccgagggagaaattttcagtaaaagtaagtcatcagtgcagttgaacaaagcccatctctttggcttctaactctacattttagatctcccttcaaggcagccatatatagcatagaaaagagaataaaaccttgcaagcaagcctggaggctatataatagattaatcagacaagtaccaagattaatttcctatgtaaattatagcaaaataatacactgaaatatttttccctaaaagttttaataggttacttttataagacatttacagttcaatgagctgataaggtaattataggatcacatacatgtgggaattaagaaatgtgtatgaatgagtcagaaaaaaaataaagccaaggtaagtgtatggatttgtaatcaggacatcagaagctaaaagactaactctaaaatagtaaaggaatttgaagtaactagaggggtaaacaaacaaaaaaaagaactcataataaatatacaggaggcacagctacaatcagcctaagtccaaataaagtgtaataatgtagcaaaaaaattgaatcaatgctagagaaaaacatttatgatgatcaacttgctcctagaagtctgatttaattttaagaagctctgttatgtttaaactgtgtttatgacatggaagaaagatttcatcttatctgtcaattctcatcattcattagtggttgtctgaagattgtgttgagaaagatgctcaaattagaagaaagtaaacatcttcccagtagcaatgttttctacaggctttgaacagattactggtggcatgtagccctccttccccattgccactcctactctaagttcatctacctgaagtagttttaggagggcaggtttcttggccaaaggagacctaaaaatatagtccattctggggcacccaaagggacagagtcttattctaaagaatgtctggaagaatttgacccttaaactccagagattgtcctagtgttgacccccaaaaaactactcttaaaacatcagtctttgtaaacatctacttgattaattctcttaggacattaactgggaggcagtaactttccagtggcataatttggtgacaaaagtttgatttgatactctaaaatatttgctttgccttgtatttaaaggggttttaaaataaagttttgtgcagaaacctggtcaggaaaccttggagttggtaatagcaatgcacaccaatttgaaagcatccctttagtgaaactctatttaaggtagagccaattccaatgttaagaaactaacattcacacccatatgcaagggtgtgaattttcttctaaatggattgtttgctattatagtagttacagtttttaattcagtggtatgggggatttcctgaaatactatagaaatacattctttcttcactgcattcctttgcacaactcaaataactgtgtgttagtaaattgagatgtagctagatgacatattctgtattttcttatcattcagatgcagcttccctgtcactccttctaagagaccttcctcaaccacccagttgaaagtatccatctagtctatgcagccataaaaaaggatgagttcatgtcctttgtagggacatggatgaaactgaaaaccatcattctgagcaaactatcacaaggacagaaaaccaaaccccgcatgttctcactcataggtggaaattgaacaatgagaacacttggacacagggctgggaacattacacaccagggcctgtcgtggggtggggggaggggagagggatagcattaagagaaatacctaatgtaaatgacaagtaaatgggtacagcacaccaacatggcacatgtatacatatgtaacagacctgcacgttgtgcacatgtacgctagaacttaaagtataataagaaaaaaaagaatttcaaaaactactaaaaacaagaaagtatccatctagtcagttgtttcatatcatcctattctaattctcttcacttatcttgatatattatatttcttgtcttttaatgtttgtttactgtttctgtcctccaaacttcaccaggcacacactagaaatataaacttcgtgcagcaggagtcttatgtgttttgtttcctctgttggctgttcctataaggttacctggcacacagtaggcgtttcatctacatttctgaaattaaaaaactgtgcctttacaaacaaattggatcaaaccaaaattaccatgttggattgaatcagtgagttgcagcagtctttctggaacaaggcaggctaaatttatattatccaaatttatggttggttttactggaatgaggaatggctccctgataatttcctgcccaccatggatcttgattctctgcatgtgaatctggattaagcacagttcactaaacagaaacttataattcagcacaatttttgtctggagaatgagtcacagagatatcaatggcaaccacatgccgccatttttaaatgaaaatcaaattcagaggtgaccaacaataccttatgagcatactcctctggtttcatattttgaacacaatgtatagctttatacatcatcttctctcggaaatcattaactgtctcatgttcgataactcctgaaccactgtgagcaaccaggacgtaggtgctctcatcagctctggctcgaccacgggcctgaaaacacaaataaatcaagtaaatgaaagggtacgttgtgatacaaatcctcctggttttttctgggaatgatattcttgctcagaatgaaatgatattgggttgttcagcatgccagtcttcaaatgggtaaagttagtaaagttagttattaatccattacttgtaagtcagctctttgaaacttataatatgctttaatacagaaaaagtgttctagagtgatgatggttaggcctcaatgacataatatcatcctgtccaggctttttgctctcagaacttctctctcaaactatgagaaccacgatcaatgacttggactgaggagtcgtctttcttggtaggaagctgggaggaatgaatggagagaagggtcatctctgaccttgacactagggctggtgagaaggcaggtcagtttctggcatcctacattacattcttagcacattttcccatgggaacatatttaacatggtgataactttctacaagcctctttatgaaagtgatattcaggtatattttgattaatagaaacttctgtggcctggcccaggagcctatcaactataaaagtatcctcaaggaaaaatgtattctaagtttgattactaagcttatcactgacttacaaatagactcctgaaataaaattatttgctaatttgatggcagtctggttatcttagtcttctatgacttgccttttattcaaggatgcaatttaagttatttaaaaatccctttagttaattttataggaagaatagtgtatctattaatcagcataacacctatgcctactcaacaggttacaataatgccattaacataggtgggtaagagataaagtgaaatctgaatgaaaacagaacatttcactcttttatttatttttacatttataagtctgcccccaaccaacattttatcatgaaaacttctaaacacacagaaaattggaaaggataagggaagaaaatgcagaaacagcagggctccctcaggtttgggcatgttacttcatcagacatttgtgggacagtgtactttagattcctggtccagctgggggctcacagacatcctaggaaagaggaggctgcttttgactcttacaaatggggctagtgtcatggtcctggaaagccttagggtacagaaatagctaaagaggagttgttgtttaaacatacaacaggtatctggttattatatgaattgacagcaatatgaaaggcaacagtgcacagcattttaaaaatgctcttttaacaggaaaaaggctttgttttaaaaactaaaaagatgtttttgctgtttaactaaaagaaagcaattaaaataggaacacaacaaataaaaattaacatagtaagtagaggtatttgaatgtacctggaccatggctatttcattggtgacgagaccataacggataacaatgttacattctttaatatccagaccttcttctgccactgtggtagcgataagcagatttatttttccagtgcgaaatttactaatgacttctttttgttcattctgtagaaacattttaataaattaaattttgtgatgctaaacacattaaaatcttctaattagaggaagaaataataaattgcaactggtcagtgtaaatcaaaggattagatcatacatggatttgttgccatctgtttttggcattgaacaaagacataatggtgagacaacatttgatttccaatctgggattaccacacaataacaaaaatatttccatcatccagtctggaggtgggaagaccacattttatgccaaggaaataaattgatgggtgactccagaggaagaaaggaggagctgtcggttgagaagaggatatgacaatcagaagctaaaatgggcttttttcccccactacattaacttcagaatctttgctatttagaggataagatgcagagatgctttgatatattgttttcagtcacagagaaaatgcacactgtatatgcatttggtcactttaagaatcatttgagttagaagctatggaatattcccaaaaggacacaagagaaactgaaaacatcagctgcatctagggaggggagctggaagactagaggtcagtggtatgccttgtgcctcattaattttgaatgaggtaaatatattatcaattcaaagggacaatataaataaaaatgaaagaagaggttatgcaactgtaaataaaactattttcaaatgaaaaaactctgaattttgaaagtcaatataaataaattaaaatatgacctctcatccttacatgggagaaatgagtgagcacaaacctagcttgatatggacaatgtggttttattttcataaccactctcatcaaagctgttggtccagttggcatttggtgcacatccacactgtctattgcccccatacattaaacaaaaataaagctgccagaccaaaagtatgttcttccatccccttccctttcttctcagaggcagtgtgagtccttatttgactcctactcctaactgtcggagaaccctgtagaaaggcctctcttgagtcttctctgaaaatttctccctccggccctcacatctcccgataaaaacttacatgttcttggattttagcagaagatgcctgtgtcttaatttgaaggagtaactttaataacaaaaattccagacagtgtcagatcttcaagtcacatcacatagatgcctaacaccattgctaaggagtttgtccaccccagtttacaaggtgaggatacaaggagtggggaaggaagggaatatgttctgtattttggcacacagccccttggtttgaaatgaataaggagcagaaagtagcttgaacataggcttttcatttgcactctacctctttttacagagaagcttagccctcttacaataaaagtcacaacgctaaagttaatataatagaaatttaaaaacagaactcataagaatcaacacagaggctgtgagactgaacttgagtttttcctgctagctttctggaagctaaggcaaaaagaaaaacatataaagcaaactacatctcatcaaaaagaaggaagcaaacttgttacccaaggaaaacagtactttctctggcattaattttattggcaatgctcacaggagtgcatgtagagggtatataaagagttatagtgaaccatttcaagaatttttttccagcaaacactgaaacagaattaatttgctccattggcttgaatagtgataactataatagaaaggaagtatccatttgtccagaaagactcagggtcaatgtgattttagccctcagaagaatattttactctaacaaggcatcattgcttcatgcatgcttgtaatgtctactagtgcctttttttcttacccaagtgtttttttactatgcccacagtaagcaacatgtaaacaaagtaaaacaaaacaccttaaaatggaacagaaaacctacttaccagaatcccaaatctctaatatatcaaattctttagttttttcaagtttccctagaggtctcattctatgtaaatatattttgcatagttctagttataacgaacacatttttgtgggagtttgaattttccacttgatactacatggcaatcatttctgaactttgttgttaagcttacatgtcacttatttttgcaagggaaacttagaaagttcttccaattattatgtgggaaaaatgactcctaaaacaacacttaacctctcaaaaaccacagatttgattgctattagccttagattttatttcaagaacaggtgttttatcctgtaaatgtattcatgggtggtgagaggattggtagaaaaagactaaaaacaatttgagaagagtaataacagcataagaaaagaagtccaggctgagcgcagtggctcgtgcctataatctcaatactttggaaggcagaggcagaaggatggcttgagcccaggagtttaagacaagccaggacaacatagtgggacaccttttctacaaaaaagataaaaaaattagttgggtgtggtggtgcacacctagagtcccagctgctcaggaggctggggctggaggattgcttgagcctaggaggtcaagggtgcagtgaatcttgatcatgccactgctcttcagcctgagtgacagagcgaggcctcgtctgaaagaaaagaagaagagaagaagagaagagaagaagaaaagagaaagaaaagaaaagaagtcgtccaaaaggatatttatacctgtgtcatgggtttgaactcactgctgtgtccagctccaatcagatggtgggctttgactcctacttcagcaaatttttcattttcagtaatccactgggaaagcgcatatgcactctgtcgtgtttttgtaaagattattcctcgtgctgattcctcagtcctagtatattgctccattatggtatttcttaatttggtcagcttttcattttcatattctgggttttcagccagccttttcaacattttattgttttctttaagaaataattagagttgatatgttaacaagcttgatttagccactccacaatgtacagatatatcaaacattttgtacaccaaaaatatacagttttattgattaaaaattaattaatttaaaaactatttggaagtataaattagtaaaacatacaacgaattacactagaaggtttcatgaattgtggctcatctacaatcttgcgctatatctaataattaggatggtttaataaataaattcattacaattgtcttgacaataaaactgaatgaccaaatgactgactgtgatcatacaactggtagctaatctggtcatatcattagaaatagttccaatctgagtgggatttcttctttcaaaagatatttctctttttggagagcttatgagaagcagtaagttcatgttgaaaaggtaaatgaatgacaccagtatatgttactttgaatcttaccaaaaaataaagtcatgagaaatctatctgtttcatccagtttcaaaggtttctttaaatcatcctcatcttcatcaccatcacaatactcatcatcaccaccctcatcactatcatcttctatgactgcaaacttcttatctttctcttcattatagaaagtttcaagatgagtatacgcatctatcattcgaattgtgtcattaatttgtagggcctcattgtacttcctcaaatgttctgcacaaacacgttctttgcgatttccttcttttgcagctgtgaaaaaatatattatgtaagtgaaataataagcatataaaccccctaaaattgtgccatggacttgaatatatgttactaactgcaaaactggcttcaccttggttttaaaatgggcaagttaaggctcaaaatgtgtcctgagctctgaaacagggcaagttttccaactcctagacttgctgcttgagttctgcctcagcaaaaacatgtagctgatgcacagagaaatggcatgaaaatatattagttgagtttgcctttggagacagagctattaaagtttatctcaagactctggagacaaagagaaaattggatagcattggaatctctctccttagaaaaggaattagaacatgtttattatgcttgtcctacagagaacacagaaattctatttggaactacttttgctttccattttttggggaatctgtgatatagtcatctaaaatcttggtataaacatgggataaactaagtgttaggtccaaacctaaattaccttttttttccatttgaatggcccattgttcatagggttgagttccaaaatctgacattggactcatttgacaataagtttgaatccttgtcattatttctagaagtttctctttaaatggatcctaaaaataaagtacacacttattcttatgtattcttattgttaaaggaataacattatctttgttagaataatttctaggttataataaatctgattcatctttgtttagacaaagtaacaggttagtgtcccatcacttgtctgtacatttatttttgtcagcttctcttttaagcctgccatcaagccacacccacaccaacaccctgttacctctgctggaatctccaacttaaaaggttaacaaaagtaaagttaatgaattatataaaccttgtatgttaaaggtaacttagaaaacacatattgcattaatgccacaattatttagaaagcttacagtgtaatttaagaaacattcctcctttgtaaaactggtttcagtattatttcgaccaaaataaaaagttgaagtagagtctgaataaagccagaaataaaggagtgcatgctatatgattccatttatataaagttcagaatcagtgaaaactcattttttgttttagaagtcaagatagtagtgattcctggggcatggtgactggaagggggagccaggagcttttaggatactggcagtgtgctgtctcttgatttggattttgtttacatatgtgtattcagtttaggaaaattcagcaatcagtacacatatgaatttgtacttttctgtatgtatgttatgcttcaaggtatataaaaaaattaaagtaagtttaaaaaatggcaaattcttttaaaaaatgtacctgagaaatttagttttaaaaatctttatgagtagaaacatgcatttaaaattatcaagtaaaaccaaataagtaacaaaaaaaggaaagtgaataaaatatattcaactgtgctagtgcagctggagtagatagcagtctttttcagaatttaaaaaaagagatatacggaggctagttactaacattggtttagtgcctactatatttcaagcattgttttatctactatgcatatttcatatcatttgatcccaacattcttattttcaatggtattatcaagtacatatggccagaatttgtaatgctttctaaattttacaaaataaagtattgacataatttactggccataatgtccaaattgactctcagtttattcttataattcctgaaaaattcatcagaaaagcatcattaaagtaaatatttcacttctttaccattgcactgttttcctaagaaagtaaatatgcaagtatgcaaattagataggattcccattatcattgccaaatgtaatttgatagcaacaaaatggctctgtggaatgtcagaaaatcaatcctggaattcacgaagaaaattaaaaaggctaaaacgaactgtcataacccctccagcttagttacacatccctctgcccatggcccctcactgtcccttttaactcatatgtacaaacaatgaataagctattcctcatgtaaattagaaaactaaaagaggtctagaggcgagaattcactgtagtgctttactgcctaacatcaattaaaaaaaaacctgaaacttgtttgctaaaatttttaaataatatttttcagatggtcagtataaaatagcctttgccatctttctactgaatgtagtattgtcaatcaatagatataaaacattaagcccatacttctctggttgcatctgcaatggcaaacttcttgcatggctcctgtatttggtttttcagttgatcaaggttttctttaacagttttaatagtaaatgcatcaagattggcacatagctggaaaagagacatttttcaatatttatgcaattatttttccctttcactttattcaacgtagaactctttttcatgtaaaaaatatgtagcattaaattgtagcataaatatgtggtataaaatttcatgaaagtaatatgtagcattgcttgctaaatatagcattttaacattgttttattatggatctcattaacccacaatcagcaacatttgtcctaatataggaaaaaggagcttctaaatcaagttggtgtaataacagagaaaaaggtgtattgatattcattccttaaattccattttccaagtggaaaactgacatggaaagagtataacaatttaccatcattgacagagaatgattttgagataaccatgttacatgaggcatatcaaaggtcaacttgacatccgtggatcatactaccaccttcttctacacataaagcaggcatctacacataaagctgggagcatccttagtcatgttccttgattattagattggaattagtccttaatcccagtaataaattatattttggagcctataattgcatctctgaatgttgtgtctactctacataatttgtattgaattcaacttaaagtaagggacttaaaattcaaatgcaattgccttggtaccaaaatacttcttgggctactctgatttacttaacactcaagattaacagtagcactgtatgtggtgttaccattagggggcagctgacaagctcatctttaaagatcttcatatccctatttccctttaatttgaattacctagattcctagaataacatatgaaggacagaaaatacgcagttttgaaactcatggagtaagactttattatgtgtgacaactagaaactttcatagtttatgcatatttctatatcaggtagatcattaaatttaaccataagagtagatgttcaaaagaaggcattctatttatctcaacttcccattaattatatcactctccatcatttttatgatatgattttgtgttattgatatttattaaggcatattagtattctgtagaagactgagtatatttattgtactaaagcaaacagatttcacttaactgatgatcacagcacttgaactcaatcttatttaataagaccaagaagtcctggcatttgttttagctttgctttcattggttatacataaaattatgacttacttttaaaatgtgttcttcagctttggcttgcttcgtggcccctccaacaccaggtgaagctgttagtcccagtatctgaggaaggggaatcactggtttgttttctttcttgagtctattgtttttcaacttctgcatcaaataatgcctcatgatgttattatacactgcttctttgttggtgtgatgacattcatcaatgataatgagggaaaagtcttaaaagaaaattcaaagagttcatttctccatatcagcacactacagtgagaaaatagctttagaccagtaattgagctgccttggggatgccttctcttgggcacgacacaagagcagtccactttcagtttttaggagggaaatctaactatactagcacctgtacacacagacgttcgtatatactaatcatgaaactccctgttagacattctccttctttaatagataagattcagaaagtttacagagctaaaaagcgttagatgtggaattcacaccctggcttattacaaaacaaatctcaggattttacttttgttctttaataaaatatttaattttaggttggtgaattttatttttattacatcaagtgaaaaacacactatttaaagagggaaaattttgccttgttttaacattgcatttagttattataaattatttttatttttttccattctttctcctaccttctcatcctataccccataaaagacaagatttgtatttttattctatgggaaagggaagcagatctaacaacattcaatagcaaataaaggaacttgtcagaataaatggaaagtccagcgagtgcttgccttaataatggtattcttatgcagaataaagtggtctaattaaaaacttactttttttgtttcctccaggaagtagaaggattttaataaaaccataagcaataaaagacaatttaagccacgaacatttaaaaaattaacaaatacagcctttgttatcatcaatattactattaatttttttaaaaaaataaacacttaaactgacctgacaattgaacaccagcatcttctccattttccaagtttaagagggagttttcaaggatttgagctgtactgataataatatcacaggacttgacaacttctggaaatgatattttcagttgggtatcaccacttaatccaataacacgataccatttcttcaaaaatggttggaactccttgcggaagagctgttcaactagcagtaccttaaaaaaatgtgaagattttttaaaagagagaaagttagtcgaagccaaaagagtgttgatcaaaggcctgtttggcatccagcatgaaaagaggtgtttacattatcagtgaatcaggcataacaacgttcccatcactcctttcattcatctgtcaataagcactgattatacccttgttaggtgtgggcatttatgtctgggacacaaagatatttaacatatggttgacaactctgaggaactctgtctagctgatcatacagaccaagactaaacaaagcaagacaaattattacaacacaatgtaataatgctcacctagaaacacacacaaagtgacagttaagagaagaagcaactgacgactcaaaaaaggggaatttgaaggaatttgaatctagtaagccatgagtcagtgaaaagataaactgaagctaaggttgaataagaaatacatttttaaatttgtagagcagtgccaggttataaagggctgcaaacatcaagcagagtattttacatgtagtataacagtttacaggatccctacaagttgtactgttgaagtgatttattcctgttgtttgttttggattagaccagaagcaacaggcccacaggaccggaagaatcagggaaccacaagtgaggagttagggcattgactaggagaacagatgtgaagtgaagaaatgagctgctggaatagctgtggtggctgagaaagaacaaacccgaaagtagacctggcaaaagaagtggaaacttcgggtccttctcagctgattctgtatgttataacatctgctgaaggtagctgggttgacacctcaatgctacacattactagtcactcaaaataccttctggattaggagaaaaaatataaggccatcttgaaggtcatatcctaggaagatttatgcaatggaagcccagcagtgtacaatatgggaaacagagagttggcaggaagagtttcaagggcaagcttcaaagaatgcccattatattattcactctccataattctaccagaaatgcaatcagtggttacctttctcctagtctgtagggtttgtgttattcatctttttacttgaggtaagtcccacttaggtgttaaataaggaatggctgatccccctggctaaagggaacagctaccttatgaagaacactggtttactttattatttagtggaaatgatggaggcttccaaaagtaggtgtctggggggctggaagaaggggtggggaagagttaaaatgaaatccataaattctaaggaagcaaagtggacttaaaatcagtaatcaagttggtgagtgaaagaacattaccttaccacaaggtggaaagggtagaaagagtaagaagagaaactttcatttagttctttttttttttcaaagtaaagtctctctaatctacctgttacaaacacgcttgagaagtttagaaaatgcagactcctaagtcccactcaagaattactgaatctagggacaatctctggggggcagaggcttgaaaccttcactttaatgacatttaagcctttaaaatttgagagtcacagctctgctcttctctctctcttccacaaagccgttcttgaatcattttctagaagtattctttccatttcatttatgcaagacagaaggcttctgaggaaaagaatggaaattaagtttagtggaaagagacagcatgatgcagagggaagaaagccctgaaaacagctactccagccacttacttctttgtaccttggacaaggtctcaatcatcttaatgctctcaatttccagattaataaaatgaggataatgttaacctattatagggttgtgaaaattaaatgaaatagaggatgctgtattgtcagtactaaaacttccacgatatttcaccaatccttttattctagaaggagggtgcagtggcaaaggaagaccagtggactcagaagataaaagttcgtgtctcatttctgctgtttcttggctggatgatccctgaattgccaattaaagtcttgaaacttcagttttctgatgggaaaaaatgagaataataaagactaccttatggggttgctgtgtagatttaatgagataatatatctgagagtgctttataaagtgcaataaaatattaattatcatattatcaacatatatctctcatctttcttctagactgtatatttcgtgaggacaagatctacatttgatttgtctttaaatacactcatgctgaatgatttaattaagaatctctgtattatggagtgacattgcaccacaaaattctgcccataaaaggtgagtcaaaaatcttcaaaagaagccgcaccttctgatgtacagaacaaaaagaagttgtcacaggagatagcagatgctggaaatcctgatactcgctctgggtggtgttgacttcctactgaaggacacagagaaagccagatgcaagtctgacatggctaattgggaggtgtgtggtcctcttggagccttttcttgagatgtgacagagtgcctgccaagactaatcaaacccaactgctacccacttctgctgaatcatatggggctgcattgcagcatctgaaggaacctgggatttatctctcatgatgttgaagccctagataggaaatggaaagtctgggaacacaggtggtgttttcatttctctctgcattcgaaggctataactttggaaaggacggaggaagggagatgaaagtaaatggtgttagagaacaggatttcttttttctagatcaagggtaacaataccttgttgttgggccaaacacaagattcaggttacttagacttactgggccagaggtgttctgactcaatcaaaaagaattaaaactgaaattaatttaaaattcaaaaagatggtatagtaaacaattatgacatagatggaagaattagtggagggatttctagtaattctaaggagaaaaacaatagaaaagcaataaggaattagagtcaagtccccaggtgtccacacaacaatgcagtgaatgtgaataattaatgaggataaattaatatttaaacatagccataaatgtgcattccgaagaatcatgtagatccaatgcaatgaaagattcctggctagaatatagcattgagaagagaagggaatattatagaaaggaagatgcatcagacacatacaaaaatatgagacttgaaaagatcaatagttaaagaaataaacctaagtatttgaatttaggctcagaaactgactgcacaaaaataaattaagaatgttctagtttaagagattttcaaataaaaaggaactgaggattttgattctatgacaaggtccagataagtctgtggatgccagaggcaaatgcggtcataagctgggtgtcatatctcatgtctcctacgctctgcactggtatgatcttatctgtagtattttgcccaactctggacaccgcatttaagagtgtcccagaaaaatgtctgaaggagtatgagcactaggaatgatgacaggtttagaaaccatgttatatggaaaacagttaaaggaactgtggacatttattccaaggaacaacaaaaaaaagtaacttaggagccacatgatgctgccttgtctatgtgaagggctgtcattaggctggagaattaggacttcgtgtggttgcagaggaaggaactctaaccggtgattgtgggattccagagaaacagatttggatgaatacaaatagggctttctaagagtgtcagtgtcttgttagtagggggacctccttgatattaggaagttaccctgcagaagtgagagaaccactctgcaaaggaagaaagctgaatctcgaagccccttttcaactctattagcctatgtccctgtgaccagataagggaaataaaggaagtagatgaattaaaactaactcctaggtgtgggggctgcatgctttggaggaggtggtattactcacaaagagacaggtaaatggggaagaggagcctttgggagggtagatggtgaggctgagtttgagaaaatggcagatgctcaaatggtttcaaaattatcagtttaagtagctttgaatccagttaacttggttcttttctttggatttggcacttaaaagcctccctggttatgttacttagtttcatgagttatgaaggtgaagagaaaggagcaggagaaagctagtatttaagagtaaaagcaggagtcattactaggccatatataatccaattgaaatttcagagcagggtagttattattttgttcattttgcagatgaagaaattaaagttagagaagttactaatttgtctaattcaaagtaccggtaggtagaaataggattcaaacctatttcatttaaaaaaataatatcctgtacaaagggaatacatatgcaagtctatcggcaaacaaatttgaatgtgtcaccattaccagcaaaataaataaaagtgttttaatagtaagtatacaagtataaaggagagctctttggacttagcagatgcacacaaaatgcatttggaactacatgataggaatcattcaaatcatggattctaagtactgaaaaacaggatgtaactaaaacttttagcataatagaaataaaaaatagaatattttacagtctactgcttttttttataaaggaatagataagaacagaaaaaagactttctgatcaaggaaaagtatgctcatttttattccataaaatagtaaatattcatatccccaatttgtatatttataaattaataaactgtcatttatctgaataaagctcaaatgactagattttgttttacggtgaagcagacatatttacttatgaagatggccttcaaataccctaagatataaattattgaaggaaaacttcagttgcatttaatgtaatatgtgtatattttatatatatatatgtatacttcttgagcattttaaaatctatttaacttgatgtagataccaaaccttcacttaattttatctccaaaccacattatatgtattctggagaaagaggacttgccatctttgactaagggtcaacagctaaagagaaagtaaaaaacaatatttgatccttgattccagtgatattttggggtcattcatattcatttgcaatgataaattagctagttaaccttaaagtatatctgggtaaatataacctgtgaccagataagggaaataaaggaagcagatgaatcaaaactaactcccaggtgttggggctacataagttatagctatttggtataatgtcctagttttattgaaaaatttctattttcaggttcatcacttagatattacatatacctaaaaaagattaaagataaaataaagagcttattttgacattactcttaattaaactaaacatgtgtgagtcaatgacacaaatgccatcatataaaagtttcagaataatacaatgaaaatgatcaactagtgttatgtgttctttgaataccttattgacaagaactataacttttccaggctcagatgcttttttcttcttgtctaagtgatccttggcaatgtaaacagccactctggtttttccactccctgtagggaggcagatgatgatattcttcccttccaaggctggctgggcaacttccatttggtaaggcctgagctggagttctggctccggggatgctcttgctgccacattctcttcatctgaagaaggttgaaaagaaaaataagagaagggacaacaaaataacagagcttaggaagcctgaaactgaacgtaggcctcttgtgctttaaactccttttcacatgtggtccaaaccaattcattttctcttttctgtaccaattaatgtctgctctctgcatctgcagaatacaacacaggctccctctcacagaaggagtctgggggtgtgggggtgcagagggagtcaactaattaagaggactggaaggagcaacatgggggagtgttttcacagagtgggtgaagccaaggcgaatttgtagaaagggctgtggtgcgggattggcaggtctagttgttaaggcatcagacttcccatttctttgtggagccactatgccctgcttgtttcacttagcccttccacctacaaaatcaagaggagctgagaaagttggaatcattagtcctcccaattccgtatttcccctttttttaattgcaaagaaggtattatggctgatactattttctttcgtttgtagaaactttatctgacaaccaaataccaaaaagcacacacacacacacacacacacacacacacacacacacagacaccctatctatctcaagttcctttttccatctgaggcaactacgttgtacagaagtgttatttagagagtagaggaaaaaactcttcctatgctagcctttaattggtaggttttccttgaaaggtaaaaataattttgttggtttaaactaaatcatgactacttttgccatttatttgtgaattgttatctttattacttccttatgtttatggctccacatattccaactttttctaaaatccaaagtataatatattaaaaatattttcaattaacatggattttaaatttaaaatactgataaaataagttctaacataaactttatgtatattaaaataaaattattataatatgtcttgttttagatagaatatattttatttagaagtgaccatattgacctatattaccaggggaaaaagatcaaaaaatgcatagcttataatgtgaaatgaagtaacataaatattataccaatttaaaagcccattttatgacttatataataagaagaaaaaatgaaataacagtatttatccatatttcatcacacatgaaataacttctttttcttatcaatgtttgcaataaaactaaactaacataatcccattaacttcaaaaaacttgctgatggctccatttcagcccctggataattctatttgagtgagttttaacttgttgtgatagtactatctgaacaggtaggaaaattcacaccaaataccacttaggatcatctactaacctggcaggaaatttgccttttgtatggatgagtaaaaacagatgcaatacatttaagctatcgttggatcatctgctgattcattcaatatgatttttatgaaaaactcatttaaaatcaccagcatttaaaatatacctttataagtttccatgcttgttttgaactctacaatatttacaatagttcatcttgtattatatttatgtaaggctctgatttatttaagaacaatgttagccctctgtagctttcatagactatcaaaaccatgatatttcacctctattaggatagtttgtcatctaacttttccaaaagagccagtatatttgcaaaggaagatgcattataaagtgtctaaacaaagacccagaaatttactactgctaaatttttgtttgatctaggaagtttgttaaaatataggaataaatcctctttgtttaatttcatctgagtttcatttttgcgtagattttaagaatactaataaaatgctccttccttcataatagttgcagaataaactattaaaagagtacattttaataataatttcccccatttttcatgcttactactatatccttgaataagaaatattacaaagagaaagatatagcaatttcctaagtctctttcccgagaatccagaaccaaatcaaatgagtaaaatattaatattactcatgcattctaatcatttattaagctgatacatttaagaagagcgagaatgttaaaaggactattgtgtttacaatttaacttcagaactgaagtcatgaggttttactgctacttaagtaggcatgtaccacaaatttattcttcagtcaatattgactggacacctattatatgccaggcactctcaataatatagttgttgtcctgaaggactttagagtctaggacactataccgctgttatgcacacaaaaatacctggttagacagatagctcaataatcttccatatttttgatttaagactaggagatttgataggtggccctaagtttaaaaagaagcacagtgtggatacaggaaaaaattagagttggattcaatgtgagactagcatccaaagaataaaagctgggtgagtgctaaatattcagcctgattcttgccttatcacatcctctgacacagggatggaagaatttatccacagaagcaatgaaaagagagttttctcttctgtgtcagcagaaggagagaactgggctggtatcaatgagccaggagccaatttcctttataaaagaaatgtttgggtttttgattgtttgttgtttgtttgtttttggctttctctgaaaagcataatcaattaaatgaaaatagcagttaaaatatgcacaagctttgaataacactgtgccctccctctacaacaagtattgattaaagaccttaaaattatattctaccatataaatggtcaaaaaagaaaatcaaataaggcttaaataataatattctattggaactacaccatgtggcaaatttcattctcacattgattttgacagctgagttattcttggagagaaaaggtctgtcactgcatgtgtttgaaatctacaaagtattcctttacctatggtatgtaaccacagaaaaatacaccattccagctggacaaatattaataggcattatcttgaaatagtaaggaaacactttctacatatcaggccaatatgtattgccaaaaacattgccactttttgagaggcaatatatctttctgaaaatgggaaacagaaaaaaaaaagcctctcataatataattagaatatttatactttaaaagtaccggtaatcatgtctactatggcataacacttccacaaaggaatataatatgattgttttgggtcacaccttatggcccatatatgacctctggaggaggaggaaggacatatagaatgaagtcccttttgatgtcaacttcaaagattaaaacacaattgcaaattctataatacttttcagtgcctcaatatgtgtttaacagttcaccaatttatctaaacctccttttgaattggtttctattttagcttataccaggcacttgtgggcaaggaatttcataattttaccatttcggaaattgactacccactaggcaaagtaattctttgctcctaagtactgatccatctagaacttcaagtggtgttcgttctgatgtgtttgtcttcaaatatgtatttgcctttgaaaatgtatttgcttttcaaaagtagattgcgttcagacttatcatgtgtttcatgccacattgaggactaaaaatcagcaaatacatttgttaacagctctaaataggcaagatgccctgcacatagaaggtacacattaaatatttattgaatgaatggatattattgaaaagcccttacttagacaaatgaaaattagcatgatctccaaaaacttaaaacaacctataatgatgttaaatattagctagattatctattttgagttctagcatagcatgtaatagaaatgttaattattaaattgaacaattttatgacaaggatagaaaaaacaaatataatccacagaaataagcacatggcaagaactcaataaacactgactgaattgaacagaaaatgaattcacccttttaaatgaagattaaagttgtgaatgacatttggtgaattgggtttcctcaaactaatttgttctaagggattcaggagtgtcattgtgataaaaggatatatgaaaaaagaggtgctacaatctaatttggaaagcatttaggattgatgacaatctttctataaactattttgccaccttaggcctcttgtggatatcaatttttataattcttctgacaatgcaggataatctgaattatataatatattcttaggggaaacaactcaatcacaaatgaagaataaagtaatgtgtttcttaatttatcatttttccaatgcttcttagctggccccttgcaaagcattttatttttgtttgtgatttgttcattttaattgtgaaatacttcaaacaggtaggcaaatatagaaaggtatgtaatagaaacccactaacccatcacctacatttaataatgttaacattttagcttagtagtcatcatggaaatatacactcaaagaaaagaaagaaacaatttgaaatctatcagactaacaaattggaaaactgataacaggaagtaataattaaggtgtggggaattaggaagaggcactctcatttattgctggtggaatatacaactgatattgaaagtaatttgggaaaaacctggtaaaattttcatttagtgaccgaaatattttgccaactctactcctattcaaaagatacttatacaaacttgacttcttttacttacatatgtaatttctagttagtcatacttctcttattgatagtatcaattttttatttaaaaagtattttaatttaaaaagtagaatttggaagtaaataaatgtaccaaattgaatacagtctatttaaatgcagtcaaattaattgaaacagatcccataaataaaatagatgacatgactctatggaatgtggcatatgccagaccagaaagatatgtactggatcaaaattagagagtttggttctaagagtttgtaagttacacttttaaagaaagtgaatggcaaagttccaaaactatttcactgtagaaaagaattgctttaattgcataaatacattagggagggtatgaacagcccccatgcttccactatatggcgtcttatttcacactttttaaggtttacacaacagttaggcagtacctgaatcacttcccatggtgcctgaatcactgcccatgttgctgttatgtccaagactttcatctaagcagctgacacttccttctgccaaacttgtgtctgattctgcaaaggaaaacattttaaaatatttttaaaatatttctgagaataaacgtattttaactgcacacctctacagcacacagtacatacagttcaattcaagtggggaaggcacacccagacaattatgaataaaaggtaagcgcttctggcaggctacattaagaaaaatccactatggatgagcagctgctgggtagtgattcaaatacatattacctacttaaagtactacacatccagtatgagagctaaagcaaattcctaagggtttataacttttattgcccttctacatgtaaatgttgcccaagaaaacactatttaggtttgatatgtcttttaaacaaaaaataatacatagaaacctttgaggtcttttcatttaaaatgatagggaattaataaagtacaaaaattaataaagtacctggatctactgatcagttatgaaaatgatagtttggtgataaacatagatgtaaaatctcaaagagaatttgttcaaaaagaatatcactaaagcctggcatcacagttgtactagaagctcatgtgaggttggaaataactgtttttctttactataattagattaagcctctatcaaagagttatggttaatatggatgaatagcagtgcacatccttcatttatgaatcctgacattctgttttcagaactcaggatcaattctttttgaaaaccttctttccctcagagaagaattcttttcttacagtttatttccaaacacttacacaacctcatcctcaagcaccagaactatcgttaaactggtaaaaataaagcaatggtggttactaatattggctttggaatcagaaggacttgcaaaatttgctattcactttgctctgaacctaacaagttccccttgttttaaagtgaggctaatcccacttacttcacagcccttgataatctttaagtaatattaggtacaacaagctcttggcacaggactttaattgctggcaattagaaaatgaaataaaaatcaagaaatgatatattcttaggataggagttccattagataatgttcttcttttaattaaaaatattttataatatttatacttagataatatttcatcctaaagcctcttaacacaccaatgaggtagctcttagctatttaaaactagtctgagtgtcatatttatggctggaaataaaaatggatgaaaaaatagacacatagtatgttttaataaaacttctctgaaaagagatgatatacaactcaaaactgcaaatatttcctttttccttaagtagttaattttttcaagtcagctatattaagatataatttacttactaaaaagattactttttatgtttatagtttgagaagtttgacaaatgtatacagttttgcaactttgaagaggttgacatatgtatacagttacgcaactaccatcacagttaaggtatttccagcaccccaaaagtctcctcaagcctctttgtagtaaatccctctggttatctaatctggtttctgttccacatcagacaaccagtggcaaccactgatctggtttctgttccaatagtttttccttttccaggatgtcatatgaatggattcatgcaatatgtagcctttatgtctgtcttttaaaacttagtttatagtaattgtgattcatctacgttgttgtgtgtattactaatttgttcctttttattgctgactagtattccactgagaatctgtgacatttacatctcccatccaatttggatgagcctatttagtttaagagctataacagaattacagccaatgccaatcaaatatgtaaggtatctttcttaaaaattaaaagtaagctgataagaaatttgtagaaaaattctcaatggacatacatactgtttaagtatattagcacaacataaatatactaatgtgaaaatactgtgcttatcagttgtcgcagattagttctaaaactcagatttgaggaatcccttatgatcacacgggaaaacctgtatatctcactgagagatttaaaatatggcacctcgcaattcccagaggtatgtcttgttagaagctcagaggcgaatgtgggatagaactgtcaagtagaagagcgttttgggcagatgtactgatgaaaagagaatatgatttgtaaggaaaaggcaaggtgtaaaatgagatggggaaaatgtcattgcaagagtaattctagatctagaaatataggctaagatttttgaggcaaaaaagtgaattttgacatgcttttcatttgctgttttaaatgtaatattgagaactgaagagaataccaaaattactgaaaaaatactaacaaatatctaaaatctaagactgtatcattaaattttccaagtataataaaaatgaaaattatatttgatttccacttcattttctaatcactagcagttaaactttaatcttaaacctacttcatctacatgtagagtcaagatttctcccaagctttgttctaacatccgtaagttttgggagggagctatttatgcaatgtgcacgaataattgatgaattgttttaaaagttgctacccaaaatagggtattattaataaagtctattatctggattattttgatctaacaaaccaatcaccaatgtgtcaggaagacactgaactcagagttttcacagatgtaatgtaaatttcattttaatctctcaacattctgtgtggtagatacatattatctcctgtttcataggtgagaaaccaaggcgctgagaggttaactgatatatccagatcacacagctacagtggggcagaatcctcatttctgaatccaagtccagtgttccagtgctttttccgctaacactaagcatggctgatgatttgggtgaagttttgtaaacacagtgttaactgaattaagagctgtggtggtggtgtttttcaacagcaagagacattttcattgtattgtcacatttctatccatcttgaaacagagcttatctttccaagaaaagaacttagagagatgattttgctttgctaacatttctggtttcattgatagattttcactaactttacatttaagtgtccacacctctttttaaacttttttctgcactcaaataaaaagaacacctctgttctcgttacataaaattaattgcagtaatcctgtagagattattatgaaaatgaaagtgaatatatggagctcgatttctttgtcattttaagggtatataaatcttcagtttctccacataaaaataattttgtttcctaggcagcaaattcttatgcattttgatatacgtttttgctttcatagaaatataagtaaaatttaataataaaagaaaatatattgtatttcttataatagggagaatgccttccccagagatcttcctcctgcattcactttaaaaaccgtattacacacaaacacacacacactcccaaaaaagtgagatcaagaaagtgtttgcgtgaagccaaaattaaaccgacctattgagtttaaatgccaagaatttctgaaattgatttatttaggtttatcttgttttgttctttgtatttttcaaactatgtcagtctggatttaagtcctaatgaataaagtcctgcgtttatgattttataagtagatcgcatggagttaattggaggcaggccttgctatgaaaaaaatttgtgctttggagtccaacagataagtctccagatcgaacgtagccacgacttacaagcaaattaaccttctgttttaaaaaatatatagagagagatagtagtctctattttctcacttattgtgagaatgattcggttagaccaagaaaatgaaactcgaagagaaacaaattttaaattctcattaaaagggctttgaatattgaagttatattgtataataagtttagttaagttttatataggtgtcatttcctctagggaaaatatcaaagctaactatgaaacagattagaagatggtagtaattgaactgttaaagaaaagcagttatttatatcaaaagctattggaatgaatgaaaattataaccatccagttaagagataggattttctttcataattttgtaaacaacacaaaaaagaacagccttgcctacaatgacagcaagtgcctaagaccagcccaaaagccatggaaaaaaaaagccttattttgcaatcacatcttgagtattttgctaataaggcagaaatattaactgaaatccaagaaatttcttatttaacatactctagaccttaaatactttaaaatatttttaaatcatttagaaaccaaaaatattgaactttaaaatattcaaaccaaaaaaaataaataaataaagcaagaggttgaaggcctttttagatctatttcaatgtaaagtctgccctctgctggaaaaagctaacatggcaagtagtggacaagtaggcattctttattcaaagagctaagctccattaggtaaaattcaaattgattcttgcttctattcctaccaggtagtacctcttctatttttggcctagaggcatttatcaccccacagaatatctttcgtttctttcccctggcttcagtctgccacacactatttttcccgaaaagtggttttgcattacagcaggaaacgcgaggggaaagggcctctgtgcatattgagaaagaacagcaccaactgctcctgttctcctgcgagtcagtggtgacaaggtctttagtccaatttcacttttcatggtaatttcatgtttattctagttctgaccttgtgatgcattttagcttcacctttgcagctatccccaccttccctccagtttcataatcctcacgcctggaaggtccaagctaccccgaaagcttgaaacatgtgtgcacgtttgggcacacacacaaagactgcatgggcttctcaagtgggcttacactcatactgctaataatatatatttcctttccttttgaaataacttaatcttttttgagaggaaatagatcacttttattttcagctctatgtatatggatctacacacacacgcacgcgcgcgcgcacacacacacacacacacactcacattttggtctgtcagattttcctctccgtgccagggaacatgtgttcccacagaatggagagaagccacctccacccaccttgcatattctctcctggatccaagcttctaggaaatgagttccccaacgagaaaaatcactctcctagagccacaggcccacatggctatccatggagctcctctgctcctgtttatagaatttctactgctgaaatgtttctaacagaattaaatttgaattgtgtgtaatgaggttggcttagattgtatcatctatgccctttagcctttgcacttaggttctaataaagagaggtagttattaaagcacaggttgcaaggataacaacacacaccagaatgacccattcattcactgccagtcagtaatggaggcaaaaagtcctagagtagagtcagttaatagtgagaagccaggtaaccacatgggaagtaaatcttggcaataacaaggtttggagacggcaaggtagaatgtgaattagaaacctctttggctggtaagcacttttcaggaaaggctgtaggagttaagcaaacttaagcagacatgaaagaatggagggagatacgaatacactaagggtgcccaggtaaatgttcaacaactggccctttggtggggggagacaggatttttaaaaggtttgtcaatttccatggtgtaaatattcacaccgtggccaatttccagcatgatgtcctgtgtggagctggaaagagatgtgcacactggggtcttacaagccagtaagatccagttccagcgctctgctagatatattcctctacctaaggactttcctacaatcatcatctgagatgatgcttgtacacacatgcattgtgctggcattgtataattatccaaatgataaatggtgtacttttaaaagtgtgtgtgtgtgagaaaaagcattgtaaaaattactgttagagaaactcgttaactttcactgatcttagaagtcttaaatcctaccgccctcctccacaaatgctcctctctcatcagactgttcctctgaacacattttgagctctcttgtgcttgtgcttttgctcatgatgcctctgaaacctgaaatgttgcctgccacttctatttacaaatccagcatagtgctctcaaggctcagatgaaatatctgatattcctcatctggtaagctttctctcgtcagtcttccttcttttacagatcttctctcttcatcctgtaatatagatcttgcatctcttttaccatggctagattacagtttctttgtggaggcatgtcacttgttttccttcattagagtataaactttttgagagtgaacgcaattcctcagtgcttggttctctcaatgatactgtattatctgaccaactcacctccttcttcctatttctctggcttctgacctcattcacatcctaaaattgtgaagggaagatctgatagtcaaaattaaaatcactgcttttgttaaaactctgctaaaaaaacagctttatgtttgtagtcataaacagatatcatgaaaataaatccaacatgtattaactgcacactggggagatttctttctgtctttctgtcataatatttatgtccccattcctgaggtatgaatggtaatcctcctaggactattatgcaactgtaagccatataactgacccagatacctcatgctaggtttcaaataaaatacaaacttacataatcctttaacaagtaccaatatcagtgtcagcatcagcatctctctctttctctcagctcaaattaatatgtgtcttttggattgcctcagtagtactgctagttctcaataattaatgataactaagtttagaaaaattaaaaagtaaaggagtgctcttacttcaaaccagtcctgatatagcatgaatgattctgaaacagtcttattgtaaactactgtatcaattatttttttccacttaggtttcaaatgctatggttttatttctagagattctaaaaatctctagatttctagaggttagtgctacagaacattattctggtcctcaagtgcaaggataaattttgtggcacttttacagaaattagtatagaccaaatctaagattggactttagtctataaaaaggcaaaacaaaacaacaacaaaaaaagtgctataacagattggaccagggagaagaaggctgttttgtaaaggtcaatttttaaacccctcctacagaacatgatctatgcaaaatatatccacaatatattccaaagcataatgtcaccggataaacctaaggagtggaacatatggggaaatatgagaaagaaggtattaaagtctgaaaacaagcaggttggtaagctcattagctggggtggaattttaaaatcttcacgtgaacgaatatataaatcaaaatatacacatgcaatcacagtcatgcgcactgtatattcacacatggcacactctacagttacattataatctttcacgctgaaacagtgaaattccattggctttataaatgtaaaggcgccctctgctggccaatctgaggcatttgcattttctagttttcacaatagggcagctgtaacacaatgattaaagaagtttggggggattttctgctccattctgcataaaagtttataccaaatgcaataaagttgacttagttttaaatgtcacttaatttcctttgattttattgtaatgcattaattcctaaaatagtataatgaaaaaaggttaatgtgaagtaactattcacttgttttgacaaagcagcagtagcagacaaagactgactgcacaactaatttaactgttcgcttttagaagtaaaatatttgctatatagaagtcaattatttgctataattaaaatgcttttaatagaaaatgaaagcaggcttagtgtctctctgatgtttcctagggaaatctgatctagagaaacaccaaagttttgcagttatcttttgttataagacgaccagtgacttcagaaagcagaactatagcatccagcattaaattgccattaatagtctgagaactgttcaaattttgtttagaaattgttttggtaatttggaaaagggcaaataaaaaattgatatatcaattactaaccacttttttaatgagaagcaattgatttgtaaacataggtgggaggaggaaaaaggacacatatcaacccgcaagtttggagatatgatgaaatcactctctagaacaatccactagagaactctgatatgtcacctctagtgccaaagggatatgtgtttaaaattagtttcaaggtgggccactgttactgatggtagtgtgtcttatccatcagatgtgttaaggggtaaaaggtgctaaaacacacacacacacataatctttgcattaaagctataaataattaatatttgcatgcactaagactactatgcactgagaaaatatttgataaactggttcagaaataataattataaatatcttaatttaaaattacaaataatttgagtcttttctttatacacataaaaatcatatttacagactttgtgacaagtttttttcagtgctatcttggcaactatttgaaactttaacctaatataatggaattcaaaataaagactaaacattatcaatatcaagaagatacacaaaacaaaactacacaaatgcatattagaagctatggagcactttcacatttaccttgattgttacttctgtcagaaaatgcctatgcaggcaaaacccttccatagtaaattctgcaacaaaaacttcaatcaaaagaactcaataatttctctggactaatggtactttataagttattaatatcagtaattcttagtccttaagataacaaggaaacaaacagatacctggaatgacagcagcagtctaaagcaaaggtctgaagcaaacacactacattttcataaataagtgactctttgctagtgctctggaaagggccagaatggattaaactaacctgctttcaaatccacatgagaaatccagatatcataaagaacctatggactagaagaccattaagatgtttgtgaattggatggatcctcggattactgtgcagtttactgtatactcttacatgctctcagactattatatattttaatactctgtactactctttcatggcacttactaaaagtgtagctatacagttactactgctgggccgacacctccctcagtggaaagctccatgggggctgaagtcatttctttttttttgagacggagtttttttgttcttattgctcaggctggagtgcaatggtgcaatcttggctcactgcaacctctgcctcttgggttcaagtgattcccctgcctcagccttccaagtagctgggattacaggcatctgccaccatgctcggctaagtttttgtatttttaatacagatagggcttcaccatggtggtcaggctggtcttgaactcctggcctcaggtgatccacccgcctcgtcctcccaaagtcctgggattacaggtgtgagccaccacgcctggcctgactcatttactcttaattatctcttaccatcacaatctccagatagagtcatattaggctccatggccatgaagccatttctgttatgttcctgagttcacagtatacaacaaggtgcctggcacatgataggagtttggaaaatagttgttaaatgaaagaagtgaaaggaagagagggaaggaagttagggtgaaaggaagggaagggaaggagggagatagagaggaaggaacccaagaggaaaaaaaaaaataaaaagcttttctgtcccctaatatcattattaaaatttttttcacaagatacatctttaagttttatactaagaagtaaaaatttaaaaaaatttaaaactttgcctttaattttgttcactagaagttcagagcagattaactacaagctaatgcaatgcattagtctggtaatctttgatgataaaccctcatttaagatgcagggtcatctctcagcagtagctccatcttcccttctttctagtgtggatttacagaaaatggccagtaactcatagagatgtcgagtagcttgtaaaggacatttattaaaacatgaaaactccacactcagatagtgaattttggcattcctatagaatcatgatttctaaaggaaggtgcagctgctcaaatgaaaaacaacaacaacaacaaaaaaaactatcctgtataagctttgctattagcagcagcagcagcaccagagtttatgagaaaggtggaatcgcattacattaaaaaacaaacagcagctcaagcctataatcccagcactttgggaggccaaggcaggaggattccttgagcccaggagtttccagacaagtcttgacaacatggtgaaaccccattctctaaaaaaaatacaaaaattagctgggtatggtggcgcacgcccgtgatgccagctacttgggagactgaggtgggaggatcacttgcgcctgggaggtcaaggctgcagtgagctgtgtttgtgccactgtactccagcctgggcgacagagagacagagcaagaccctgtccccgcctgcccccagaacccccaaaaaaagaaaaagagaaaaatccacaaacaggctaaaaagcaagccaactgtgaaaaaaattggtactatttatgacaatgaattgatatcttatatacttagatagttcatataagtcagcaaaaagaagatgaataccctaatagaaaagtgaattttaaaagtattgataattaacaaaacaaagagaatgaatttgtgaaattctttttcagcagaaatatgaaaatgtaaattcaaataacgaaataccatttttaatagcagccaaattgaaaagattgaacatgataatattattcattctcgtagaagagaattcagggaaataagcactcatatcccatactcttggagaacatgtaaattggtacaagttcctggagtgagatttgacattaagtatcaaatgtgttaaaatagtataaatcatttgacccagaaattccaattatataatatgtttttaaaaagcaaactgtgacataagtacaaagagagctatcgaggcattatttaaatgttcaacaattggtcaattaatcatactgcatccaaatggtgggaccattatttagtcattaaaaaccaggctgtagaagaatatttaatgaacataagagaaatgacactatatatacacattcaggtatgtaaaaagcccagaagcacacatacccaaatgttaagtgtaatatccacattctgggaatattggtgacttctttgtgtgtttctgtgtattacagatttcttgcaatgcatgcatattacttatctaagtacaaaataacaaggccaggcggagtggctcatgcctgtaatcccagcactttgggaggccgagtgggggggatcacctgaggtcaggagttcaagacaatcctggccaacatggtgaaaccctgtctctactaaaaatacaaaaattagccgggcatggtggtgggtgcctgtaatcccagctacttgggaggctgaggcaggagaatcacttgaacccgggaggtgaaggatgcagtgagccaagagcatgccactgcactccagcctgtgtgactgagtgagattccatctccaaaaataaaataaaataaaataaaatgaaattaaaaaaataaaaataataaactttgcagtggtgtgctagagttagtttatatgggctcacaggagctaactggtaacttttcaggaattttctgagtttttaaccacagccattacaaaaattaaattgtataaacttaccataaaagaaattattttcaggcaaaggttgtaagtatttaaaactcatcacctaatcatttaactatcatctttgatctggaggctatctccgtcttttgcatctgtacggtgggaatgctgtataaagatgtgccactgcacagctcttcccagctttgtgttcagtgatcttatgttggaagcttgaaataagcctgaatgagaatatttaaaccacagagactagcaaatgctacaaactagggctttttcttttccccagagttacttgttacattcaccagcacaccacaggctttaagcaactatttcttgtgaaaacagaataagtccttttggcagagaaggggagaggtggattctcctatcacgagcagattagaaagggaaaaaataattaaataatttgtttctgccagggctgtttcagtatcaaaaaggtggacatggtagtcttcagtcctcaccgattagttaatgcaattcaagccaaccctagttcagcatctgttcatcttcctttttatagctttgattttaatttttacgacacagttgaacctctctgagccatcccagtttaaaccagagaaaaaaagcaatgaatctattttattttcagggttttgggtgaattaaattgactgatctatttataagtactttgaaaaccaggaaatataaggcattcttatacttatcttacaatgactatggatttcttataaattaaaattagatgcaattgtgttcatatttataacacatcgatattggattagttttagaaagcattttggccaagaattattttaatttaatctcctctaaaaatattattttaatataaatgtttactaaccttaatgcccacattttctccctctgattaataggttctgcccagttggtttttctggaagtagtaattactgtattaaagtacgtatgtgtttcaagtacctgaaactacagaagaatctgcaaaagatgattctgatgagttattctccatgccccagacctccttctccagatttggctgaactgtggttgaaagaagttgctcttccacttgaggaccatcaacttgtgataaattctcaatctctgtgaataacagtattagaatgcaaatcatagtgccatacaagtttttgtagagcatacataactgttattgttattttgaaaacaaactagaggttcctaatagagattgcctgaatatatttaaatactttgaagttctgaatagaatgtaaattgtattgcaatgcaagattttatacaatataaatagctgttattgttattttgaaaacaaaatggagagcccgcaatagagattgctttaatatattttaatatgttgacatttcgaaaggcttagaatgtgcttttgttatggcaaggtacttttaattttaatatggacacaacgagtagttctttgtaatgattagactgtagctaaaaaaacaatataagcattatgctaatcacaagaaaagtgatttcctgtctgaccgtcatgtttaggaagtaagtcacttattcagtgacacaaagttacatttaaggctgaattaatgaaaatgcaaatttggtagttttctttagctttgctcttgccattttgtttcctcactgtgtgttctgcacgagacgtacatctgctttaatgtcagcctatattcatgtattctgaatttctggggatttttaaaacatttaatgaaatattttgtgcccctcttttcttctttcctccattcctcacttccagcttttcttacttcaactacatgtaatgggtattttattaagggcttatgtgggttaaaaagaaaatcaagagtttttgcctttatgaagctgcaatctgtcagagaagactgatgccataaggaaaattttctaacgtatcattttttattatctcatcttaaagaacccagtgaaaatgtgccccactttgtatggaaaatttcctaaagaaaactgttgtgactttggacaagaagaaaacttggcaatgtttgcagttagatattaagtacattagggactattataatagttaatttattttgcactcacaatataaatactttacatacattaagttatttaagtctcaaaataaacctagatggtaagtaatattattgtctccattttactgaggtgataagtaatattattatctccattttactgaggagtaaactgaggcatagagaagtcgagaacctggccaaaggtcacacattcaaggaaggagcctggatttgataagcatcaggatccgatatgtatcaggacccagagtctaagctcctacagtagtctgtttatgctgccataataaaacaccatcaactgagtggctgaaacaacagacacttcttttctcacagttctgggcactggaagtccaagatcaaggtgacagcagggtcaatgtctgatgaggactctctccttgatttgcagatggccacgttctccctgcgtcctcacacggttaagagagagaaagagacagatgtttctctttttctctttcttcctcttcttaaaaggccacaattctatcagattaaggccccattcttatgattcatttaatcttttttttttttttttgagacggagtcttgctctgacacccaggccagagtgcagtggcatgatctcggctcactgcaacctcagcctcctggttcaagtgattcttctgcctcagccttccaagtagctgggattatagctgcatgccaccaccccagctaatttttgtattcttagtagagatgcggtttcgccatgttggccaggctggtctcaaactcctgacctcaggtgatccacccgtcttggcctcccaaagtgctgggattacaggcgtgagccaccacgcttggcctggctcatttaatcttaactatctcctactatcactgtctccagatagagtcatattaggttccaacatatgagtattaggaggacaaaattccatctgtagcattttaccattggcttcccaaaattcatatctttactacatacaaaatacattcatctcatctcatcagcccaagtgccttaactcactgaagcatgaactctaagtctaaagtcaaaagtctcacctaaacattgtccaaatcagacgtagatgagactagaggtgtgattcatgataaggcaaattcatcaccagctgtgaacttgtgaaaccagttgagctacatgtttcttttccataatacaatggtgggacaggcataggatggacgtcttattccaaaaaggagatataggaaagaaagcaagggtgatgggtcccaagcaaatccaaaacttattaaggtaaattctgtcacatcttaaggcttataaggcttgagaatagctctgtttggtttgatgctctgccttccaggtccacggaatggcaggttctagggctctgcaagacagcctgctctctctaagggctccatccacacagctttctgtgaggatagctctgcttctgagacactaggcagggtcatcctgagggctcactaaaaccagagagacagttttgccctttgaaaccaaaaaggaaactgccttggcctctgggtctgtggtggaagtggcaaccctgatgacttctgtatcacttttgggggcattctttcctttccctgaagaatagtacacattcacagccaaatagctctatggtctggttctgtagaatccagaaagtccagtatccttttctcattctgtcctgctttctctgtctccttcagttcaaactggaagtgtatttgctggtataatatatctctactcctaccttctgctgaaatggctgattaagtccatcagtagcacccatgatcttgttatcaattggttgttctctttataacacaatttctcattttttgccatatggataggctgagaattttccagatatttaaattttggttcctttttgcataacaactccttcaattaatttctcttcttttgcattttactataagcagttaggggaaatcaagctgctccttcagcattttgctaagaaattttctcagccaaatatccaaatccattacttgtgagatcaagttttatcccattttataacaaggatcacctttcttccagtttccaatgacatttttctcatttctctctgtgacctcaccagaatcaccctgaacacccatatttctaccattcacccaaaactcttacagtctctatcaattacccagttccaaagccacttccacacgtttaggtgtttgttacagcagcaccccactttttacagcaaagttttcattagttagggtcaccagaacaaaactgcaatgattataattaattaatagttaactttcaatttgtctttcatatgatatttttggaaacataggatgcatactacgaaaagaaaaataagatagcagtttaagtgagatttacaaataatgtaggagaaggagctataaaatgttatgttattactattattgaatgctgtttaaaatctcacattaggtaaggttgagatatattgacaaaacaatccttttatcaaatgcttaatacattgcttaaaatgtataaaaatgttcagaagaatatgcagcagattttttataaccactaaaatactttcttccaatgtatttgtgtatatttaatgttacataatcttgataaaatttctggtagtcatattgtttttaaaataaggtagtagaaagagtgttggttggatgaaaaatggtctttgatcagttgatattttcccaggcatcaatttcctcatttgttaaggtgataaaatagatgatctatcacatatgttccactcttaaaattttgattctaaaaatcttggtgtttagcattgtgtctttctgctttattgaattctcaatcactaggcagaatttgaagaatcttcctcagtaaaattacaaatacctgcattgctttctgagcaatcagagcctgttaactcttggacaagttcattgtttcctgtttgacgaagaacattcagaaatgcagagaaccagttttctttctgcacaatcctttttagtagctctcttacacctgattcatttccattgttttctgcagcagcaatctgttgtaagagaaaattagaattaagtaagatcaaacatcttctgaataaccttaaacaggaaataccctttagaaaaactgagcaattaagcataagtataaataaaggcttacattgaaacattgaagaaaatagcaatgttacctgtagcaattctgaagtcggcagggaaaaaaatctccgggacaacaacaacaacaacaacaaaaatctctggaccaagtgtccttttaaatatgaaccattttttttaaaagctattgaattattcaaacctgacacctagaaaataaattttacctcagccattcctgaataaaggatagaagagaaagtatctttagtctgcagccatgttatgtctattttcaccaatttctttctgtatatctagggctggctatattttttcaatctatggagtctgtaaatgggaaatcaaacatttcttatctcctttcttcatgattatcattatgaaataagtaattactactgcagatttatattttttcctatgtaatatttgcatagttgattattactataatcaatttttctcaaatttgtgtttttttaatgttatgggaaatttattgttatatcttttttttggaaatatggggcagaattatttttatatccattcattagagtctttagccttcttttattttctcttttagattagtaaatttcttttaaatgtggatcttttgtgtaatcattgtcacagtgcatttccctaggtcctaatatagcaataaggatttggaggaaagagtaactcaagccatgtttagacatgaaagaagttaggcaggacatcattagctttctgtggcattaggcaatttacttcatctccctagaccttggttacaatatgtggttacaaggcagctgaaaagaaatttcagagtttctatatcttagctgcatgttagaaacaaccgtaaagccttaaaaaatactgatgtctaggaaacacccctaaaagattatgatttattttgtctatgttaggaactcagatattaaagaaaaagtaaaacatctcatgtgattctatcagcctcccagataagaaatattgactttgatattatcaaaggtccttctcaacatttgccaatcttccacatgtatcatttggattgtttagttctttcctacaaatttatgtattttctagttctataaatatattccataaccttttatgtcagaaatttgttaacatttttggaacaatgtctggcactaattcagtgttagaactattatggatgattgggaagagttattgttacaaacacctcacctgcacaagcacatacagcatggtctctacccaagggatatttccgtcttagcatctagtagttaagcatgctgttctagggaacttgaatatattaacccagcagcccagaaataggtaccaatattaactcatttacagatcagaaatccgaggcacagagatgtttaggtacctctctgaggtcacaaagtgagtaagtggcagaagtagaatttgatcccaggcagttgaatttagaggctgaatcctgccttcttgaactataattatagcttataattttctccaattttaaattcattttctggcaagaagtggttaaaaataactatttgaactcagtaaatttcaagtgaattcagtccatgtcacccacaacattttctaagcagatttttgctcattttttaccatttttttctagctctcttagtctcctaatggaaattctttggcttccctgatgttgtaacatctttattatcatctgctaatttaacaagtaattgctatagatgtaaataagactggtttcagtgtcttcttttaactcagccattctcatattttattaccccatcctttaatcagctttaaatatatttgactgaagcaatcaggaaggatttccttaaaaagaaccagtgaggcaacaaatgctgttattaaaaatccctaagcatattctatccacaaaattttcttcaaccactattctattaagtcaacttttactgtggaatcatatttttcaagctttctttgccgttattgagtccaagcatataaggatcatgatgtcattatttcctaaacatattcttacaatttgaatgtggaactacatatatctgtgcaattttagcagcctcatcaagatgctgaatttttaagaaatcttctcagttttggtgctggaaagtacatcagctccctttgaagcaattatataattttaaaaatttaatatgttctcctaaaacattgtaaagatattgatcccaatatgtaaacacaattacagaaattcgtgggaggtgaatatttacatttgagactgcaacaagtcataaaacaattctcacccatgcccctcccccactcgaagttttctctgtgaagttaaaaatggatggatgttttcactatgtagtctattaatacattgttaactaatttatgaaatacgaaataaaattaatttggtaataatacaactcaatgctttcatattctaaattctttgatatgttttttctttccaacagaaatcagtgaagaaaccaatgacatttccataaagcactggcttaccaacacaattgtacagtttaatgaaaatgttttcttccctttataataaccttagatagctatttaaatataatggtgatttttttaacccagcagagttcaactctcagataaaagtaaatcaggaggcaaaacctgtatgttaaaaaagaattttaaagaaccagtttcccacaaaaagttaatgtcttaacccaatgaatatttattgtcacattgacatagctaatttcttattcatacttttttttttgcagatgaaattcttatctttcctaatttgccagacaatacaatgttcctggggagattgacttgggtgctcaacttcatgttgggagaactggactgttcttaggtggactagtcatggcatctctggttcttctgtgtaaatggaaggtgtgtggagtctccaggactacagatgcattgtgttctgaactggccagggatgaaacatgcatctctctttagctgttcagcttgattattaagacactatggaaatgtttatatgatcactttcgttcccagagttcatgactgcctaaattgatgggtgtgccaagttgtaacttagttataactaagatgtaacaatgccaaattgtaacttagcatcctaaaagaggagcaaggcagtacaggggtacccccttaccattaaggattgctttattataatgattgataaaatggcatatatttattgctgaaactctagtatttagaatagtcccttgtatacagtagacattcttctttccttccttcctttcttccttccttccctccctccctccctccctccctccctcctttctttctttctttcttttctttctttctttctttctttctttctttctttctttctttctttctttctttctttctttctttctttttctttctctctttcttattagatggagtctcgctctgtcaccagggtggagtgcagtggcgccatctcagctcactgcaagctccgcctcccaggttcatgccattctcctgcctcagcctcccgagtaactgggactacaggctcccaccaccacacccagctaatttttttgtatttttagtagagacggagttttaccgtgttagccaggatggtctccatctcctgacctcgagagccaccctcctcggcctcccaaagtgctgggattacaggcgtaagccaccatgactggcctacagtagacattcttttatcaacactaattaacactacaacacaacttcacgaaaggacaaaacagtctctgtgtttttctcctatcttttcaccactagcatggcatccggcacaaagatgccactcaataaattcaaactgaatgaatgagtgaatgaatgaataagtttttgggtacttgctggacacaaacctatgtataaagtcattttcagaaggcctgctgtaattacgggcaggggctaggaaatggggtgggaatcctaaattaaaataatagatcaagtagaaaatgtctatggggaaacagaaaaagaatgaaaatacaagaccattttatagaagtcttgattacttagttaaatgctattttaagccttcaaaaaagcaaatttggaaatcttattttcatcattcatccattctctaacgcctggcaacacaattcaatacgtcatgtgttttcaacgcttattccagacactttcagaaataaattcaattagtctatcaatcaagtaatcaatgcttactaaacaccaaccctctacctaatcctagttaggttctgggatgaaagaggtaatttctttttcaaatcagtataatctagggactttaagaagtatatctcaattgcgacatggggaatttacctcaatctctcaaacttaaatttacacagaaatgtaaccagatgaatggttacaaaagtcaacaccattatcatatcaaatagctctgatttataagctttttcataaacactatttctgatttgatgttgactaaaatactgtgagaaattttatgatgtccattttcacaggtaaatgtagcatcagggaacttcagtaatttggcccaaagtaacgcatatagtaagaagccaagatggacctcaaatccatgtgttccccttctacagtcttatcacactttgctgctgtaagataaacatttgtcaatgaccaccacctcaatatagattattctaccaaacttaatgcttccgtctcattgtccaccatatcttagttttggaactgataatacatgtaaatgatgcacacaaaaattattccacactctcacagagaaactattgcttcctagagagcctcaaatttatagctgctcagtcttttggggcctcctttgaaatgtgaatcagagggagaatttgggttgttttggccttaactgctaccagtacacaaaagtcccgttactctatatcttctttgtgtcaaatcccttgcattactgctagctgcctccaagcttgccagaatcaagaacttggataaaatctagctggcggaaattcaatccaggcaagacaaaagtgatgctgataggcagaagtatttagagtaaatagggagaagtgctgtttcgctggcaatcgggacatcatacccaccaaacataaacagctttgtggtgttactggactctgttgcttctggacttctaacagctactgtggctggaaatgccatcttccatctccagctggcttgaaggctgcatactttcttccaaattaagattctgccacagtgatgtacacatttgtcatatccagctggactactataatgcgttctagctggttctcaatacacaaaacgacataaacattacagacaacagtgcaaagtaatttacttgttgggaaaactggccatcaaaattagatgcatgtttgggtctttggacaggccctgtgtctgtcaagtctacaaaagatcactaactttattcactaaagactaaattgcatcataggctatagcaaatcaatcaaatgcccagaagtttgtatgaatatacaaacaatggatgacccaaaagagagagagagaaaaaaaccatgtgaaaatcatagagtggtgtagacaaagcctttgacttttagtcatggctttatttgtctacatgtcttccaaaacaagacttttgacttacgagcctgaataagtcacattcaaacaggtcagcatttatacacatcacagtacatcttcacttatcaaaaaataattcatatcacattcaatgtaaagtcatcagtaaaattcgccctgtcaaaatgctaccttaagaaaaatgagtttcttcactaacatgaaaaactgaaactagcaacacattctttcaatgaattgtttctaaattttgattctcaaagaatgttgaaactttgattaaagaaaaagggtgtgtgtgtgtgtgtgtgtgtgtgtgtgtgtgtgattgcaatttacccatttgggctaagactaaatggcacaaagtgtaatgtagggcaaagattggaaaactttttctctaaaatgccagataataaatatttttggctttaagggcacacagtctccatccaattgcctttggagtagaaaagcagccacaagcaatatgtaaacaaacgagcatgactgtgttccaataaaactttatgaacactgaaaattaaaaattgaaaaatctgaagaccattcttagcctgtgggcctgaaaaaaacagtagcaggcttgatttagcccatgggccgtagtttactaacccctgctccatggaactacattaaataagaaaaacattcaacactatcacaagctaaattcttagctctgccactgtttttcctgggagaccttggacaaattatttaacctgcctcaggtttctcatctgtaaaatggagttaataacattaggagcctcagtgggttactctgaacatgaactgtagtaatacattttgaaaatgataccaactgcacatagtaagtgttcaataaaagttacctgttaatacacattacgattctagagttaactcctttttacttcagtgaaaacattagaaaagtagttcttttgtgtttaaatttttaaaattgtcttaaagtgcctagatgttgtcttctcaaaggaagaaactagatttgcccaaagaggtcaagcacatttggaaaggggcaaacgcacaaggaagcctgctttgcaaaatctgcctaaaaggctagctccatctgaacagacacctacccggtttctgtcttcaattgtcaacagttcctcctccatgcacttatccaagacgtctctaactagaagcttgtccaccagagtgggctgaaggaggttcagcagttggagatattcatcatgagcgttctcaaacgatggagagggcaagtccgtgagctcagggttcatgtagcgggcggccagagggctgccggttctccggagggcctccacgaattcccgagtccaaccaaggtgccagactcccttctccaaggtgctcagcagcagttcaactgcctgcatgttcccggaggtggcgactgtcctctgaatctgctccttcacctctgcaggcagaaaggtcaggtagtccagcacaggctccacctggatgtacattttcaccctggccctgaagcacgagatgagatagcggaaattctcgtctgtggaatacccattcgacatctttctttctcagagaagggagagggttctcccaagcagatggtgctgttgtctgcgggacaggtgaaatgtgcgtgccgctgtccgctgcccacttagagaagcagggtctaccgctctgtgcctgacaatgacgaggttgtccacagggctctcaggccggcgcgcggggctgcactcgcacctgggcaggtgggcaggcgggcaggtgggcagcggggcggcgcgcggggccgcggcaggcaggtgcggccggcaggcgcggcactttggactctgcggtgtgcgcctggggtcccggaccggggcgatcctgctgcacactcgggtaggagctttgagtccagctttctgtcaggcagttcttacagagtttgcctgactttggtttctgtttcgat

SEQ ID NO: 1759 - DNA, 34915 bp, Homo sapiens
aggcggcgcgtgcgtagaggggcggtgagagctaagaggggcagcgcgtgtgcagaggggcggtgtgacttaggacggggcgatggcggctgagaggagctgcgcgtgcgcgaacatgtaactggtgggatctgcggcggctcccagatgatggtcgtcctcctgggcgcgacgaccctagtgctcgtcgccgtggcgccatgggtgttgtccgcagccgcaggtgagaggcggggaggagagtcttggcgcagggcgggaggtagggcacgcagctgggctacgggggcggcgatgctgttgggggcgacagacgcccagtctgggaaaccttcggtccactttgccgcgccaaagattaaacccgacctgggctcgcaaatcaaccaggagaaagtggtgttctgggtcctctcttgccgcttgcctgtggccgtgtacgggtcctcgggagcgcccgggtcccacccccgtgaaatggcggtgccagagctttgtgtcgagtttgattctttccgggaaagtaccgcggctccgctggtctgtttgataataaacaaaacatttcccgaaatgcatttcctcaatctggtgaataggcgcccagtcccacgggggagtgagctaagtgtggccaggatttctctgccctcaggattcatacaggccaataaaaaatgacagtcggagtgactgaagcataattgtcagttctcgaggtttactaagcctgcttcagggcgcatccgggaaaaacgtgagccacaaacacgtctgtgactggttttccagaggttttcaggaggtggggcaggaaggcagtaaggcaaatagttctgtgagaatttagttagtgcccaagaaatctgtattttaagataccatgagtgtcttgaagagaaaaagagagtaaagggagtcagttatgcagatgcctctgggtagatggagtcttgactttgttttgcacctgagaagataagcttgtaattgacatggtcagtgtggaaggcctgaactagtttttcagattaactttggaatgccatttgttgagaggagaggtccattcacattgttggggggcttagaattttatttttggtttacttaactacctacttttttcccaaagaaataatcatgttcaaaactcaatgaaatgttatctcaatgagattgtaatgttgctcagtctttcagaagtcataaaaatagtcatactttttaaactagtaaatgcaattctaggacccaagactaagaaaactgtccaaaatatgggaagacatttttatttatacttttttttttttttttttgagacagcctgttgcccaggctggtgtgcagaggcgtgatctcagctcactgcaacctctgcctcccaggttcaggcgattctcctgcctcagcctcttgagtagctggaattacaggtgcacgccaccacatccggctattttttgtatttctagtagagatggggttttgccatgttggccaggctggtctcgaactcctgacctcaaacaatccacttcagcctcccaaagtgctgggattacaggtgtgagccaccacgcccgatctatttatgttttagactttagttttaggaactagacttaggttgtagacctgaagttacagttggcatccccttgtttatgggagaccagcaaagaattgacttatgaatgatctgtcagggtagcccttcgcagatggctgagtctttttatccttccttggggatttggctgaagcataatgctagtaacagccattcgtttggaagagggtgttgcagtcacttggcctctgggcttaactaacttcccttttgcgtaagaaagttgggagaggtcctgagatttttttttttcttttacaaaaataataaaagaaaaatacaaaggcagggcgtcaccaggctaatttgctgaaattcttcatacttacttgggatgcatgggggaatggcaactattacaaggttgatagagagtgagaggtaattttgtagtgaggaggggtacccaaagagaatcagggctagcatcccagtgcaggagtccaggtggtctgtgagcctgcaagtgagttcaaaatactttacctgttggcttaggaaaccatatacctgtgtggtacatgatatcctatttctcaaacttttccacaaatatgtagtatacttttcctaggatgtgggtactagggtcctggtgcatcccatagtaatttctttgaagtcttttgtttatgaaaaacttgcattaaactcatgtttggtttgatgtgaaaaaagctttcccagaattttcatataaaattgacattccaggagggtgtgcattaagaaattaatttaaaattaggttagcggacaggtggcaagatataatttataggcatttatcatttcttaagctcttagctgtgtgccaggcagtaatctaagtgttttaaaggtataaactcattaagctttcagagcagtgtagatactgttatgcttagttaacagacaaggaaactgagcaacggagagatcaagtaacttgcctgaggctgtataggccagtccgtggaggagtgggaagtcaaatcctgagtctggactaatagccttggggcttaaccagactagactgttttcccaaaggccaaacaatttaaattcctgattgtccacttgtatgttaagggcctaattatcagtatctttcagttaactgtgagcccaaaaatatctgagaccggtctgaaatcaacttagaaagtttattttgccaaggttaaggatgcattcatgacacagcctcaagaggtcctggccacatgtgcccaaggtggtcaaggtccagcttgcttttatacattttagggagacatatcaatcagtacatctaagatgtacatttgattggttcgatctggaaaggcaggacaactcaaagcaaggcttccaggtcataggtagatttaaagattttctgattggtaattggttgaaatcaatggaaaggaatgtctgggatgtcctaaggggttgtggagaccaaaattttatcatgcagatcaagcttgtccaacccacagcccactggccgcgtgcagcccatgatggctttgaatgcagtccaacacaaattcgtaaactttcttaaaacatgaggggtttttgttttgtttgttttctttctgtttttttgtttgtttgtttttagctcatcagatattgttagtgtattttgtgtgtggcccaagacagttgttcttccagtgtggcccacggaagccaaaaagagtggacacccttgatgcagatgaggcctgcagatagcaggcttcagagagaatagattgtaactgtttcttgtgaaacttaacgtctgtgttgttgttaatggtggttagctttttctgaattccagaagagaggagggtataatgaggcatatccaaacctcacttcgcatcatggcctgaagtagtttttcaggttagctttggaatgcccttggtcaggagaaggggtccattctgatggttgggggacttagaattttatttttggtttacgtaactatctactttttccccaaaaaaaatcatgttgaaaactcaagaccttaagtttacagctcaagctgatcctgaaagttatctcagtgagattgtaatgttgctcagtctttcagaagttgtataaatgtaccttttagcctagtaaatgcaattctaggactctagattaagaaaactatccaaaatatgggaagacatttacttacatatttgtacagatatctatatttggatttatgtcagacttaaagatatagtaaaccattttggtcgtgaaaatgaatgtgaaaggttgaaagcaaccaaaattataaatgcattatatatatattagattaaatgtccatttatacatttacatgtggggtaattaattgttaatatactaatataaaacattttaatatactagtaaattaatatattgtatgttaatgttacataacaatttatgaaaaaattattaaaaggagattgccaataataatagagcaaaatctgtgaaaactaaaatcctgtttaataactttatttccaagcccctgtccatttatcagtcagttatttgttggtcttccaaatgccaacatgcctgtaacttcagggtctccttcttttagcagtaaaggattttttttctccctgaggaaatcactagctgtaccctataacattttctattcttgtctcaaggcccaaaattactagaattataatattctgcacaagatattgtaaatactacaaatgccatcagatcttttgttaaactctgtaaacccagttgctaccctttggctgcatagaatctataaattctaacaaatggatgagaaccaagttaagaattctagagtgggataaggggatgtgatgtattctattcagggatgaagttttagagactccaagtatgaaacagaaaattgaggatggggagacctgatgggtaccacattaagtttaaaaaaaaaaaaagtgttttctcagctgtctccccttttgaccccatactataagatctaactggaaagagcaagaagctgtctcagttaagaaagttctatacaagaacccctgtggtagaacaagtctacaacaagataacatgattgccccaaggcagaagtaaaagaaatattgtaggaaccataaatgaatttaaaagctgatcttttaaaaaatatataacttatcaaagtgagagatcagtcctttatgatatttaaggagttcctgtgaatgcaccattatgctggatactctgaaaaaatgcaaatcaagtatgaagcgatataaattctgcccttaaggaacttgcaatctagttggagatttatgtttaacacaaagaagcagtttttacaaatacttcttttgaggattctgggaagatggcagagtagaaagcaccaggaatctgtctcctcacctagacaagaattgtactggcagaatctgatgtaactattttggaactctggagtctattgcaggcttgcaacttccaggggacagacttagatggtaaattgcagttaattttggtctatttgagctcttagtacagtagcagctacccatcttccacctctcaacccttagcagacagctgtgcacgttattagagcaatctgcacacaacttacaggaatcaggtgggcaaaaagaaacacaccatccagatatctgggatctgtgctcttgattggtcattgctccttctcgtcacaaaagcgcaaagagatgggcggttgttgttgttacaccttactcattgttacaaccccctccccactcactcccctgccccatggatttaaagggctagaaatctccctctgcttcatttttctctttcacttttgggagccggatattaaagactaggacatttaaaaacaactgcatttatggggaaaattagaaagtcactgtacatacctagggaaaggctcaggagagaccttaagtttatagctcaagctgatccttggcacaggattaacaacaattacacagcaattaaacaaagcaaacacacacacacacaatgtagtctgggagagtgatgttagcaagatggccaactagaagccccttctgctcatcccctcataagacagccagaacaacaaataaacaactacattttagcaaacttaactaagagtgctagagtgcatcaaagaagtaacagaaatcctagtgagcagagaaaagtgggatggccacatggagaatgggaggaaatgccaggattcctaggatcatctgggaacgaggaggaacttcttcctatggcaaggagataaacaagaagatcccagctacaccatgggcaccaacagatctcaccactggggttccttagagtccagacagcaactaagccaagctgaggaagctgcctagagtctgcacagctgtgttccctccagagaaggagccaacactgtgctccacctgctgtggcccacacagctactgtgccactccaccttggaactggaactacttctggagtgtgtcttgcttcggggacttgtagccatggcttcctttcatctgaaccacgccaggctggtggctcaacatccctaagctaaactttaagcagctgttacacccttccctgtggagtcaagcagaggtggaactactccacctactcctaccccactgcccttgggctagagctgaagcagtatcctatttcctgggaacacactaccttggccacccagagcagtcatgcacccctgtgcctaagctgaagtggtatacggcattccagggaaacagggcctgaaccacccagagcagtcacactccccgggcctcagctgaaggagcacatcactccctgcagaatcagtgccctggccaaaccgagcagctatgcatcccagggctgagctgatgtagtatcctatgtctcagggaaacagagcagtggctgagctgagacaccctgttctacaggccaaataactgtagtaccccgcttccctggagctggactagtcctctagagcctgagctgctgagacactctgaggagtggagtcatcactgtgctgttccctaccccccattcccagcccagacaacagctatgcttcaccattttgtagtacttgctgctgctgctacacttggcctcacagtctggggtactgcttatccctagctattccaagatttagagtcatgacttcatggtgcctcatcccttgggacctgtgttgccactgagccctattagctcatattcccaaattaaaaccataccctgctccccaggcccaaacctccagagaaccccttctttatagtcaggccagtgctatgccctgacccccataggggtagaatcaaagctacaacccattctctgggcctaagctgccaggaagcacctccaggtcacaaatcctggctctgtgagcaactacgtccaagccctgccacagagagcaaacccacctcagcaaccaagtgtctcagtaggtttgtgagatcctgagcctaggacctttgcccagtagccactctgaataccttcatctggaatcaagagctgctgcagctgcatatatatagcccctgtcagacctgacaccaagaggtgttgccttggctgagtctccccattgtggggaagacaagaataggaggatcctaaaagccttcaacactgagaacattaacaacctacactaccactgccacaaacttctgcagcctaggcccctgaggcacccatttactactgacattgaacacaggtaaagcagctgctttaccataccactgcatctgtcaggaaacagtcaccacacccttcgaaaccagcatactgaaacccaactgctaataaaagactttatctttgaaagccactgtctgtaaagtttggaagaggtaattatcctatcaacacaaagacacaaaaacatgaaaaagcaaggaaatatgacaccaccaaaggaaagtaagaactctctaatggtggcccaatgaaaagaagatcaacaaattgctggaaaaggaattcaaactaatgatcttaaggaaactcaacaagatacaagaaaatacagatagttcaatgaatcaggaaaacaattcacaatacaaaaaattcaacaaaaaaattaaaacatgatgaaaaacaaccaaacaaatcctacagttgaagaattcaatgaattacatttaaaaaatacaataaagagcttcaataacagacttggtaaagcagaagaaagaatctctgaacttgaagatataccatttgatattacttaattgtagaaaaaacaagtgaaaccctacaagacttatgggacatcattaaaggaacaaacgttcatactatgtaagttacagaaagaggagaaaaggtaagaggcatatacaaactatttaatgaaataatagctgaaaacttcccaagtctggagagagatacagacatccagatccagaaagctcaatgattcccaaatagatttaacccaaaaaggttctctccaaagcacattattatctgttgtcaaaagtcaaagacagagaaagaattctaaaaatagcaagagaaaggcatcaagtcacatttaagaaaatccccattcagctaacagcagatttcttcacagaaaccttacagtgcagaagaggatgggatgatatactcaaacagccaagaatgctatgcccagcaaaactatccttcaggaatgagggagaaatacagtttttcccagacaagcaaaaactgagggaattcatcactgctagaccagccttatgagaaatgctccagggagtcctacatctggaagtgaaaagagagcagtcagtatcttgaaaacatggaaaagtataaaactctctgatagagcagatacacaaaggagaaagagaaaagaattaaaccttatcaaaccatcaaaccacaatgataaataataagagaggaagaaaggggcaaaggatattattagaaaactttaacaaaatgacaaatgtaagggctcaaatatcaataataatcttaaatgtaaatggattaaattccatacttaaagagactggcggaatatttttttttttctttttttttttttttgagacggagtctcgctctgttgcccaggctggagtgcagtggcgcgatctcggctcactgcaagctccgcctcccgggttcacgccattctcctgcctcagcctcctgagtagctgggactacaggcgcccgctaccacgcccggctaattttttgtatttttagtagagacggggtttcaccgtgttagccaggatggtctcgatctcctgacctcgtgatccacccgcctcggcctcccaaagtgcggaatattttttaaatgactcaattatatgctttctataagaaacccacttcacctataaagacacatataaactgaaattgaagggatggaaaaagttattccaagcaaatggaaaccaaaagctgtcaggaattgctatacttatgtcagattaaacagacattaagtcaaaaactgtaaaaacagacaaagaaggttattatataatgataaagggaccaattcagcaagaggatataacaattctaaacatacatgtacccaacaccagagcacccagatatataaagtaaatattactatacgtaaagggaaagatagactccaatatgatagtagttggggacttcagcaccccactctcagcttcggacagatcagcaaactccaagtacagtgaactcaaagagaccacaccaagaaacagtcaaacttttgaaagccaaagacagagaagtgacttgtcatacacaagggatctttgataacatgatcagcagatttctcacctgatactttggagaccagtgtattcaaagtgctaaaaaaaacaaaaccaaaaaactcaaaaccctgtatatggcaaaattgcccttcaaaagcataaggaaattaagatgttcttagatagacaaaagctaagggagttcattaccgctagaactgccctgcgagaaatgcttaaggaagtcctgaaaggtgaaatgaaagggcactagacagaggggacagtgcagattcaggcaggtgcaatggcttctggggaagacccagccagtggggctattgccagcatccagtcagctgccaccttccctgaccccagtgtcaagtgatgcgcagggtgatccaggtgtgtgaggggcagctggatgtccagactgagggcactggtgccatcagtggctatcctaccactcaattcatgacccaggtggtgatccagggtgatatcaccagttatgatgcagttaacacagaggggaaagctgctgagatacactatactttcccacccctgcagtgggagatggggcagggggtaccacatcagggagtacagctgctgttgttactacccagggctcagaggcactgcttgggcaggtgactcttcctggcactggtcaattatttgtgatgatgtcaccacaaggagtactgcagggaggaagccagcacttgattgcccctaggactcaaccttatttatttggacgtaacaccattgtaagtcaagaagcatctctatctatctatgaacatacaatgtgaaatcaaattgaggccataaaacagttgaacctcatcataagagtgactcatcggtgtcacttctaagaccaagaaaaattctatttttatgcagagaccatttgttttttaattaaaagacaactctatttcaaagaggaaaaaaaatcaactcttttttcagctctctcagatgcagaaatgtaattatcagcatccctgtgctgggagcaatcattagtttttttagatttttaaaatatacttcattatgtttcactgtattcattctttaatcagggatgtgagggatagaataacatttagaatatctgtacagtttgtatataatgttcttatttcttgttgcttttataggtggaaaaaatctaaaatctcctcaaaaagtagaggtcgacatcatagatgacaactttatcctgaggtggaacaggagcgatgagtctgtcgggaatgtgactttttcattcgattatcaaaagtatgtgactctacttactgatttgtcagaatgacctgaataatttttacaagtttaacaacaccataatttttagatttggaaagtgtttggtttttctattttttagaaatgttacgcctattttacataatatttttaactttgtttctgtagagacttagtcaaatacatctttgggtgttgaagcaaaaaattggggatgagggtggtagacagcgtctctaacccatagccattccttctttcttctgggtgttccagcttcttttttttttttttttaattattatactttaagttttagggtacatgtgcacaatgtgcaggttagttacgtatgtatacatgtgccatgctggtgcgctgcacccactaactcgtcatctagcattaggtatatctcccaatgctatccctcccccctccccccatcccacaacaggccccagagtgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagctccagcttctttcaatataagttggggtctgagctagggtatatcttgaagatatggcattgtactccaaaaggtccatcgaagaccttggaataggccaccaggtttcctgtgatcaggctttcctattatctccatgatatactatattttaattttaggtacactttttttttttttttttttttgaggtggagtcttgctgtgttaaccaggctggagtgcagtggcacaatcttggctcactgcaacctccacttcccggtttcaagcgattctcctgccttagcctctcgagtagctgggattgcaagcacatgccaccatgtttgactaatttttttatttttagtagagatggggtttcgccatgttggccaggctgatctcaaacttcttacctcaggtggtctgctcacctcagcctcccaaagtgctaggattacaggcgtgagccactgccctggcctagatacactttgtaaatatattgttaactgggcatggtggcatgtgtctgtaatcccacctacttgggaagctgaggcagaagaatcgcttgaacccaggagacagaggttgctgtgagccaagtttgcaccactgtactccagcctgggagacagcaagactccatctcaaaaataaataaataaataaaataaaataaaaatcgatatattggaccttgcatttctaaagactcagtttttctggagtgttgatgtctcttccttagtactttctacttaattattcaagaggagaggcaggcagaaggaggaatatagaagggaacacagatcaggaagtacagtactttgccttccgattatgtgttggggccccacctgccaaccatgttcccctgtccaagaaaaagcaggcaatgaagaaataaggcattaggccctccggaaccaggagcccaccacttcagccacagctgtgacactattctcgagttgtaactaaaactggcatatgaatctcacagcttcagtaattgtgtatgcatatataaacaaatacacactgtatatatgcatatatacactatatatatacatactgtatatatacattacactatatataatacatactgtatacatacatatacacacattgtgtatacatacatatacacacattgtgtatacatacatatacacactatatatacatatacacactgtatatgtatatgtatatacacacacaaattcatatatgacttttctcagaattgatcatttaaaattttttatctctagagattttcattaaattgaactttgagtttggttaccagttttgttttttcccttagtttggaatttccttatgaacaactattttaggtagagaaggaattatttcagatacccttatttaatgttacttgtataaagaaactatttgcaaaatatgcatccaacaagagcttaatatccaaggaactcaaacaatcaacaacaaaacccaaatccatcaaaaggtaggcaaaagataggaatagatatttttcaaaagaaaacatacagtggccaacaagtatgtgaaaaaatggtcaacatcactctaatcatcagagaaatgcaaacgaaacctgccatgagatattgtctccccgcagtcagaatggctgttattaaaaagttaaaaaaggctgggcatggtggctcacacctgtaatcccagcactttgggaggccaaggcaggtggatcacctgaagtcaggagttcgagaccagcctgaccaacatggtgaaaccccatctctactaaaaatacaaaaacttcagccggatgtggtggtgcgtgctgtaatcccacctacttgggaggctgaggcaggagaatcgcttgaacccaggaggcacaggttgcagtgagctgaaatcgtgcccctgcactccagcctgggtgacagcaagacttcatctcaaaaaaaaaaaaaaacccaacaaatattgaatatatttcatgccaaacactcttctgactgcttagactgcctcagtgaacaggagaggcaaagatggcatgaagttatattatgaaacggatttcatgaagtaaatattacattagttacatattcatatttcatattctgttctgagctaattattgcatatgataatagtttttttgttgttggttttttttttttgagacggagtcttgctctgttgcccaggctggagtgcaatggcgcaatctcggctcaccgcaacctccgcctcccgggttcaagcaattctcctgtctcagcctcccgagtgcctgggattacaggcatgcacccccacgcccggctaattttgtatttttagtagagacaggatttctccatgttgatcgggctgatctcgaactcctgatctcaagtgatccacccccctcggcctcccaaagtgctgggattacaggtgtgagccaccgagcccggccaataatgatttttttaagaaaatataaaagtagcttctgctgcaatatcttgattagatgtaaaacagttttaatggagcatgcttcagcatctcctgaagtaggaaagacagatgtaaacagtgaggttgggttgaaattatattaagttttaaatttttgataaggttttctgtttataatgagagtttctggatttttagaaatagattctgatgtggaaccttttcaagaatgtttaaggtatttttaatgccagctctaatctcaggcctcagatatgtaaaagtggaagtgaaaactggccaagaatgaagtatttcatatgctagtgtatatttttggtaatttcttaaaaatgtttccattttgaaaaacaaggtagacttgtatttggttcagcaacaaaattattttggtattatctctggtttctaatatctaaatcgtctttaaaatggcatctgtgatattattaaaaataaataaatcagctaatgaattaggcttgacaaaaatgccttcccagaagatagtttctctgctacttatggtcaatgggcttaacataggtaaaagttctcaaatctgctaaattggccgggcatggtggctcacgcctgtaatcccagcactttgggaggctgaggtgggcagatcacctgaggtgaggagtttaagatcagtctagccaacatggcaaaaccccatctctactaaaaaaaaaaatacaaaaattagccagacgtggtggcacacgcctgtaatcacagctagttgagaggctgaggcaggagaattgcttgaacctaggaagtggaggttgcagtgggccgagattgcaccactgcactccagcctgggcaacagagtaagactctgtctcaaaaaaaaaaaaaaaaaaaaaaagaaatctgctaagttcgtttctatccctcactttccctgcaagctcttcttcccctttctgggcaacatgtccttttctgctttaggcactccatgcccactttatttttcatgtttgccccttttttgaaaggaagaatctaatatcacttcagctttctgattggccagttccacttccaaaaatttatttgtttatgtaaacattttcagttttgtggtttctgatgatgtaatagaagaaattacggagacaggcaagcagaagggatggtttgcttttggagagggcagaggaaaccttgaaaccatactgattctgaggtctttcttagggaaggtaagtctattcataggaggaggtcagaagggaatcatcaaatccaattccccagtttctatttaattttattttattagagacagggtcttgctcggttgctgaggctggagtgcagtgatatgatcatagcctactgcagcctgcagccttgaacccctatgctcaaatgaccctctcacctcagcctacccagtagctaggactgtgggcatgtgccaccatgccctgctttgcctttttttttttttatttctcatagagacagggtttgctatgttgaccaggctccaaactttcaataaggaagataagatccagaaacacaaaatagtttaccaaaagtcacacagctatttttaacagagccaacatactaaatccacttttaccttatgggtcatttatttctctgcttcctgaagcaaccacccacaaaattatataaagaactgtattttaaaattcagtttcataagtaataacttggcttatatgcattgaaaaagagtggaagggtgtatgctaaaatgttaataggacattagctcaagtagaagaaataactcttaaaccaaaaatagaaataactcttaaacaagagttattaagagttaagaaataactcttataccagtaaatagaaagtatttgacacttacatttatacatttgctcactcattcatttgttttttttactttaaagaactgggatggataattggataaaattgtctgggtgtcagaatattactagtaccaaatgcaacttttcttcactcaagctgaatgtttatgaagaaattaaattgcgtataagagcagaaaaagaaaacacttcttcatggtatgaggttgactcatttacaccatttcgcaaaggtaagaaaaagttgctagctgaattatattctttagtaaatattaccagagcagttcactttccaagccattcatttgcatgatgcaaaatctaacatcttttaaaaagaacaaaaattcccttaaacctatatcttcttcctgctatggctccatttgtcctactttccctgtagtagtggttctcaaagagtgatcctcaaggccctttcagggggctgtaaagacaaagctatatttatgacaaatctaagacttagttgcctttttaatttttgttctttcttgtattcacagtggagttttccagaggaggctgtttgatgtgtgatgtggtgatatggtcactgatttaacatagaattcaatgtgaaattcatctgccttctttattaatccaaacattcaaaagatttggaaaaaaaatgtaaaacagcaccactctgaagtttctatgttccttttggcaaatgtttgttaccataaaataggtttatcattgttatttctttctttttttttttgagacagagttttgttcttgttgcccaggctggagtgcaatggcacaatcacggctcactacagcctctgcctcctgggttcaagtgactctcccgcctcagcctcccgagtacctgggattaccagcatgcatcaccatgcctggccaattttgtatttttagtagagacagggtttctccatgttggtcaggctgacctcaaactcccaacctcaggtgatctgcccacctcaacctcccaaagtgctgggattacaggcgtgagccaccatgcccagtccattgttatttcttaatggattaattagttaaaatggattgaaaactttaccagttttaatgtttaatatgctaatataaaaatatacagcccacataaataatggctgtttgggattctcgataattcctttaagaatgtaaaggagctgagtgtagtggcccacacctgtaattccaacactttgggaggctgaggtgggaggatcacttgaggccagaagttcaagaccaacctaggcaacatagtgagaccccatctctacaaaaaatatataaaaattagccaggcatggtggtgcacacctgtagtcccagctattcaggaagctgaagagggaggatcacttgagcctgggagatcaaggttgcagtgagctgtgtttgtgccactgcactccagcctgagcaacagagctagaccatatctcaaaaaaaagtggggatcctgagaccaaaaggtttgagaaccactgccctgtaccaagaatgatctgtactccctttctatactaatcttccaattccctgtcagccctctccattcaaattctgttcctcctcacttaaaaccactctttttggccaggcgcggtggctcacgcctgtaatcccagcactttgggaggccaaggcgggcagatcacgaggtcaggagatcgagaccatcctggctaacacggtgaaaccctgtctctactaaaaatacaaaaaaaaaaaaaaaaaaactagccgggcatggtggcgggagcctgtagtcccagctactcgggaggctgaggcaggagaatgacatgaacccgggaggcggagcttgcagtgagccgagatcgtgccactgcactccagcctgggcgacagagcgagactccgtctcaaaaaaaaaaaataaataaaccactcttctcaaggtcacagcagcctccacaatgccaagcaaattcccagtcctcttctggcttcatccctctgtagcatagatgtggtcatcactcagtttttcctttactggatctctgggacactgctctttcctggttctcctcctgctcattgatcgcttcatcttcccaacttttcagtgttagactgctgctgggctcagtcattgaacctcttctctttctgtatcactccactggtgatcttacagctttctatcctatctgtatgctcttaactcccagaagtggcaggcacatattaagtgctcagaattatttgttgaatgaaggttttggcattgtattaataaagttccatagtaattgttttgatttttttgcagctcagattggtcctccagaagtacatttagaagctgaagataaggcaatagtgatacacatctctcctggaacaaaagatagtgttatgtgggctttggatggtttaagctttacatatagcttagttatctggaaaaactcttcaggtgtagaagtaagcattatttttacctctgtttaatcgatgtgagagaaaaattaggcgaattaatcctaaaatttgactttatacttttttaaagaaccaacttatatttgtgttataggaaaggattgaaaatatttattccagacataaaatttataaactctcaccagagactacttattgtctaaaagttaaagcagcactacttacgtcatggaaaattggtgtctatagtccagtacattgtataaagaccacaggtaaggaagatgttttgttttagattcaataaatatataaacagattgtcaattttggcatcttccccatattgctgaagtttacatgataggtcaatatatgttaaaaacattgtaacatttacataagcaaaataaatgttacttgggatttttgtctcaaatagtaatgaaaattaattctacttaaaagttcaggctgggcgtagtggcccacgcctgtaatcccagcactttgagaggctgaggtagctggatcacttgaagccagaagttcgagaacagcctcgccaacatgggaaaaccccgtgtctactaaaaataattagctgggcgtggtggctcacgcctgtagtggtagctacttgggaggctgaggcacaagaatcccttgaacctgggaggtggaagttgcagtgagccaagatcgcgccactgcactccagtcgggagcaagggggacaaagagtaaggctccgtcttagaaaaaaaaaaaagttcaaatattttgtaatgacaaaacttttcatttgttcagaatccacatgaagcaggaggtagctgaactatgagttctgcaagtgggaagaaaaggtggggaagtagttgctagtagacaagttattgttcaagaaagcatacctttgtaagtggaatgttaaaatatgaaagtatcctgatacatttagtaacatctttccaataattaaggtcaagggcaggagctgggatttgtttattttaattgtaaatttcatatgcttttttttttaatcaaacattacggaagggtttaaagtgaagtcttcttctcccttcttatccccaattccattcactagagataagcattgcttagcagtttgtgtatatcctttcacaacttttttcaggatttatgtaagcatatacacagacccacagtttcttgggttttgttttttaaaattacaaaataaaatcttactagaagtattttacagcttgcttacttaacccagtgtgttggggatattctatatcactcaatacagatctattacgttcttcatttgatcttagccatctattgcattctttcttttttacttatttatttatttatttatttatttatttatttatttttgagacagagtctcactctcttgcccagaatggagtgcagtggctcaatctcggctcaccgcaacctctgcctcccagcttcaagcgattctcctgcctcagcctcccgagtagctgggattacaggcgtgtgccatcatgcctggctaatttttgtatttttagtagaaatggggtttcaccatgttggccaggcgcgtctcgaactcctgacctcaggtgatccatccacctcagcctcccaaagttctgggattacaggtgtgagccactgcgcccggcctgtagtctttcaaatggctgcatagtattacatagtgtgaatacaaaccatatttaactattaccttataatgataaaatgcgagcctttatcttcttgccagttatctcacttgagtaaaaatgtgtgcttttttttatctgttctttggcttctagttgaaaatgaactacctccaccagaaaatatagaagtcagtgtccaaaatcagaactatgttcttaaatgggattatacatatgcaaacatgacctttcaagttcagtggctccagtaagttccattccataaatttccttttgcccagtttgttttgattatgcttcttttcgctctgcatcagtcaccaggtccttgcacacagaatgaccgactgggaggtgggtacgatatattggaaacgtgagaaatctcatttctaaccccagttctgccagtaactaactggatgacattgagctaatcgcttaacctccatgggcctcaatttcttcacttgtaaaatagatggattctaatatctggggttcttactggcttaagaaaaaaaagaaagtgtaactagttgcatgtgttatttccccaatctggaagactcgacagttgaccctgatctttttctaagaactcacttcttccatgagtccttaaaatgatctcagtccactcacttgttcaattcaaaaaattagccttcctattttctttattactttagtggttttgacaaaattttgtagtagatacttcggtgggaaagaaagttggaaagaactatgttctatgtggttgagcagaggctagctaaacatggatgaagtccaggcgctgcataaatgaaagagaactggcctggtgcagtggcgcatgcctatcgtcccagctactcagtgggctgaggcaggaggattacttgaggccaggaattgaggctgcagtgttgtatgatcacacctgctagtagccgctgcactgcagcctgggcaacatagtgagacccccatctctaagcattaaaatttttaaaaagctgataaaagagaactgcatgtagtttatattgattggaaaattgtaggagatgaatagagaaaagagaagaggaaaattaagtagaaggaaaaatgggttatggggagaaaagagatggaaagaaagatatacattggtggcagaggagtagagagagcaaaggcaagtatagctaagacaggaaaggaaaagtcagaagaaactggaaagaaacagaaaaaatgagggagaagggaagtgtaagtaccgctatgatcaatttctatcttttagtgttaattttgaaccaagggtgactggtagaatgcaaatgcatttatgtgcatatgtgccccacaatgcatatataacctcacaaaccaatcaggaaactgttcagtagtcttttgtgtatacctcactttcagaagtgaataaataatagggtcaccaaatagataatgagaggtatttctgatagctgatctctaagcttcttttgggtacttaccatattgtacaaagcactgaagaaatggaaagagtcagcagaatcaaacgtggttcaaaaattgaaagcagttagccaacattgcaaagtgttgtgtggtttaggactaaagagtggtatacaaattataagggttgcagaaattgaaaatgtaaaggtgaataggggctaaagagaccaaagaagccataaggaaagagataaggtatgaacaaggccttgattgttaattcagattttttttaagtagacaactattagatgttagttttctgtgtctgtaactaattaccacagacttagcaacttaaacagctgtttattgtctcaaagtttctgtgagtcaggagtccaagcgtggcttagctggctcttctgctaagcagtcaaggagtcagtcattcatacaagacttgggggccgctcccaagctcacatgttgttggcagaatttatttctagagctcatggtggctcacttcttagaggccatcaggaagggagagtctgacctctagatccttttttttttttttttgagacggagtctcactctgtcacccagactggagtgcagtgacatgatctcagctcactgcaacctccgcgtcctgggttcaagtgattcttctgcctcagcctcccaagtagctgggactacaggtgtgcaccaccacacccagctaatttttgtagttttagtagaaacggggtttcaccgtattggccaggctggtctcgaactcctgacttcaggtgatccacccgcctcagcctcccaaagttctgggattataggcgtgaggcaccgcgctcagccattttttttgtatttttagtagagacggagtttctccatgtttgccaggctgttcgcaaactcctggccccaagtgatctgcccacctcagcctcccaaagtgctgggattagaggcatgagccaccatgcctggcctagatcctcttttaaggggttcatctgattaggtcaggcccacccagaatagtctctcatttgattcaactgatttgggaccttaattacatctgtgaaataccttctcttctgccacttaatgtaacctaattatgagaggagggcctccatcgtatttacaggtcctgcccatgctcaagaggaggggattatacaggatgtgtacaccagggggcaggaatcttgggggccatctcagaattttgccttctccagtggggaggatgtccttctagagtagcagaacatttggacaccaggtggcaatgggaagaaagctgaataagtagaatgggacaagattagggtcaacctcaggctgtcctgtaggcttttggggattttgtgttggggtgatagttaacctgagctctggatttgaggaaggtgcatgcggcgacatggtatgtgggagagtggactaaggagacactaaagagagataaggaaaccagtcaggaggctattagagttctgggcttgaactgagatgcttttagctgttggtttctgggcaagttacttaacctctttagtctcgtacttatacttgctcttataaccccgcagtgtgtctctattttagcacttaatcagtgtccattggtatgctggcgcatgtttagcagctggctttccagaaagaaaaagtcctattttgtagtgtttgctgatttttatgatataaatattcccaccatggccactttcaagccaccagcctgatgtccctgaatatggagttgggaacatatgcacagtagcacaccactatcatatagctacaatagataaagatagccccaagagcttagaaaataaaatgtagtaaaataattaggacaagatgaatttatttattacctctgtctttaaaacaattttttatttgcaaatttatataacttaatttttagtaatggtttttctttaaaaaccagtttgtattttaggaggccgaggtaggtggatcacctgaggtcaggagttcaagaccagcctggccaacatgacgaaaccccatctctactaaaaatacaaaaattaggcaggcctggtggcgtgcacctgtaatcccagctactcagggggacagaggcaggagaattgcttgaacccaggaggcagaggttgcagtgagccaagatcctaccactccactccagcctgggtgacagagcgagactcggtctcaaaaaaaaagccaaaaaaaataaaccagcttgcagcattcctggaaattctaactaacagatgttcttgcatattgatatgagccacctccagcagagcacaacatgaccacagtctggaacagtctttggttttcttttatgttagatgcatatctcttccattgtttgtgagtttcctgagtgtggatactatttatttctgtaaccttagcccctaacatagtgtctggcaattgtaaatacttaataaatatctaatgaatttaaaaaatatttgtcttaaaagcgcctttttaaaaaggaatcctggaaaccatttgtataaatggaaacaaatacctgactgtgaaaatgtcaaaactacccagtgtgtctttcctcaaaacgttttccaaaaaggaatttaccttctccgcgtacaagcatctgatggaaataacacatctttttggtctgaagagataaagtttgatactgaaatacaaggtaaggcagtagtttttactggagattgtaattctctggtgcaagtttttaaaattgtttttctaattgaacattatttctttacaaattttttctagctttcctacttcctccagtctttaacattagatcccttagtgattcattccatatctatatcggtgctccaaaacagtctggaaacacgcctgtgatccaggattatccactgatttatgaaattattttttgggaaaacacttcaaatgctgaggtaaaaagactgtatagtataattttgtaacttagagttataattatgatttgggtaaataaagcttgaatgtaaaatttgggggaaatttttaaactttatgtgggctggatgcagtggcctgtaatcccagcacttcaggaggccaaggcgagaggatcacttgagcctaagggtttgagaccagcctgggcaacatagggagaccctgtctcaataaaaattttaaaaaattagcctggtgtggtggcgtgcacctatattcccagctacttggggtgggagggtcacttgaacctgggaggtcaaggctgcagtgagccatgatcgtgccactgcactccagcctgggtgacagagtgactgacagcttgtctttaaaaaaaaaaaatgtgattaactcagatattaacaaaatgaagattatgagcatttttcatgttttgcactgtagagttatgggtgagctgcatctgggccccagtttgcttttaaaatacagattcctgagcctattgttactgaatcattatctctggggatggaactcaggaatttgcatttttaacatgattcccatgtattcatctaaacctgggattctcagcactattgacgtttgggctggatagttccttgggagggggctgtccagtgcagtgcaggatgcttggcaacattctggtttctgcctactagatgccagtagtgttccttcctagttgtgacaaccaaaaacatcttcagatattgtcaaatgtcccctggtggctcctccaaggggacaaaaattggttcttatgggacaaaagaatttatgtagtacagttgtttgttttcctccaaaaccattggaaagcattcttccaaagttcagctttgcccaacaaaatcttattccttagtatttaattttatgatgggggaaggattaggaaaaaattgcccaaaaagttgtttagttggggaggtaatgaaaaaagggttgacaaacactggtctaaaccctaaaattcagataccactgacaaagataatatataccgtcagataatatacgtgtttcccagatcacttccccctcgtggacttgtagtcaagaatcgacctttaaaactcctgtccagtcaggctggtaaattctttaacttcacctcattttctattggaaatctaagcaaattccattgatttggctgcttccctttttaattgtctgacaaccctgtaaccatagcttaatgtagcccattgagaattatggtcggttttcagatgtctgtagatcagacaaacctaaatttctatctcactgctaaactgtgtaaccttacgtacgcagggtgctttacctcttggagactttgcttcctcttctctgaagtggtggtaatcataacaactaaatttttcaaaaggatgtttataaggtttaaaaggaagtaacaaatatgaaaatacctagcacattgctggacaagtagtagagattcaataaattgtagttgccatcttaacctatactggataatatatcaataattgttactatagaaactcttattgaatacttatatgtaaggtactatgctaagtattgtacatgaattgtctcagtcattcttcaaaacaaccctgccggattatgtgattggttacattgctgtttggcaaatacttgggacggtgacttcttccctgcaccaccagaccgtagatgctggagcccaagtagatgtgctgagaacagaggccttaagtgtgcttgcagggtttggcttggctcttgcactgctcctatttgccaggaataaaatgtattccacatagtctctggtccaaggaggattagaggctgctggagctgacctaaaccccatgcacagcctccgtgggagctgcccagccagtctgtagacttgtgagtgagaaactacataatcgttttgtgagccactgaacgttaaggcagttttgttatctatatttttttattttattttattttattttttttttttttgagacaggttctcattctttttcccaggctggagtgcactcatgtgatgtcagctcactgcagcctcgacttcctgggcttaagtgatcctcccacctcagcttcccaagtagctgggactacaggcacatgccaccatgcctagctaattttttgtatttttgctaaagatggagtttcaccacgttgcccaggcttttttggtggtggtggtggtggttgttttggaaatagggatttcctcagcctcccaagtaacagagactacaggctcacaccaccatgcctggccaatttttttgaaatttcttgtacagacagagtctagctatgttgcccaggctcgtcttgaactcctgggctccagtgatcctcctgcttggcctcccaaagtgctgggattacaggtgtgacccaccggcttgttagacattattctggcgatagctgactgatacagatagcagcaataactgtcccgattttatagatcagggaatcaggtagagagaaattaaataatgcttgcaagaccacacagctgtaagtgatactcttaataaggcagtttgaggccaaaacccctactcttaaccattctgtcactaatcagaggtaatacaatggcaattaccccagacttggcatgtacttgtaaatcaattagaattctcttaggaatagatcatatgcttttttggcagcagcatttttaactttctgatttggttatagtggtgtatctaaaacaaatttatatttctcacacatatactctgtaatcccagcactttgggaggccaaggtgggtggatcacttgaggccaggagttcaagaccagcctgaacaacatggtgaaaccccatctctaccaaaaagaaaaaaaaattaggcgtggtggcatctgcatctgtaatcccaactactcaggagggtgaggcaggagaatcgcttgaacccaggaggcagagattgcagtgagcccagattgcaccactgcactctagcctgggtgacagagcgagactgtctcacaaaaaaaacaaaacaaaacaaaacaaaacaaaaaatacataccaactacgtgggagaggccaatgttagactgaacataaaaaattgagaaagcacatattccctgatttcttgaggtgactaaattttatcagtgatttaattatattttctagagaaaaattatcgagaaaaaaactgatgttacagttcctaatttgaaaccactgactgtatattgtgtgaaagccagagcacacaccatggatgaaaagctgaataaaagcagtgtttttagtgacgctgtatgtgagaaaacaaaaccaggtcagaatcttttattgtcttttttaaaaatgtagctagacataataaaagtaattctatactgtacattgaaaattgtaaaacattttctctttactgcaaaaaatatatagaaagaatgttttcttcatgaactacatgaatcaaaagtagactttttagaaaatatttgtaacgcttaactctcaagtcggtgttgttggatgctttatatttcatccagtatccctataattaatttccttaatgtatttctctttaacatttaataaaactattttaaatttttagaatataatccttaacataattatcatgtagaaatcacttagttcaattgtgagttttttaatgtgggaattggtttagtctcattttctattttacagtttctagtgttgaccggtagaggcttagtcacagaatatctattaaattttgctagttgtatggtgtaaaagtgctgaaggatacttgcatgtttggcctgtatgtcaatattgtatttctccctgaggatctcttacttcagttcccacgccaatctttaaatgtaaatgtcattgcctatggttgctgtggactcagtgctgccagaaatatttttaagagtattatttaatagattttatatttcctttcatatggctagtctttcacacagctgtcagcactgttaaggcatttgtatgtcaaaatatatgctaaatatcacgtatatctttttaggaaatacctctaaaatttggcttatagttggaatttgtattgcattatttgctctcccgtttgtcatttatgctgcgaaagtcttcttgagatgcatcaattatgtcttctttccatcacttaaaccttcttccagtatagatgaggtatgttactttttttatttttttgtcaacagctaggtaatgaacagaaaatgtgtttgatttcaacaggatatatgtaggttttcttgatatccagaaaataatagagactgatttgggtatcttcttcaaagctttagtcaattaactttaaaaacagtaatttcatgtaataacatagcatgagatagtaatgattgtccttaatttcatatttttctggcaattcctagattcactgtggcatttgttttaccgtttaaagcctgtgattcttggccaagcgtggtggctcacgcctgtaatcccagcactttgggaggctgaggcgggtgggtcacttgaggtcaggagttcgagaccagcctggtcaacatggagaaaccctgtctctactaaaaatataaaattagccgggcgtggtggcacatgcctgtaatcccagctactcgggaggctgaggcagggggatcgcttgaacctgggaggtggaggttgcagtgagccgaggtcatgccactgcactccagcctgggtgacagagcaagactctgtctctaaataagtaaataaagtctgtaatgtgattcttctcagtacagacagtcccaaacttacgctgtttcaatttgtgatgcgtttgtcagaacgtaattccattgtaagttaggagcatctgtatatatccagaagactaaaatattctatcagcgtagaaagtatattctatggatgaaatcatacaaaatgaaataactaaaaacatgagactttttttatgacacacatcacagttttttgtttggcacttctatgaagctagcatattaaatgaaagcactgaatggtgaaggcctaaacatagaatctgttcctgggaaaccatgtgctcatctagggtgggttttgtgaatttgagcaagtcactaagggcaggtaagcaagtacccttggctgtaaaccaccccatagaggtgttaggagcaaaggagttaaaccataagaaccttaccactctaaaaatgctccgtaaatattaacaattttactattatacccctgagtttttaaatgtcattcctgtgtactgtaatattcatagctattatttaaaatagacttaaaaactagttacaatagccaataatttctcaattgtgcttcttctggatatatatgtgttggatacaaacatttttattatttcaaaaaaaaaaagtcatgatcccagagtccgcccgctcctgtcctttcccgtgttcttccccgcctaccccgatggcacagtgtacctttcttaggtactcttcaaagactcaccacagaaggtactaagatatgagtgacctcactaatgatgcttttaaacattataaggcaattagtatgttcttaggcgactttttaatatgcatgccagaagataggttttctcagtaatggatgtaagaaactaaagctattacaactagaaaaggaatttttattattttaaataattgatttctactctttccctttttttaaattagtatttctctgaacagccattgaagaatcttctgctttcaacttctgaggaacaaatcgaaaaatgtttcataattgaaaatataagcacaattgctacagtagaagaaactaatcaaactgatgaagatcataaaaaatacagttcccaaactagccaagattcaggaaattattctaatgaagatgaaagcgaaagtaaaacaagtgaagaactacagcaggactttgtatgaccagaaatgaactgtgtcaagtataaggtttttcagcaggagttacactgggagcctgaggtcctcaccttcctctcagtaactacagagaggacgtttccctgtttagggaaagaaaaaacatcttcagatcataggtcctaaaaatacgggcaagctcttaactatttaaaaatgaaattacaggcccgggcacggtggctcacacctgtaatcccagcactttgggaggctgaggcaggcagatcatgaggtcaagagatcgagaccagcctggccaacgtggtgaaaccccatctctactaaaaatacaaaaattagccgggtgtggtggcgcgcgcctgttgtcttagctactcaggaggctgaggcaggagaatcgcttgaaaacaggaggtggaggttgcagtgagccgagatcacgccactgcactccagcctggtgacagcgtgagactctttaaaaaaagaaattaaaagagttgagacaaacgtttcctacattcttttccatgtgtaaaatcatgaaaaagcctgtcaccggacttgcattggatgagatgagtcagaccaaaacagtggccacccgtcttcctcctgtgagcctaagtgcagccgtgctagctgcgcaccgtggctaaggatgacgtctgtgttcctgtccatcactgatgctgctggctactgcatgtgccacacctgtctgttcgccattcctaacattctgtttcattcttcctcgggagatatttcaaacatttggtcttttcttttaacactgagggtaggcccttaggaaatttatttaggaaagtctgaacacgttatcacttggttttctggaaagtagcttaccctagaaaacagctgcaaatgccagaaagatgatccctaaaaatgttgagggacttctgttcattcatcccgagaacattggcttccacatcacagtatctacccttacatggtttaggattaaagccaggcaatcttttactatgcattaagacctctgattcaaaacttattagaacagtagcttctgctggaatttgcaatcactgaagtcatagaaaataggtaactatctaattagagaaataattgttgtattttaagatctgagagtgtgtacaagttttagtatacatgccatgccagaagatagtgtatgcaagaagtcttgggaccagaaaatggcaatgataggagactgacatagaagaagaatgcttccctaggaaaaaggtcgctggctttggtgcaagaggaagaagaatgttccactggaagcctgagcacctaatcagctctcagtgatcaacccactcttgttatgggtggtctctgtcactttgaatgccaggctggcttctcgtctagcagtattcagataccccttctgctcagcctgcttggcgttaaaatacaaatcattgaactgagggggaaaaatgtaactaggaagaaaaacccaatttaagaaattacataatgctttccaaaggcacctacaacttagttttaaattacttgctactggggattacccatggatatccttaataggcaggaagtctgggaattctggtggcctctagggcagtgttctcacagcaccgttccgacagggaccagtgaaagaaaagagacaaagttagaacgtgctggggagcggccatttctaaggccagtctggtttaagtagtcatttctgctgaaaaaacagatgatcctggtggaagaaaaggttgaaggcagctgccctcgggagggctgtgatgctcggcacatcctgcctggcacatacacgtgtctgcaggccacaccgtgcatgtccccagacctgccgcctggcttctggagtgcttcaagcagagcatggtgggtcattgaggagacccaggaatctcatctgagaacccactctctgccggagaaccccatggtgacacattttcatctttctgaccagaggctgtttttttttttttttgagacagtctcattctgttgcccaggctggagtgcagtggcttgatctcggctcactgcaacctcgcctcccgggttcaagcaattctctgccgcagcctccagagtagctgggataacaggtgcccaccaccacaccccactaatttttgtatttgtatttttagtagagatggggtttcaccatgttggtcaggctggtcttggactcctgacctcatgctccacccgcttcggcctcccaaagttctgggattacaggtgtgagccaccgtgcacggccggcctgacctttggaaaagccttgtcactttggacgtttgcgtctttgaagaggcgatgggagcatatcatgactgcctgccaccattgcttttcagactaccacaactcaatcatgctgtccaggacttctggccctgtgttcaccactgggaaaacgtacttcagactggatagcctaaaaaggagcaatgcccttgtaggatgtggagaagggaaaatacggacattaacattaaaagacaccagtgaaattgttaggtctctaggaagttggagcacaaggcttcacgctttaagaccatctgtggttttcagtgaacaagcgctgagcaccagcagcagaaaacaacaacaaaaaaacacctcgtttttaccttgtcttctagacatgaaaaggcagttgcattccactctgcattatgttctacatgttgctttatcagtatatgcttagctgtaagtgacaagtattttttctgaacagaagtttacttagaaataccatgcacttgggggtaccaattaaccgcctgaaaattagcatattgatagttcttagagagaccagatataatctaagaatttatatgaaagatttgtatcattagagccagaaataattttatattaatatataatacagattaacattatatataatatgtacctgtgtcacttctgacatgagcctgtaaacatatattcatatatgtacctgcacatgtacccacctgatgtaggtcttattcctttagtatggacttaaagtacttattcatataccttgtaactaaaaattagaacagctccctagaattgtgaacttttaagagtctgactagaaatttgcaacttataaaaaagttacttttaaaaatataagttagggctaggcacagtggctcatgcctataatctcagcacttttgggaggccaagacaggaggatcacttcaggccaggagttcaagatcaaccaacctgggtaacatggccagaccccatctctatttatatatatatatataaaacttagagtttttatcttcccctaaaagaggccgtgatatttgcagcagcctcaaattgctcttaaggggtttaggtgtgcagaagctttcctttccctacccagtaaccatgtgactactaacgtggtatattgatttattttgtttgctgtctgtctcccctgccccactgctggaacagaggctccaagaaaacagggaccttattattcattactgcatccccagtaatgaaagtacttagaaaataattattgaatgaatgaaatctaaactgtgaacctgagggtgtttgtggcagtgtttgttttactgaattgtagaaggacataaccgtgttttcagtgtttctatggaacaaacttgtacattttatttcacttgtgttttgtcttaaaccctactgctggaaacaattttatgtaataagcaatgggcccaaaagtctaggagtttttttgtacttagtgaatttgtatgcaacagagatgctgcagctgatgcctttaaaaggtattcatcatggaagagctgaggcctgtgcttggtgttccagagcccagggttgagcatcctgaaggagccactgcagccgtcactgtccccagagcctgtggagatagagcctgtttgctgctttttcttcccgctcttaagacatggctggagctcagtcttcattgaatgaagtttgctgtggtattgcatagccttgctttcttgaactaaactgtttgcccttcacaagtagttcttctttcaggattagttcgttccaaggaggctcttcagtctcacagataagtagatctctcctgctgtctggacacatttcactcggaaattgaatacaatttgtattcaggctgggaacctgaacacacacttgtgtttttaagcttcccttttttacagtggacaaggacacaaataataaataaatcatccctaatgcccaagaa

SEQ ID NO: 1760 - DNA, 32832 bp, Homo sapiens
gcccgcgcttccgtatcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaaggtaacgcagcgtggcggggtcgcgggagcggagcgcgtggccagctgactggagggaaaacgccgcctccctgcagcggttcccggaatcccctccggttccctctcgctctccccgactcctcctcctcctcctgccctccctctgcgtcttgagtatgcggctagtgcgcccttcctctctcccggggccgcacctgcgaccccaggacccctcccgggccctgtcctgcgccctccacgcgtcgcccctgctgggagtccgctttcgttgcacccctccgcgtcccaccccaccccaccaaggatgcccaggataccgggcatttgccactgcaagatgtgagtcgttgctaagtttgagggtcacattcctccaggtccaccccgccttgcaaaaccggctcaccagctgggtgctcaggttcgggatctccagcccgcccccttgaggtcccctgggattagcccccctcgacctgcgtcagggtcacagactgcagccggggctggagcggcctacacccctccggatccgctgcgtggaggcaggagggggaaggggcgaggggacgtggccgcggagacagaagggtgcaccctcccagggtcggagaggggagatactgggaagatactccgcgaatatggagaggcgatcggcacttgcatttcaaccctgagcaaatcaatccgttacacgcagtagcgagttgactccatcagcccgtttatttggttagcgatggttatattgactctgagtattcccacctcctttcttttaacatttttttttttatttccttgttttgtttagcaagaagtcttagaaacgaatatagcatgcttgggcgttgattcagtggtgagaagtgccggagctggctcagggagaggtggagtttcccatgtgtgctcactggcccaggggctaagtcccactgcttgccaaggtttctcagtatcctgtccacccaccccctatccacctgtgcaggcttgagggggtgagggggtagcagatactctatcaaaatctaccctaaggaaaatattcgataaacactcctagcaattagggcatagctgataaggcttgatctgtttgtcgcagaaaatgacttgaacttgtaagttctattgttcataaagttgttttccacaattttagataatcaaaaatgtacatgactcatttttcttacctattatttcctctaaagtttctcatgtatttattgaaaagttaaagaaaatctgattttggttcacataatttgacaatggtgatttgtctaaaagtcatttcaaaaagtagtatgaaaaggatcataaccctagaggtactgtcatagacgtgaaacatttattaaaatatatattccatggctcacacttgcacactcaaagccacattggactcattttttctgctacctttataaaccttcaaactgttcaagagtcaatggtatgtatcatcttccgttatcaatcatcatgttttgttttgtttggtttggtttggtttggtttggtttttgacaaagtctcgctctgtcgcgcaggctggagtgcagtggcactgtcttggctcactgcaacctccccctcctgggttcaagcgattcttctgcctcagcctcttgagtagctgagattacaggcgtgtgctactacgcctggctaattgtatttttagtagagatgggatttccactatgttacccagcctggtctggaacttctgacctcaaatgatccacctgctttggactcccaaagtgctagtattacaggctcaatcatcatgttttatcaaagctaaaacccaaactaaaatgccattgcttataagatgcactttcattttatgtaatgaagtaagaaaaaacactgtcaatcatgctatgccatgccaccagaatgaaagcattctgatttcagaaattctcaaatgttaaaagaaaatgggcattttataatttgtgaaatattagtgagttagagcagagcttgacggcactggccctgagggtccttcttcttcctttggaagaatgaaactgggggctatgcaattcagggaagaataaaggaaaaacaggtaattggcagaggaggttggctgacttagaggtatggaaaagacaaaacaaaggagggaaaaagagaggtatgtatgatggggaggagttcagagccactgaaaattttctctggccctaacaggaaaacgagttaccccacaagccagggttttatcatctggtacgtggagatatccatcagcattgtcattggttttcatttgtttgtttttaattctcaagtttaaaaaaaaatttaaaatttaaatgtgtctcaaccaccagaaactatagtgagatttctctgtaataaataggaaagaaggagactgatccagtccttgttaaaaaaaaaaaaaagaggaaactgaatcacaacatactttgcttttttcttttctcacaaaggaacagtgggccctttatgctgggtgaaggtgagtgagatgggggaaggttcactgggcaccaaccttctgggctagagaaattgcccaggctttacagaacaagctggaatcagataaagttgtggaaaggaagtcgaggtttcactctgccatatcagtaggaggtactaaagccaaactagtagcagcaaagtgaacagaaatggtaagggggaaaaataggaaaggaaagaacaacgtggattgcaagacgtcttactaaaaacaaagaattacacttggaacagaagaaattcattaccattgccttacactgtgcaacaacttgataaaaatataaatccaataaaacaaactcaaagatgagaaaattgtaaactggagatgaaaagggagattgcagacctaaaggaaaattgaagaccgtaaaaacatagtgacagaataaataagtcaggagaaagaacagaagcaatactgctgaaaataaaagtattttaatagaagaaagcccagtaaggaagcccagtaaattcaactgaaaagggacaaagattaagaagaaagaagctattatgaaagacaaaatacaatcaagaattgggaccactgaagtcccagatgtagagaagtcaacaaatgggacagaaaattcaaataaaaataagtccaaagaaagcttattgagatgaagaaaaaatggtctgtaggccaaaggaacatgccatgttccagaaaatgtcatgtgggaatacggaagcactacgatatcttaaactatttaaattcaaagaaaaagatttaggaatctaagaagaaaaagtaaaggagggaaaaacaaaatcaagctcgcctcagacttcagtgcagcactaaatgccagactatgatggttgtgaggaaacagttccaagggaaagaaacttttccgaggggcatattttttttccggaagaacaaagggaattcagcacccatgaaccgtttttggaaaaacaaaaacttgctgagtaataaaatccaggaaatagcaaattaagagataaatcaaaataaagaacttaagagtagagaaaggtaaaaagacttggtgagtatttattctatttaaatatagaagtaatacatctatagaaattgtgggtaagatagaatgcgattgttattaatctagacaaaaatatacagccaaaaaaaaaagaagtcagagaggaagatggaaggaaacatgagaataccaatattctcttctttcaaagaatggaatagtaaatatggtataaaattaaaagatgctatgtgaatatataatactgcaacttttaatatctttcataagttttatttaaaaccttagagggatatcataggaaattatactttcttatggacaaaaaaatttaaattttaacaactcctttgactttattttagtcttttcccaagtaacattaaacagaaacactgtgtgtgtgtgtgtgtgtgtgtgtgtgtgtgtgtgtgtgtttatgcatagaaagatctgtgggattatgttcgcctaatattaatgatagtaatagtttttacagaagaaaaaagaaagatgtttgaaaaataagctagaatcaaatatgccaagatgttaacaattgttgatgctggatggtaggaataaggatgagtgttactttcttatttgtactttttcatatttttctaatttccagaaaaagatatgtaattgtttttgtctaacatttctgaatccacttcattcattattcattgcctccttgacaatgtgcatcagtctatgtcaaacagaaggaaagacacagccatactttaccaggagactatgaggcagcgagttcctggagggttgtttgtctgtctaggaggagttggaattcaaagaatcacttcactcaatccatccattttatctgggccttgaaaattggcagggtttgtctggtctcagggtgaatagcaggtagagctcttctttcagaatggagaaggccacagtgtcacagggtgaacctgtgacaaaattggggttcagcctgggaagccacatgagttgttggcttcgcacaggatggaattaaagagcaagctgacagaattaagtgaaagcaagtttattaagaaagtcaaggaatgaaagggtggctactccataggcagagcagcagcatgggctgctccactaagtatacttatggttatttcttgatcatatgctaaacaagtggtggattattcataagttgtctgcaaaaggggtgggagttctggaactgagggttcctcacttttttcgatgatatagggtaacttctgcatgttgccatggcatttgtaaactgtggtggcactggtgggagtttcctttagcatgctaatatattgtaattagcatatgataagcagtgaggacagttttgtcaccatcttggttttggcaggctttggccagcttctttactgcgtcctgtcttatcagcagggtctttgtgacctcctgttttatcacataactaagaatgcctaaccccctgggaatgcagcccagcaggtctcagcctcattttacccagctgctactcaagatggagtcactctggttccaacacctctgacaagagcagggggtgacctgtcacctggggctcagcaggacaataactctaggaaaaactggaaaggctgatagccttgaatttaacctaaggagcttggtgcattgtcaggcaacagtgagctacagactgagctcactacataattcacagggcccacccagagccaaataaaaatgcctgagaaagtaccactaaaggtactaaaatataaagccttttcttccacagtctctctctctcaacacgtaatgtttttttgtttgctatttaatatcattctaagtaaaaaaataggccgggcatggtggctaacgcctgtaatcccagcactttgggaggccaagtcaggtggatcatgaggtcaggagatcgagaccatcctggctaacactgtgaaaccccgtctctactaaaaatacaaaaaattagctgggtgtggtggcgggcgcctgtagtcccagctactctggaggctcaggcaggagaatggagtgaactcggaaggcggagcttgcagtgagccaaagtttgcgccactgcactccagcctgggggacagagtgagactctgtctcaaaaaataaaataaaataaaaaataaaaataaaaacttgaattattagcatgaatattgcagttctttatattatgcaaaaccagatttaaataagagcatttaattcatatatggaattgccaagttataccattagtactttacagcacatcttgggaggttcccttgaactagccagaagaagcaaactgaagccagacagaggaagattgcaaagaggaagagagggtctccaccaggcacagagccacccaagggagccctccctcaggctcagggataccgagggagccagagcagattcacacaggtccctggggcccctctgccctggtgactctaggatgcatgtacttgcacctgacttctaggcatccccctcctgctagcttcccctcgatccagcctggggcaggctctgtggaagtcaagccttgcatctccctttcccaagcacctaccatcctaacccacagtgtagtggccacgtccaagggtctttacgtctctgcctcagatatgctaggtacctgggtcaagagtgacccagagactcatccctgccagacccaacctccagccagtcaccctctgactccagtccatggggcgaggctggagtgctggccctgacctctccagcatctgcaccaggagggcttcagcggaatgtggtcccagttgatgccccatgccaacagtagcagcagcagttgttaggcatagagattgaagccagacagggcctgggattcctctgctgggagcctaaactgcaggagatggggaaggatccaagtgtgagctggggctcctagcacaaaactcacattgaaagataaaatggttaagaatttcaggatagccacaggagaacctcaagccaagtgtaggatccttctagctgcagggcctgggggtactgagactagccctgttgacaggagccatgctttaggaagactgatctatttgtagtcagcaagagttttaaggagctccattaacaatttaggcacgatgccaagatgggatattatattttccaagcaagaagaatctggtaatcaggcatatggttccaagtgaagtataagtcaccagaaagcaaggaaggaagccatcccctggcccagagggggagaatggggtgtgtgtgtgtgtgtgtgtgtgtgtgtgtgttttctcggctgctgaagagactgagtgttcctgcagatatataacaaagatgaagatgtgccaccgttggagacaaatggggaccagaggccacatgtcagaggtcaggtcaggtgttcaaatataaaggggttgccctggctgggcatggtggctcacatccataatccaagccctttgtggggctgaggccggaggatcacttgagcccaagagttcaagaccagcctggacaacatagcaaagccccatctctaaaaaaaaaaatacaaaaattagccaggtgtagtggcaaatgcctgtagtcccagctacttgggaggctgaggtgggagaatcgcttgagcccaggaggcagaggttgcagtgagccgagatcacaccactgcactccagcctgggtgacagagtgagaccctgtctcaaaaaataaagaagttgcccttctacaatctggatgtggtggtatctaggggaatgttcacaactaggcaacgcctctgctgtggattgattatgggagatgacatcacacatcaagatatctcagcagatgtttctcaatgggtacagtattatgggattagttccaggcagtcgtgcttggatatctcatgggtggtggagtctgtagcaaggctggaaattttgacttggaatcacttggatttctctaagagaataccccaggttggatgtgttactgtggcagcagagaagacttaaaaattacattgtttttagcttgaacttcgtcttgtgaagtcctaattagggaagaggagtcaggctgggggtctaggggaaagcaaagagataaagcagataagccataggtctaccttgcttcatggtccaggacatacaaacaaaaagaagaagcagataagctataggtctgcctttctttatggcccaggacatacgaccctcctgcacacataactcacaatcttcctgcgtatcatcaaatgcttcaacttatcatcaaacatctcggctgaccgaaaaatgcaagttagctccctgctaccttggcgttgtcagtcctccacatagcactcttcagcttaaattgcattttataaaatccccagcaagcctttgtctcctggcagtcaactcgtctcttactgacctgcccattgctcccttgcaatgtattttcctactttctctaataaatctgcctttcttgacctaaactgtcatggtaaattcttcttactcctatgtcaccagccacagacagtcgccacaagccatgacaagtctgcgatttcatggtctttttttattttgatgatatttccccagtgtttgggggacagaagaatgcccacaatctataggtcttagtcacatggatggggacagaatatctgagagagagagaaggaacaagatctactggggctccttaaaattcttcttgaagaactcctttctcaccttggagtagggaagactttctgattatgactcaaaatttagaagctaagaaagaaaatacctttaaatctgaaaacataaaactcaaaaacttctgggtgtttttttgggggggttgttttttttaaacagcacaagcaactcaaagggcaagtgacaaactggggagagaagaaaaagatgtgactcatatcacagtttcccttctacttaaaaaaaaaaaaaactgcaaaccagtaagaaaatagcaacagctcaacagaaaaattgccaaaggcacgaacagttaatgagaaggagatgcaaatcgctcttaaacctatgaaaagatgaaggtgttccatcacaaagagtaagagaaatacaaattaatattaatgtgaaagacaacttttcatttatgaatttgagaaaaatccaagaacttgatgatatacctctaagaagcaacggtagggaaacgaaaattctcacacattgcaggtggttatgtaaattggtatagccccgcgggtggtcagtgtgacagtttctatccaaattacagatgcatagtttcattgccaggtctcttctgtctgcttcttcagacccaccctcccctctccccactgtttagttggcccaggaccctgtctggtaaggatacaactccaggccccttgccctatggcttctggttgtgttcagccgatggggagccccaaataagagaaggaagggacaccgtgagtgatatttatccctcagcttcctgcctgcactgtcctcttggtctggctgtgtccagtggtctcatgtcatagctgctcatacaggagtttctccttacaaattgcaatgttggcttctcttccccctccggcccagagtgattacagccatcaatgttgtgagctacaggttctataccctcccttctgcaggcccagaatggtaacagccctcaatgttgtgagctgcaggttctgtactctccctcctggggcccagagtggtcacagccctcaatgttgtgagctacaggttctatactctcctttctgcaggcccagagtggtgacagccctcaatgttgtgagctacagctctcaatgttgtgagctacaggttctataccctccattctgcagacccagaatgttacagccctcaatgttgtgatctgcaggttctgtactctccctcctggggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctggagtctcccttctgggccccagagtggtcacaggcctcaatgttgtgagctgcagattctatactctcccttctggtttgcctacagccctctcacacatttgtaaatatagtcctgcaacccctaatgatgtcttgggcaaagatggaccttttatatgacgatagccccataagattataccatatttctactgtaccttttctgtgtctaaatatgttcagatacacaaatgccactgtgttgcaactgcttacagtattcagcacagtaccatgctgcacagatttatagcctaggaacaatagtctataccatataacctagatgtgtagttggctatgctatctaggtttgtctaagtatactctgatgttcatacaacaaaatagcctaacaatgaatttctcagaacacagcactgttcacagttgcaaagatatggaatcaacctaagtatccatcaacaaatgattggataaagaaaatgtggctaggtgtggtgctcacatctgtaatcccagcactttgggaggccaaggcgagaatccaggagtttgagatcagcctgggcaacatagtgagaccctatctctacaaaaaaaaggtttttttaattagccggtgtgtgatgacacatacctgtagtctcagctacttagggggacaggtgggaggattgcttgagcctgggaggttgaggctgcagtgagccatgattgcaccactggcactccaggctaggcaacacagcaagacccgtctcaaaaaaaaaaaaaagttacatatatatacacacagtatattcagccataaaaaagaatgaaatcgtgtttttgcagcaacatggatggaactggaggccattatcttaagagaaacaactcagaaacagtcaataccacatgttcttataagtgggagctattaataaaaaatgtgcacacattgacatatatataatgtggaatgatagtcattactgactgagaagggtggattgggtgtggggagttaaggaatgagaaattacttaatgggtataatgtatactattcaggtgatggatacactaaaagcccaaatttcaccactatgcaatatatctatctaacaaaactgcacttgtaccccttaaatttatttttttaaaaagcgtgtatcctaatttgaatgagctgtttcttgccagaaccctaactgatatgtcctttgtctagcaattctacttctggaaattttcccacacttaaactggcacatgtgcaaaatgaaagagatttccttgcagaagagactggaaataattcaaatgtctatagtaggggtactaattatataaataatggtgtgtctatagagtagaactgtatccagctatttaaaaaacaaggatagaaagatcttccaaacatatttttaagtggaaaaagcagggtggaacagggactatacatgctatctcttgtctaaaagatggggaaattaggaatatgtatttgtttttgcttatgcatgaagatactctgaaggattcacaaaagaaaaaaaagttttctaaagggagcaagacttttcacaattttttttttgaatgcttaaaattgttgaacccaacgactgttgcctgttcaaaagttaaatttaaaattcctcccagactaggtaggggattgggcccagaagctgagaccaggctcacttgaataaatggggtaaatgactaggaattttactattccttacaggtctctcattatcttgtctttgctcccatttttatatttgcagtttaattagacacttcagaattttgatcacctaatgttgatttcagatgtaaaagtcaagagaagactctaaaaatagcaaagatgcttttgagccagaatgccttcatcttcagatcacttaatttggttctcatgggtaagtgctgctttttatcttagctcttatagaagcaagctgtgatgccatcctcactgagagcactggcaggaagtcgcaaactcatttccctgactagaggacccagtaccaccctgcctagtgtcaggagttaagtggaaagcaaataggaaacctacactagtagtttagattcaatgtagattcctgtcctgttgttaattttaggaaaacaaatgagtgacttaaggcaataataatcaggactatcctcgccataatttgaagagtaatttctcctaacacgctttcttcctccccaatctttgataaatgtcttttacctctaaagttgattaattagcaacatgcttattcatattctgtgaatatttctaggatggacaattgcctctgaggacattccctcagccagcccaagtacttaaacaaaaacaaggaaattctttgatgttaaagatctcgtgtgtgtccgggcgcggtggctcgcgcctgtaatccctgcactttgggaggccgaggcaggtggatcatgaggtcaggagatcgagaccatcctggctaacatggtgaaaccccgtctctactaaaaaatacaaaaaattaggcgggcgtggtggcgggcgcctgtagtcccagctacttgggaggctgaggcaggagaatggcatgaacctgggaggcggagcttgcagtgagccgagatcgagccgctgcactccagcctgacagagcaagactctgtctcaaaaaaaaaaaaaaaaaaaatctcgtgtgcgtgtgtgtgtgtgtgtgtgtgtgtgtgtgtgtgtgtgtgtgtgtgttttgaggcatagtttcactctgttgcccaggctggagtgcagggtgtgagctcagctcactgcagcctccacctcctgggttcaagcgattctcctgccttagcctcccaagtagacgggattacaggcacccgccaccatgcccggctaatttttgtatttttagtagagacaaggtttcaccatgttggccatgctggtctcacattgctgacctcaagtgatccaccgccttggcctcccagaatgctggggttacaggtatgagccactgtgtccagccattttttttttttttagacagagtctccctctgtcacccaggctggaatgcagtgagcgatctcacctcactgcagcctccgcctcctgggttcgagctattctcctgccttagcctcccaagtagttgggactgcaggtgtgcaccaccacacccagctaattttttgtatttttagtagagacagggttttgccgtgttggccaggctgatctcgaatcctgaccttgtgtgatccacccacctcggcctcccaaagtgctgggattacagacgtgagccacgacgcccggccccagatatatttttaagtggaaaaagcagggcagaacagggaccgtacatattgttgttagtgtcagctcccaaatggatcttattttatctcagatcacagtccttgcaccatgtgctgctggcaccaatgtagagtaaaaaccatctatgtgggcatttttttggcacaagaaaaatctcaatctgataccaataaatgtgtgttaaagaatgtcagacttagagtaatcattgcaagttgagcccagataaaactattgcctctctaatgtgttttcttccttctagtgtatatcagcctcgtgtttggtatttcatatgattcgcctggtaagagatgttttttggcttcactaaattttgtataagagtgaaagtgttggggcaaccattcagaggtataaaatgtgggagatttgatttctgattgtacatctgttgcctgttttattgggattctttctctgtaaaaggagctaaaatgagctaactctggttttttgagagatacaaaactagtctaagaaatgaacactagagatcatttttaaacttctttaaagaatattcaaactcttaataatctcactaataaaagaatgaggagacacagactgtgccaaataaaaaatggcccagaaatatttactctttaatttacattcttccaccctgatgattccagacaaaggacaataatttttttttaactaaacttcttcctacgtatataaatctgtccacaaaacttcactaagtattaaatatgtgtccaaccttgtgctaagtgttggttgggggtgaagagttggcagttgagaaacaaaggcctgagtcctaaccacaggaaacttcagtgatctttaaaaatttaaccgtataaggcagaatttggcaagtctggctttaatgtctcatttatcactgccacttcccacctacatgacattgtataattcaactcagtttcacagtctgtaaaatgaatcttttcatagtgcctacttcagcattgttgtggggcttaaatgcttagaaagggccagtctgggctcatgttatactcccctgctctctgtgatccagggaataagtgagctggggaatccagaggaaggaaaatttgcagcgggctgagctacttaaggaggacttcatggaggagctgggagcagagttgagagaacggcttggggagggagaatgggtaggggagagtgaaaggaagtgcatcatgtgggctgggatggcctgggttattttggtccagtgaaccatggagggacagtccaagggcatcggagaagcccttctgtccagactctccttacacagtgcacagtccctgtttcccatgcttgcctgccctgacaatatgttgctcgttaattgacttactaatttatttcccatgtcctgtagacttcctgttttcaagacaccagggctctctggagaggttatctgccagaggtgtgggttctagatcccaagaaatgactgaacagtggccagaatacaactgtgggttccaaatttcaatgccctttttcttcttctctttagattacacagatgaatcttgcactttcaagatatcattgcgaaatttccggtccatcttatcatgggaattaaaaaaccactccattgtaccaactcactatacattgctgtatacaatcatgaggttggtttgatatttcattttctcttggtaaacatattattgttctgttatatggggagaggtgatcttttctctctctctgtctctccctctcccttttcctatctacctctccttctctctgcgtttcttattcagagccttaaaaagccaaagacaaaacaccatcacacatccatttttaattcagttgaatactttaataatccaaatctattttgacaaagcttgtatgtgtcatcaaagccaatttctacaggtcagaacctcacatacaaaataattcttgtgtatgggttaggcaatgatttctctaattcagtcagtctgaatgtttaaaagtcctgttatctgaggacaggaatccaaaggtctattgaccatattgatggtttatgttcacttttctttactctggtgggacaccagaaagctgcctggcctagtctgggacaggcctgggtccatagtctggtttggtcactaaccagcttgacacttggcacggacctcagcccctaagctaatgcctctgctgaggggttgctgcaaggattcgtgacataatggatggagtcctgcttgtcttttgtcttcccacacctaccaatcgcccttagaagtcattgctttgatccagcagccccttggagtgtccttttgatggttatttatttggcctagagctgctgctgctactgcttattgactgagccagtgggagacctcttgtgagtttctcttcggtgcctgctaaaaagtttttctctgcattgagtggtcacatgtatcatccaactaactgaagcttggtagatgagatatctgcattgtccctgaaatagcccaggtctgacttaggactggatcatctagtcttagccagagagggagggggtctcagggaaggcattcataattgtcccatagaggaagggagatctgaggcttccaccatgagggcccaagtttcattcattcatttactcatccggcaattttttttttttttttgagacggagtctcactgtgtcaccaaggctggagtgcactggtacgatcttggctcactgcaagctccacctcccgggttcacgccattctcctgcctcagcctcccaagtagctgggactacaggcgcccgccaccacgcccagctaattttttgtatttttagtagagacggggtttcaccatgttagccaggatggtctcaatctcctgacctcgtgatccgcccgccttggcctcccaaagtgctgggattacagacgtgagccactgcacccggctcctccggcaagttttactgagcacctactacatgccagggggtccaactgtgaaccaaagtccctgccctcctggagcagacattatgtaaatggagacatcagtaaacaaaggtataatgtgacaggtgtgggtaaatgctacaatcaagaaaagagagggattgaaagtgcaggggtggggagggcataagatgttccattttcaataagatggttggggaagatcacttaatacaatgatatttgggcagagccctaaaggaaacaatgaagtaaggcgcccaaaaatagactctcattacatcaatgctaacaatttcctttttccatttttttctttccaaagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacagtgagttttatctctgtttctccacttcgtccccatcatcaagatctttattatttgctattccatgaaataggaggtctacaaaggtgttttagacctggggctgggctcacctcttggccctgccacttcctagctctgtaaccgtggactgctttgcttctctgagccttggttttctaaatctgaaaagtggaatgataatttgtactttgcagatttgccccgtgcctgtataaggcagtaggaactgctgttttcggttttgcagcctgacaggaagtctggagccaggttcaggtgggctggatctagcgctctcatctctctggcccaggattttctttctttctttctttctttctttttttttttttttgagatggagtttcactctgtcacctaggctagagtgcagtggtgcgatcttcgctcactgcaacctccaccttccaggttcaagcgattctcccacctcagcctccagagtagctgggattacaagcacacaccaccatacctggctcattttttgtacttttagtagaaatgtttcaccatgttggccaggctagtctcgaactcctgacctcaagtgatccacccgcctcagcctgccaaggtgctgaggttacaagcatgagccaccacacctggccccagtgttttcttaatacagcaactccaccccctcattataacccaatgttcttttgtgtgtgaacaccaagtgtgcatgcacctagtacccaaagctcagaggagaagactagaccccaagaacaggcctaccccttctttctttccctgtgactcaagtcagttccctaacacactgtgttaacagccccagctgtgttactttttcaatttcccactttacaacgagtttccaagagaaccatctggtctcagcttcctgttgtaggctatgcgggtgtgcacgtgctcatacatgattagcaaagtggtaaggataactgaatccccctgtggcaaacaattcggatacgacatttgctggatttgtgtgcatgtttacgtatgtgtataaacagacatctgtgtgtacacacagaaaagaaagaaaatcagaatttatagttcatggtatttgggttgttaaagaatgcatattaaagtaacagtgagatatgtttcatggctcaaatgataaatatgaaaaatacataaatatccaggtttagagggaatacaaagagtgtgctttggcatggtccatctgaagtaattggcagcatgtattaaaaaccttaacatgtgcttactctaatccagaattctttagtaatttgtcccaaagaaattattaaggccaggcacagtggctcacacctgtaatcccagcactttgggaggcctagaccagtgtatcacttgagctcaggagttcaagaccagcccgagcaacatggggaaaccctatgtctacattaaaaaagaaagagagaaagaaagaaagttaggggggagggagggagggggggagagagagagagagaaagagaaaagaaagaaagaaattattaaggacaaatgcaaaaatttagttccaagaatatcccatgatacattaagtctttaataaaaatcagagacaatttaaatgttcaaaacagtgaatcagttaaatcatgatacagtcacttagtggaatagcattagcaatgaaaaattatgatgtaaatcaggacttggcagattttctatacagggccagagaagaaccactttagactttgtgggccacatatggtctctgtgacatattcctgtctgtttttgttttttgcacagtgtcttttgaaccaccagagtttgagattgttggttttaccaaccacattaatgtgatggtgaaatttccatctattgttgaggaagaattacagtttgatttatctctcgtcattgaagaacagtcagagggaattgttaagaaggtaagtggcttctcctgttaggatcaaaacagttctgagtgggcaatcaatgcacttgactgtctcttttgaaaggaaatttgcagttgaacaattaaagctaaaacgtcaggcttcagtatggtccgacttagggaagaagtcactatggttcattcactattgatctaaacctgcagcacagtgttctttaaaagaataagccacggctgggcctggtggctcacgcctataatcccagcactttgggaggccgaggcgggcagatcatctaaggtcaggagtttgagaccagcctggccaatatggtgaaaccccatctctactaaaaatacaaacattagctggatgtggtggcaggcatctgtaatcctagctactccggaggctgaggcaggataatcgcttgaacctaggaggcagaggttgcagtgagccgagatcgcaccattgtgttccagcctgggtgacagagcaagactccgtctcaaaaaaaaaaaaaaaaaaaaagagtaagccacatgcacaacatcaaggaacacacaggagagagggtgtgggagggagatgcagagtacagccaaatttcagtgaaccctggagagatttatttgaaaaggagagtttagctgagccacccgtgaaaagcatctgtcgctgcctctctggccctcacacacagtaaggaagtggcttatctggcaggttctgtcctctcctaatttctgcaaaggacctgactctcagtaacctcagggttatctggtatcagacagccctgcatcttcaatttttgttgtccctagccctccaaatgctggaataagtggaaatggacaaattgctctcaccggtgtagcagcagcttatgtctgtagagccctttgccaagtataaaacccttgcaagtgagaccagcctgagagataatcagggtagatgcatttcaggcggagggcacaggaagttcaaaggctctgaggctggagtgggcccggtgtatttcagcaacagcgaggagaggtggctgaactggagtgaccaggcaggagatgaagaggaggtgaggtcagagggtaaatgtggctggacctggtaggagtttgtgggtctgggtcttctgagtgtgatggaagcctgtggaacccaaggcttaacagagcatcctggctgggctgttaaaaatagaccacaggggcaaagatgggagttaggagaccaactaagacacaatccagggtggcagtcacttaagaggcagtaacaaattatatgattattatcatttttcttttaatatcgacatggattataatcagtactctaggaaaaggagcaaaaatgggtgaaaaataagtttatgtggcctaaggactatgtggagtgtcattaaatctgtttcaatcatgtctcgtttgtgttcaccccataagcaactaactctatgttttagattatgattcctaaaataagagactgttgcttattaggatattgactactctataagaggaaaaactgtagttaataggcatcttcttcataaggaaaattagcctttaaatccagaaaaaaaaataagctactagtataatctaagcaacagatggtggtggcttggaccttgatagtagaggggtaatgagtagtgagaggccatcaaattctgcatatattttgggttttgtttgtttgtttttgagatggagttttgctcttgttgcccaggctggactgaaatggcatgatcttggctcactgcaacctccgcctcccgggttcaagccattctcctgcctcagcctccctagtagctgggattacaggcacccgccagcacacccagataattttttgtatttttagtagagacagggtttcactgtgttggccaggctggtgttgaactcctgacctcaggcgatccacccacctcagcctcccaaagtgttgggattacaagcatgagccaccatgcccagctcataattctgcatatattttgcatgtggagcaagactaacttccccattaactatggaagatgatgaatgaagcaggtgagggttagatagggttagagggtttgggacatgttaaattccaggtgtccgtaaggaatctaggaggagacgtggggaaggagctggatgtgccagtctgttgtccaggagagaacccgcagctagagagagagcctgggagtcactggcttcttggtgcatgttgaatgccctaagaccagatgaggtcacctgggaatagacactcagagagaaaacaagacatccagtgacagagcccaggaacattccaaaatttggagatctggcaaatgaggaagaaacagcaaaatcgactgagaaagagcaaccagcatggtagggagagaagcaggtgagagtgatgtcccggtagctgagagaagaactttccagaaggtgaaagtggtctactgagtccagtgctgtaaatgggacaattgaagaggactgactattggatttagcaacattgtgtccttgataaaagtagttttaatagagttaggggcaaagagctggttggagtagattcaagaaagagtgggaggagaaaaattggagacagtgaagagagctcattcttccaaggaatttttccaaacagggaaggagattgtgtgctggccactggaggggaagcttttagtttgttgggtcgtaagtttgtttgtttactaactcctcctcccaaacagaaatttacagaaaaacatcattactgaaggctgtatttgagctgctaggaatcctcatttattaaactgctagtaagaatgtattttaaaaactgtaaaacatgatacaaaagttattattcatgaaagagccttcatatcatcttttaaattctgaagtgaaatgcaactacaggaaagaagaggcaaggtgtttaaagggagatggctgggcacagtggcttacgcctgtaatcccagcactttggaaggccaaggcaggcagatcgcttgcggtcaggagttcaagaccagcgtggccaacatggtgaaaccccatctctactaaaaatacaaaaattagccaggcatggtggcgggcatctgtaatcccagctactcaggagactgaggcaagagaatctcttgaacccaggaggtggaggttgcagtgagccaagatcatgccactgcactccagcctgggcaacagagtgagaccccatccatctatctatctatctatctatctatctatctatctatatctgtctattgataaagggagaagatgagaaactagacatcagtcagttttgtcacagacaagctctgtgaccttggagaagttacttagccacactgagctacagttttctcatccgttgaatggaggtaatgcctattttgcagactgttttgaaagtcaaaagggttaatgtttatgaaggcactttctcaagtgtaaagtagacacacactgtccatgagagaagataatcttgtaaaaatgacgtcacagagacttttattcctctttgaagacttttatctcatttgtaaaatgaaggcgctagactagatgtcatggttataaaatatgtgtgtgtgcaggtgtatattaaaagtgcatgtaggtgtagttttctgataaattacttgctccagatgacttataaatcctttttcttaccaagcctgtgataaatctaaccctgtttgagatttgaagacaaatcccaaaagagattaaggcctacctctaaatgaaattctcagtcttactgattttttgcttatgtttacagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcaggtatgttcatttttttaaattcatgttttgagtattcatgcttttactctgagggcaagcctatttaaagaaaagaatctgaaaagaattcatggagcactaaaggtctttcttccagtaaacacctcacagagatgttttctgttggttcgtgtgtatgatctggtagagtcacttttatattgtcataccaaaaaacaatcagatactactcgatgagatcagaaatcttgaaatggaaacgcttttgtttcagggagtcaggattaaattcagcactgtgtgccctttgtgtggccattgctgaagccaaatgccagaagaggtggagttgcttgagacagtggtatacagtggcattaaggggtgaaaaggtggaagcagcgaggttgggtgcagttcatggatgtgatctggcatcagctctcgctcatagatgaaaggaacccttgccagggtgtacgagaaaatcactgatgaaggctgaacacctttctgttacacagacatcagaacaataaacagtgtgatcccaaaccttcttcccctttggagtgagaacaatcaagcctcggaactccctgctgattgttttctcaggaagtagccaagtttccacctgttttaccaaaagtgagaagctatgcaagtctccctcaaagaagcccttctaaatgtcccaaccgcagtgttaggggaaagaggtcccaatccataccccaagagagggttcttggatcttgcgcaagaaagaattcagagcgagtccgtaaagtgaaagcaagtttattaggaaagtaaaggagtaaagaatgactactctatagacagagcagccccgagggctgctggttgcccatttttatgattatttcttgatgatatgctaaacaaggggtggattattcatgcctcccctttttagaccatgtagggtaacttcctcacattgccatggcatttgtaaactcatggtgctggtgagagtgtggcagtgaggacgaccatcttggttttggtgggttttggccggctttactgccatctgttttatcagcaaggtctttaccaacggtatcttgtgccaaccccctatctcatcctgtaagttacaatgcctagactgtctgggaatgcagcccagtaggtcccagccccattttacccagctcaagatggagttgctctggctcaaatgcctctgacaccaatggaagtatctttaatgttctgatttaccagaataaaaataaggtaggatctataaagaaattactttagttgtaaaccaaaataaaattctaagccccccaaccaactgaatggatccctcctctcagccaagggccgagtaaagtaaagtaaacctgaaacactagttcaggccatgatgggagtgagtggtccagacgtgcctcacgggaccttcctacctttggaattcaggcacagctggccagcactaatattaaaacagaaaccttaagactgacaaaaagatgctttgtagcactaataccagcatgatggatagcaggccctaaaagaaaccaaagtgttttaccccaaaatacatttctttgacatattttgaaatggccctgcaaagctgtctcttgcagggaaaatctgctttctataaagaacccccttcccagtccaggtgttcttcctgatccaagagagaattcactaagagtctggcacttttttaagtccagtaagaaacatttacagtctgttctctctgaagcctgctaccagaggcttcatctgcgtaataggaaccgtggcctccgcaaccctttgtcttaacccagatgcttccttttattaattccaagtttttaatcagaaaatctttgaatctacctatgacctggaagcccccccacttcgaattgtcccacctttccagattgaaccagtgtacatcttacatgcattgattgatgccttatgtctccctaaaatgtataaaaccaagctgcaccctgaccaagggttctcgggatctcctggggctgtgtcatgggccattggtcactcatatttgactcagactgaatctcttcaagtatgttactgactttggctcttttcattgacaaagtgatatggtcacttgtgaatgaagtgagccacggaacgttgcctggcacataacggtgctctgtgttggcttcactacagggcaatatgatttgattctctagtgttcctcaagaccagatgatgcacaggctggttctaaaggaaaaaacatgtcaaacacctttagcgtaagttatttttatgtcagcaaatacaggcaaacttaaaactgcatatagattctgactatagctctttcaaaaatataaatccaaaataaatgtgcatgtctttgttctaacaccagctatctgacactaactagttgtccaatgattccattcatttctgatactaccccaggttagcacagaccccacaggttaaaggctcagtcccacaaaactgcctgcccccacttcagatgccagccacaagtcatgggtgacaaggttccctgcacttccacctgacttggctacaaattcaggagttcccatgacctccctttaggtttgataatttgctaaaatgactcacagaactcaggaaagtgttatggcttatgattaccattttattataaaggaattgatggacagccattgaagaggtgcacaggacaaggtctgaaagggtcccaagtgcaggagcttctgtccctggggagtcaggtgtaccaccctctctgtacattcatctgttcatgaatttggggactccccaacccttggtgttcacagtttgtattgggtttcattatgtatgtgtgattgattaaattactggctgcaggattgaactcagtctccagcccactcccctccttggatagaggtcaaatgggggagctggaagttccaaccgtctgatcatgtggttagtttttctagggaccagccctcatcctgaagctatccacaccctgccccatcacctcacaagcataaactcatatgtggcccctaaaagaggcttgttaacaaaagacactcctaacgttcaggaaattccacaggtttttgaagctctgctccaggaactagggacaaagactggatatatatgtatattttattatatcattgattttacatacaaacgaaactcttatagacaataaaaactgaaattagtgacctggcagacagatggtggtttattgaaactcagtccccagttccaaggtgaatgtgttgctgatgagaaggcacaagctccttggaggttgatgaattctgtgatgactcactttctcccctgactcttttccatttcacctactaagatgttcatgtaacaacatcctctcaggtcattccatttttacttggcgtgaatgcgtcatgttgcacatcaagtcagccctcattctttgattattacccgagataggtcaagtaccgctctctttaattatccaaatactgtacctgatgtcaaattcttgtttgaaactcaggaagcaaataggttcagataacgtggcctctgtcactatctgcttgccatctgacgtgccctcaaccagccaaactcagaaaccagacaggtttggatggtgaggggtcttggaaggatagcctgagaccagcattaacataggctcagcagtaagcactgtgacccaatcctagggcagactgatatggggggattttagcccagacatctggagaaacaccttccccttgtcaagccttaaaactaatggtttgtctcttttattaatattaaggccctaaggaaaagctctattcattcatttgacaaatgtttattgggggcctgttatgagccagattcttttctggatattgaggatttagcagtgaacaaaacagattaaaaacttctcaccttgtggagcttacattgcagtaggagacagaataacaagatcaacatgtaaaatagacagtatgttaagtaagtaccatggaaaaaaattatgcgggaaaggaggtgagggggatgtcaggttgaggagagcaggttgctgtttttaataggatagtgtcttgatttgcatttgctagaagcagagcctgggatgtgaattcatattcaagtgtgatttattggtgggggcatcttaggagaaggggaaagagggaacaggtaggtacagggagagagaaattaagcaggcatgtggctctcagctgagcctgatcccaaggggttctcggaagcgtgaactgtatcctcaagtcagcagccagtcagttactggtggtgatctatggcatggcctccagatgaggcagcccccttttgggcaagggcagttccttatgtgtccggagttggttcctgccaatgggttcgtggtctcgctgacttcaagaatggagccgcagaccttcctggtgagcgttaacagctcttaaagatggcacagacccaaagagtgagcagtagcatggtttattgtgaagagcgaaaggacaaagctttcacaccctggaaggggacctgagcgggttgccactgctggctggaggtggccagcttttattcccttattgtcccttcccgtgttcgtttctgtcctatcagagtgcccttttttcagtcctcctcgtgattggctacttttaggatcctgctgattggtgcattttacagagcgctgattggtgcgttttagagtgctgattggtgcgttttacagaatgctgacttgtgcattttacaatcctcttgtgagacaggaaagtccctgattggtgcgttttacaatcctcttgtaagacaagaaagttccctaagtcctcactccacccaggaagtccagctggcctcacctttcacttagagaaggatcagctctgagagatatcagcagacacgtgcggcagcagtagtgggtgtgcactgactggaaaaggggacatgggcaggccacccacagcatccaccacagatggccacagatggccttcctgagaaggtagcatttgaataaagacccaagggagatgtggtaagcagaataatggcccccaaagatgtctacatcctaatcccagatatgtgaacaggctaacctctatgccaaaggggcttgtgggtgtgatgaaattgaagatcttggccaggcgcagtggctcatgcctgtaattccagcactttggggggccgagccaggtgaatcacctgaggtcaggagttcgagttcagcctagccaacgtggtaaaaccccatctctactaaaaatacaaaaattagccaggcgtggtggcatgcgtctggagtcccagctacttgggaggctgaggcaggagaatctcttgaacccgggaggtgggggttgcagtgagccaagatggtaccactgtactccagcctgagctacagagcaagactgtgtctcaacaaaaagagaagcaggagactcagaggcagagaaggagctctcacagcagcagcagaggtcgcagagtgaggatgaaggagggggccatgagcaaaggaatgcaagtggcctctagaagctgggaaaggcaaagaaatgggttttcccctagagcctccataaggagttcagtcctgccaacatcttgatattttttatcccagtgaaacccattttggatttctgatctccagaactattaatataatatatttatattgttttatgacactaactttgcatcatttgttacggtggcaatgggaaacaaacacaaggtgagggagtgagtcacgcaaacctatcaggggaaggagttccatatgcggggttcagcaagtgccaagtgcccgaggcaggatatgcctggcacggcacggcaggagtgaactgaacaagggaagaatagtaacagttctggtcagaaaagatggaggagcctgaatgacatagaacttagaagccgttgcaagagatggggaccctcagagggttgtgagcaggttgctctccgtgatctgacgtgggatgtaaagggaacatccatccacatgccttgaagtgggagccaggtgacccctgggctgattactgcagtcacccaggggagaggcggtcttacttgttccagagaggtaagtacgggaggaactataagagactgatgttagtcatcgccagtcttttcataaagttctttatcttttccattaaagatcattgtgatcagatattaccaaccccgttgctcagttcagccctctgcttgtgaggtttcttattttttgcttaaaatatctccacagtgaatccagagacagacaggtttgtccaaggccaaatttttaagacacgacctggtctctccttcccaagatgggttgatctggtccatctttcatgaagaagatagttaacagcagtaacattcaatcacagcttctcctttctgagtcagaacattgatgggattcatctcttttcaaatatgaatatttaaaaatagcatgcatgtataattgtcatgaccccaagtgagatttctattttttagattatcatcaagctgaaaacaaacaaaaattctaagttctcctaaagaattctcagactcatgagaataccccaaattgaggaatattatcctagcatattaactacaatttacacaatttggtttggacatagagtgcattgtagctgttatatgcaagttggatgggtacatgagtcacaatctctgtattatgccattccttcaccagtgaaatcactttggtttacagtacccctttcaagaatgtaaacgctatacatgtcagaattttgtatcctaaaggcgtgcctctgtggctagatctgattctggaactgtcattgatatgacaatccaatccttcacactcttgatggaggtgagagtggattcttgaaccctgtgctatctaacagtgtttttactgaactatcaagggtttttactgaacttctttctattcattccttaaccttctggaagacttagagtacataatccatttgatttccttttttctcccctctatctatttttgcctgaggctatagttcgaggattaatactaatgaagacctttctggaagtgcaagagagccttagtgatataactactgatttttcagtctggtcgcacttcaggaaaataactatggtcagtcaaaaagctgaaattttccaaaaggaattttgatgagaaactaaggggaactgttaatagagcaaggcaggttctgcagagccctgacttgtggccccagcgtggctaaagtccagcctcagaatgacccagttggttgttttcaagcaaactttccttccccacttcttcctgcccgcagcgcatgctaaccagtgtggctaccgaacgtttgagatgtgtttcatgtgactgagagaccgagctcttaattctgtttaattttaatcatttaaattcagccagctgcagccagtggctactccactgtacagtgcagttatagaacataaactgaaggaaattttacttttaaaagctaagtctattttattgtttaaaaaatgcacacttagataattctccagtctctggtatttctcaatataaaactgttttttcaaacctttggtttcttgatcatcttgtaacaccaggccaatgtacatttatttccatctgcaattgtttattgcattttttgaaataaagtcatttaatttttcatcaacagaatcagcagaatctgccaaaataggaggaataattactgtgtttttgatagcattggtcttgacaagcaccatagtgacactgaaatggattggttatatatgcttaagaaatagcctccccaaagtcttggtaggtagtttttttgttttgttttgttttttctatctttgttttttattttaacttaagaatttgtatttatataaatattttcacagaagaaaatctcattttctataaacaccaaaatgctttctcactctgagttcttttccatatctataaatgtatattttgcagggtttttgttttgtttttgtttttattatacttttaagttttagggtacatgtgcacagtgtgcaggttagttacatatatatacatgtgcagttgtaagtgtatctgtgcatctgtgcattttatgttttctttcctttttttttttttttttttttgagacagtctcactctgtcacccaggctggagtacagtggcgtgatctcagctgactgtaacctctgcctcctaggctcaagcaattctcgtgcctcagcctctcaagtagctgggactacaggcgtgtgctaccacacctggctaatttttgcatttttagtagagatggggttttgctatgttggccaggctggtcttgaactcctgacttcaagtgatccacctgccttggcctcccaaagttctgggattacaggtgtgagccactgcactcagcaatgttttgttttgttttgtttttatacttcatcacataatttataatgatcaggtagaatttcattattattaacataccatttttcatttaaccatttctcagctaaagggcatttggatttcttttccttttcttttctttggtgatgatgaatagtacaataaacatttttatatggatcgtctttttgttttggattatgtcagtggaacatatacacaaagtggatttatcctataaaaagatttaaaaaggactaggcacagtggctcacgcctgtaatctcagcactttgggaggctgaggcgggtggatcatttgagcccaggagtttgagaccagcctgggcaatataaggaaaccttgtcttagagaaaataaaaataaattagccaggcatgctggcacatgcctgtggtctcagctactcaggaggatgtggtgagaggattgcttgagcccaggaggtggaggctgcagtgagctgtgattgcgccactgcactccagcctcggttacagagtgagaccctagctctaaaaatatataaatatcttaaaaatataaagaagcagccaaaggagaggaagttaagaggagtaagtcagaacatagtctatgtggccagcagcctgcctggtttgaaaggcagctgctcccactcactagtcacaaaccttgagcaagtttcttaacttctgcacctcattttctcatctgtaaagtgggcataagaatagtaagcctggccaggcgcggtggccacgcctataaacccagcacttcgggaggccaaggcaggtagatcacgaggtcgggagttcaagaccagcctggccaacatggtgaaaccccttctctactaaaaatacaaaaatttgccgggcatagtggcgggcgcctgtaatcccagctactcaggaggctgaggcagagaattgcttgaacctgggaggtggaggttgcagtgagccaagaccgcactactgcactccagcctgggcaacagagcgagactcccgtctcaaaaaaaaaaaaaaaaaaaaatagtaagcatacctcatagagcagttgcaagggaaaggtaaattatatataaagcaccaagagtcatgcccagcatatagtaagcatggtgtaactgttagctgttattattgctgtcatcatcatcaactgcatcatcattcaatctcattaagtttattttttatttttttagaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagtacagctga

SEQ ID NO: 1761 - DNA, 34590 bp, Homo sapiens
gcccgcgcttccgtatcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaaggtaacgcagcgtggcggggtcgcgggagcggagcgcgtggccagctgactggagggaaaacgccgcctccctgcagcggttcccggaatcccctccggttccctctcgctctccccgactcctcctcctcctcctgccctccctctgcgtcttgagtatgcggctagtgcgcccttcctctctcccggggccgcacctgcgaccccaggacccctcccgggccctgtcctgcgccctccacgcgtcgcccctgctgggagtccgctttcgttgcacccctccgcgtcccaccccaccccaccaaggatgcccaggataccgggcatttgccactgcaagatgtgagtcgttgctaagtttgagggtcacattcctccaggtccaccccgccttgcaaaaccggctcaccagctgggtgctcaggttcgggatctccagcccgcccccttgaggtcccctgggattagcccccctcgacctgcgtcagggtcacagactgcagccggggctggagcggcctacacccctccggatccgctgcgtggaggcaggagggggaaggggcgaggggacgtggccgcggagacagaagggtgcaccctcccagggtcggagaggggagatactgggaagatactccgcgaatatggagaggcgatcggcacttgcatttcaaccctgagcaaatcaatccgttacacgcagtagcgagttgactccatcagcccgtttatttggttagcgatggttatattgactctgagtattcccacctcctttcttttaacatttttttttttatttccttgttttgtttagcaagaagtcttagaaacgaatatagcatgcttgggcgttgattcagtggtgagaagtgccggagctggctcagggagaggtggagtttcccatgtgtgctcactggcccaggggctaagtcccactgcttgccaaggtttctcagtatcctgtccacccaccccctatccacctgtgcaggcttgagggggtgagggggtagcagatactctatcaaaatctaccctaaggaaaatattcgataaacactcctagcaattagggcatagctgataaggcttgatctgtttgtcgcagaaaatgacttgaacttgtaagttctattgttcataaagttgttttccacaattttagataatcaaaaatgtacatgactcatttttcttacctattatttcctctaaagtttctcatgtatttattgaaaagttaaagaaaatctgattttggttcacataatttgacaatggtgatttgtctaaaagtcatttcaaaaagtagtatgaaaaggatcataaccctagaggtactgtcatagacgtgaaacatttattaaaatatatattccatggctcacacttgcacactcaaagccacattggactcattttttctgctacctttataaaccttcaaactgttcaagagtcaatggtatgtatcatcttccgttatcaatcatcatgttttgttttgtttggtttggtttggtttggtttggtttttgacaaagtctcgctctgtcgcgcaggctggagtgcagtggcactgtcttggctcactgcaacctccccctcctgggttcaagcgattcttctgcctcagcctcttgagtagctgagattacaggcgtgtgctactacgcctggctaattgtatttttagtagagatgggatttccactatgttacccagcctggtctggaacttctgacctcaaatgatccacctgctttggactcccaaagtgctagtattacaggctcaatcatcatgttttatcaaagctaaaacccaaactaaaatgccattgcttataagatgcactttcattttatgtaatgaagtaagaaaaaacactgtcaatcatgctatgccatgccaccagaatgaaagcattctgatttcagaaattctcaaatgttaaaagaaaatgggcattttataatttgtgaaatattagtgagttagagcagagcttgacggcactggccctgagggtccttcttcttcctttggaagaatgaaactgggggctatgcaattcagggaagaataaaggaaaaacaggtaattggcagaggaggttggctgacttagaggtatggaaaagacaaaacaaaggagggaaaaagagaggtatgtatgatggggaggagttcagagccactgaaaattttctctggccctaacaggaaaacgagttaccccacaagccagggttttatcatctggtacgtggagatatccatcagcattgtcattggttttcatttgtttgtttttaattctcaagtttaaaaaaaaatttaaaatttaaatgtgtctcaaccaccagaaactatagtgagatttctctgtaataaataggaaagaaggagactgatccagtccttgttaaaaaaaaaaaaaagaggaaactgaatcacaacatactttgcttttttcttttctcacaaaggaacagtgggccctttatgctgggtgaaggtgagtgagatgggggaaggttcactgggcaccaaccttctgggctagagaaattgcccaggctttacagaacaagctggaatcagataaagttgtggaaaggaagtcgaggtttcactctgccatatcagtaggaggtactaaagccaaactagtagcagcaaagtgaacagaaatggtaagggggaaaaataggaaaggaaagaacaacgtggattgcaagacgtcttactaaaaacaaagaattacacttggaacagaagaaattcattaccattgccttacactgtgcaacaacttgataaaaatataaatccaataaaacaaactcaaagatgagaaaattgtaaactggagatgaaaagggagattgcagacctaaaggaaaattgaagaccgtaaaaacatagtgacagaataaataagtcaggagaaagaacagaagcaatactgctgaaaataaaagtattttaatagaagaaagcccagtaaggaagcccagtaaattcaactgaaaagggacaaagattaagaagaaagaagctattatgaaagacaaaatacaatcaagaattgggaccactgaagtcccagatgtagagaagtcaacaaatgggacagaaaattcaaataaaaataagtccaaagaaagcttattgagatgaagaaaaaatggtctgtaggccaaaggaacatgccatgttccagaaaatgtcatgtgggaatacggaagcactacgatatcttaaactatttaaattcaaagaaaaagatttaggaatctaagaagaaaaagtaaaggagggaaaaacaaaatcaagctcgcctcagacttcagtgcagcactaaatgccagactatgatggttgtgaggaaacagttccaagggaaagaaacttttccgaggggcatattttttttccggaagaacaaagggaattcagcacccatgaaccgtttttggaaaaacaaaaacttgctgagtaataaaatccaggaaatagcaaattaagagataaatcaaaataaagaacttaagagtagagaaaggtaaaaagacttggtgagtatttattctatttaaatatagaagtaatacatctatagaaattgtgggtaagatagaatgcgattgttattaatctagacaaaaatatacagccaaaaaaaaaagaagtcagagaggaagatggaaggaaacatgagaataccaatattctcttctttcaaagaatggaatagtaaatatggtataaaattaaaagatgctatgtgaatatataatactgcaacttttaatatctttcataagttttatttaaaaccttagagggatatcataggaaattatactttcttatggacaaaaaaatttaaattttaacaactcctttgactttattttagtcttttcccaagtaacattaaacagaaacactgtgtgtgtgtgtgtgtgtgtgtgtgtgtgtgtgtgtgtgtttatgcatagaaagatctgtgggattatgttcgcctaatattaatgatagtaatagtttttacagaagaaaaaagaaagatgtttgaaaaataagctagaatcaaatatgccaagatgttaacaattgttgatgctggatggtaggaataaggatgagtgttactttcttatttgtactttttcatatttttctaatttccagaaaaagatatgtaattgtttttgtctaacatttctgaatccacttcattcattattcattgcctccttgacaatgtgcatcagtctatgtcaaacagaaggaaagacacagccatactttaccaggagactatgaggcagcgagttcctggagggttgtttgtctgtctaggaggagttggaattcaaagaatcacttcactcaatccatccattttatctgggccttgaaaattggcagggtttgtctggtctcagggtgaatagcaggtagagctcttctttcagaatggagaaggccacagtgtcacagggtgaacctgtgacaaaattggggttcagcctgggaagccacatgagttgttggcttcgcacaggatggaattaaagagcaagctgacagaattaagtgaaagcaagtttattaagaaagtcaaggaatgaaagggtggctactccataggcagagcagcagcatgggctgctccactaagtatacttatggttatttcttgatcatatgctaaacaagtggtggattattcataagttgtctgcaaaaggggtgggagttctggaactgagggttcctcacttttttcgatgatatagggtaacttctgcatgttgccatggcatttgtaaactgtggtggcactggtgggagtttcctttagcatgctaatatattgtaattagcatatgataagcagtgaggacagttttgtcaccatcttggttttggcaggctttggccagcttctttactgcgtcctgtcttatcagcagggtctttgtgacctcctgttttatcacataactaagaatgcctaaccccctgggaatgcagcccagcaggtctcagcctcattttacccagctgctactcaagatggagtcactctggttccaacacctctgacaagagcagggggtgacctgtcacctggggctcagcaggacaataactctaggaaaaactggaaaggctgatagccttgaatttaacctaaggagcttggtgcattgtcaggcaacagtgagctacagactgagctcactacataattcacagggcccacccagagccaaataaaaatgcctgagaaagtaccactaaaggtactaaaatataaagccttttcttccacagtctctctctctcaacacgtaatgtttttttgtttgctatttaatatcattctaagtaaaaaaataggccgggcatggtggctaacgcctgtaatcccagcactttgggaggccaagtcaggtggatcatgaggtcaggagatcgagaccatcctggctaacactgtgaaaccccgtctctactaaaaatacaaaaaattagctgggtgtggtggcgggcgcctgtagtcccagctactctggaggctcaggcaggagaatggagtgaactcggaaggcggagcttgcagtgagccaaagtttgcgccactgcactccagcctgggggacagagtgagactctgtctcaaaaaataaaataaaataaaaaataaaaataaaaacttgaattattagcatgaatattgcagttctttatattatgcaaaaccagatttaaataagagcatttaattcatatatggaattgccaagttataccattagtactttacagcacatcttgggaggttcccttgaactagccagaagaagcaaactgaagccagacagaggaagattgcaaagaggaagagagggtctccaccaggcacagagccacccaagggagccctccctcaggctcagggataccgagggagccagagcagattcacacaggtccctggggcccctctgccctggtgactctaggatgcatgtacttgcacctgacttctaggcatccccctcctgctagcttcccctcgatccagcctggggcaggctctgtggaagtcaagccttgcatctccctttcccaagcacctaccatcctaacccacagtgtagtggccacgtccaagggtctttacgtctctgcctcagatatgctaggtacctgggtcaagagtgacccagagactcatccctgccagacccaacctccagccagtcaccctctgactccagtccatggggcgaggctggagtgctggccctgacctctccagcatctgcaccaggagggcttcagcggaatgtggtcccagttgatgccccatgccaacagtagcagcagcagttgttaggcatagagattgaagccagacagggcctgggattcctctgctgggagcctaaactgcaggagatggggaaggatccaagtgtgagctggggctcctagcacaaaactcacattgaaagataaaatggttaagaatttcaggatagccacaggagaacctcaagccaagtgtaggatccttctagctgcagggcctgggggtactgagactagccctgttgacaggagccatgctttaggaagactgatctatttgtagtcagcaagagttttaaggagctccattaacaatttaggcacgatgccaagatgggatattatattttccaagcaagaagaatctggtaatcaggcatatggttccaagtgaagtataagtcaccagaaagcaaggaaggaagccatcccctggcccagagggggagaatggggtgtgtgtgtgtgtgtgtgtgtgtgtgtgtgttttctcggctgctgaagagactgagtgttcctgcagatatataacaaagatgaagatgtgccaccgttggagacaaatggggaccagaggccacatgtcagaggtcaggtcaggtgttcaaatataaaggggttgccctggctgggcatggtggctcacatccataatccaagccctttgtggggctgaggccggaggatcacttgagcccaagagttcaagaccagcctggacaacatagcaaagccccatctctaaaaaaaaaaatacaaaaattagccaggtgtagtggcaaatgcctgtagtcccagctacttgggaggctgaggtgggagaatcgcttgagcccaggaggcagaggttgcagtgagccgagatcacaccactgcactccagcctgggtgacagagtgagaccctgtctcaaaaaataaagaagttgcccttctacaatctggatgtggtggtatctaggggaatgttcacaactaggcaacgcctctgctgtggattgattatgggagatgacatcacacatcaagatatctcagcagatgtttctcaatgggtacagtattatgggattagttccaggcagtcgtgcttggatatctcatgggtggtggagtctgtagcaaggctggaaattttgacttggaatcacttggatttctctaagagaataccccaggttggatgtgttactgtggcagcagagaagacttaaaaattacattgtttttagcttgaacttcgtcttgtgaagtcctaattagggaagaggagtcaggctgggggtctaggggaaagcaaagagataaagcagataagccataggtctaccttgcttcatggtccaggacatacaaacaaaaagaagaagcagataagctataggtctgcctttctttatggcccaggacatacgaccctcctgcacacataactcacaatcttcctgcgtatcatcaaatgcttcaacttatcatcaaacatctcggctgaccgaaaaatgcaagttagctccctgctaccttggcgttgtcagtcctccacatagcactcttcagcttaaattgcattttataaaatccccagcaagcctttgtctcctggcagtcaactcgtctcttactgacctgcccattgctcccttgcaatgtattttcctactttctctaataaatctgcctttcttgacctaaactgtcatggtaaattcttcttactcctatgtcaccagccacagacagtcgccacaagccatgacaagtctgcgatttcatggtctttttttattttgatgatatttccccagtgtttgggggacagaagaatgcccacaatctataggtcttagtcacatggatggggacagaatatctgagagagagagaaggaacaagatctactggggctccttaaaattcttcttgaagaactcctttctcaccttggagtagggaagactttctgattatgactcaaaatttagaagctaagaaagaaaatacctttaaatctgaaaacataaaactcaaaaacttctgggtgtttttttgggggggttgttttttttaaacagcacaagcaactcaaagggcaagtgacaaactggggagagaagaaaaagatgtgactcatatcacagtttcccttctacttaaaaaaaaaaaaaactgcaaaccagtaagaaaatagcaacagctcaacagaaaaattgccaaaggcacgaacagttaatgagaaggagatgcaaatcgctcttaaacctatgaaaagatgaaggtgttccatcacaaagagtaagagaaatacaaattaatattaatgtgaaagacaacttttcatttatgaatttgagaaaaatccaagaacttgatgatatacctctaagaagcaacggtagggaaacgaaaattctcacacattgcaggtggttatgtaaattggtatagccccgcgggtggtcagtgtgacagtttctatccaaattacagatgcatagtttcattgccaggtctcttctgtctgcttcttcagacccaccctcccctctccccactgtttagttggcccaggaccctgtctggtaaggatacaactccaggccccttgccctatggcttctggttgtgttcagccgatggggagccccaaataagagaaggaagggacaccgtgagtgatatttatccctcagcttcctgcctgcactgtcctcttggtctggctgtgtccagtggtctcatgtcatagctgctcatacaggagtttctccttacaaattgcaatgttggcttctcttccccctccggcccagagtgattacagccatcaatgttgtgagctacaggttctataccctcccttctgcaggcccagaatggtaacagccctcaatgttgtgagctgcaggttctgtactctccctcctggggcccagagtggtcacagccctcaatgttgtgagctacaggttctatactctcctttctgcaggcccagagtggtgacagccctcaatgttgtgagctacagctctcaatgttgtgagctacaggttctataccctccattctgcagacccagaatgttacagccctcaatgttgtgatctgcaggttctgtactctccctcctggggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctggagtctcccttctgggccccagagtggtcacaggcctcaatgttgtgagctgcagattctatactctcccttctggtttgcctacagccctctcacacatttgtaaatatagtcctgcaacccctaatgatgtcttgggcaaagatggaccttttatatgacgatagccccataagattataccatatttctactgtaccttttctgtgtctaaatatgttcagatacacaaatgccactgtgttgcaactgcttacagtattcagcacagtaccatgctgcacagatttatagcctaggaacaatagtctataccatataacctagatgtgtagttggctatgctatctaggtttgtctaagtatactctgatgttcatacaacaaaatagcctaacaatgaatttctcagaacacagcactgttcacagttgcaaagatatggaatcaacctaagtatccatcaacaaatgattggataaagaaaatgtggctaggtgtggtgctcacatctgtaatcccagcactttgggaggccaaggcgagaatccaggagtttgagatcagcctgggcaacatagtgagaccctatctctacaaaaaaaaggtttttttaattagccggtgtgtgatgacacatacctgtagtctcagctacttagggggacaggtgggaggattgcttgagcctgggaggttgaggctgcagtgagccatgattgcaccactggcactccaggctaggcaacacagcaagacccgtctcaaaaaaaaaaaaaagttacatatatatacacacagtatattcagccataaaaaagaatgaaatcgtgtttttgcagcaacatggatggaactggaggccattatcttaagagaaacaactcagaaacagtcaataccacatgttcttataagtgggagctattaataaaaaatgtgcacacattgacatatatataatgtggaatgatagtcattactgactgagaagggtggattgggtgtggggagttaaggaatgagaaattacttaatgggtataatgtatactattcaggtgatggatacactaaaagcccaaatttcaccactatgcaatatatctatctaacaaaactgcacttgtaccccttaaatttatttttttaaaaagcgtgtatcctaatttgaatgagctgtttcttgccagaaccctaactgatatgtcctttgtctagcaattctacttctggaaattttcccacacttaaactggcacatgtgcaaaatgaaagagatttccttgcagaagagactggaaataattcaaatgtctatagtaggggtactaattatataaataatggtgtgtctatagagtagaactgtatccagctatttaaaaaacaaggatagaaagatcttccaaacatatttttaagtggaaaaagcagggtggaacagggactatacatgctatctcttgtctaaaagatggggaaattaggaatatgtatttgtttttgcttatgcatgaagatactctgaaggattcacaaaagaaaaaaaagttttctaaagggagcaagacttttcacaattttttttttgaatgcttaaaattgttgaacccaacgactgttgcctgttcaaaagttaaatttaaaattcctcccagactaggtaggggattgggcccagaagctgagaccaggctcacttgaataaatggggtaaatgactaggaattttactattccttacaggtctctcattatcttgtctttgctcccatttttatatttgcagtttaattagacacttcagaattttgatcacctaatgttgatttcagatgtaaaagtcaagagaagactctaaaaatagcaaagatgcttttgagccagaatgccttcatcttcagatcacttaatttggttctcatgggtaagtgctgctttttatcttagctcttatagaagcaagctgtgatgccatcctcactgagagcactggcaggaagtcgcaaactcatttccctgactagaggacccagtaccaccctgcctagtgtcaggagttaagtggaaagcaaataggaaacctacactagtagtttagattcaatgtagattcctgtcctgttgttaattttaggaaaacaaatgagtgacttaaggcaataataatcaggactatcctcgccataatttgaagagtaatttctcctaacacgctttcttcctccccaatctttgataaatgtcttttacctctaaagttgattaattagcaacatgcttattcatattctgtgaatatttctaggatggacaattgcctctgaggacattccctcagccagcccaagtacttaaacaaaaacaaggaaattctttgatgttaaagatctcgtgtgtgtccgggcgcggtggctcgcgcctgtaatccctgcactttgggaggccgaggcaggtggatcatgaggtcaggagatcgagaccatcctggctaacatggtgaaaccccgtctctactaaaaaatacaaaaaattaggcgggcgtggtggcgggcgcctgtagtcccagctacttgggaggctgaggcaggagaatggcatgaacctgggaggcggagcttgcagtgagccgagatcgagccgctgcactccagcctgacagagcaagactctgtctcaaaaaaaaaaaaaaaaaaaatctcgtgtgcgtgtgtgtgtgtgtgtgtgtgtgtgtgtgtgtgtgtgtgtgtgtgttttgaggcatagtttcactctgttgcccaggctggagtgcagggtgtgagctcagctcactgcagcctccacctcctgggttcaagcgattctcctgccttagcctcccaagtagacgggattacaggcacccgccaccatgcccggctaatttttgtatttttagtagagacaaggtttcaccatgttggccatgctggtctcacattgctgacctcaagtgatccaccgccttggcctcccagaatgctggggttacaggtatgagccactgtgtccagccattttttttttttttagacagagtctccctctgtcacccaggctggaatgcagtgagcgatctcacctcactgcagcctccgcctcctgggttcgagctattctcctgccttagcctcccaagtagttgggactgcaggtgtgcaccaccacacccagctaattttttgtatttttagtagagacagggttttgccgtgttggccaggctgatctcgaatcctgaccttgtgtgatccacccacctcggcctcccaaagtgctgggattacagacgtgagccacgacgcccggccccagatatatttttaagtggaaaaagcagggcagaacagggaccgtacatattgttgttagtgtcagctcccaaatggatcttattttatctcagatcacagtccttgcaccatgtgctgctggcaccaatgtagagtaaaaaccatctatgtgggcatttttttggcacaagaaaaatctcaatctgataccaataaatgtgtgttaaagaatgtcagacttagagtaatcattgcaagttgagcccagataaaactattgcctctctaatgtgttttcttccttctagtgtatatcagcctcgtgtttggtatttcatatgattcgcctggtaagagatgttttttggcttcactaaattttgtataagagtgaaagtgttggggcaaccattcagaggtataaaatgtgggagatttgatttctgattgtacatctgttgcctgttttattgggattctttctctgtaaaaggagctaaaatgagctaactctggttttttgagagatacaaaactagtctaagaaatgaacactagagatcatttttaaacttctttaaagaatattcaaactcttaataatctcactaataaaagaatgaggagacacagactgtgccaaataaaaaatggcccagaaatatttactctttaatttacattcttccaccctgatgattccagacaaaggacaataatttttttttaactaaacttcttcctacgtatataaatctgtccacaaaacttcactaagtattaaatatgtgtccaaccttgtgctaagtgttggttgggggtgaagagttggcagttgagaaacaaaggcctgagtcctaaccacaggaaacttcagtgatctttaaaaatttaaccgtataaggcagaatttggcaagtctggctttaatgtctcatttatcactgccacttcccacctacatgacattgtataattcaactcagtttcacagtctgtaaaatgaatcttttcatagtgcctacttcagcattgttgtggggcttaaatgcttagaaagggccagtctgggctcatgttatactcccctgctctctgtgatccagggaataagtgagctggggaatccagaggaaggaaaatttgcagcgggctgagctacttaaggaggacttcatggaggagctgggagcagagttgagagaacggcttggggagggagaatgggtaggggagagtgaaaggaagtgcatcatgtgggctgggatggcctgggttattttggtccagtgaaccatggagggacagtccaagggcatcggagaagcccttctgtccagactctccttacacagtgcacagtccctgtttcccatgcttgcctgccctgacaatatgttgctcgttaattgacttactaatttatttcccatgtcctgtagacttcctgttttcaagacaccagggctctctggagaggttatctgccagaggtgtgggttctagatcccaagaaatgactgaacagtggccagaatacaactgtgggttccaaatttcaatgccctttttcttcttctctttagattacacagatgaatcttgcactttcaagatatcattgcgaaatttccggtccatcttatcatgggaattaaaaaaccactccattgtaccaactcactatacattgctgtatacaatcatgaggttggtttgatatttcattttctcttggtaaacatattattgttctgttatatggggagaggtgatcttttctctctctctgtctctccctctcccttttcctatctacctctccttctctctgcgtttcttattcagagccttaaaaagccaaagacaaaacaccatcacacatccatttttaattcagttgaatactttaataatccaaatctattttgacaaagcttgtatgtgtcatcaaagccaatttctacaggtcagaacctcacatacaaaataattcttgtgtatgggttaggcaatgatttctctaattcagtcagtctgaatgtttaaaagtcctgttatctgaggacaggaatccaaaggtctattgaccatattgatggtttatgttcacttttctttactctggtgggacaccagaaagctgcctggcctagtctgggacaggcctgggtccatagtctggtttggtcactaaccagcttgacacttggcacggacctcagcccctaagctaatgcctctgctgaggggttgctgcaaggattcgtgacataatggatggagtcctgcttgtcttttgtcttcccacacctaccaatcgcccttagaagtcattgctttgatccagcagccccttggagtgtccttttgatggttatttatttggcctagagctgctgctgctactgcttattgactgagccagtgggagacctcttgtgagtttctcttcggtgcctgctaaaaagtttttctctgcattgagtggtcacatgtatcatccaactaactgaagcttggtagatgagatatctgcattgtccctgaaatagcccaggtctgacttaggactggatcatctagtcttagccagagagggagggggtctcagggaaggcattcataattgtcccatagaggaagggagatctgaggcttccaccatgagggcccaagtttcattcattcatttactcatccggcaattttttttttttttttgagacggagtctcactgtgtcaccaaggctggagtgcactggtacgatcttggctcactgcaagctccacctcccgggttcacgccattctcctgcctcagcctcccaagtagctgggactacaggcgcccgccaccacgcccagctaattttttgtatttttagtagagacggggtttcaccatgttagccaggatggtctcaatctcctgacctcgtgatccgcccgccttggcctcccaaagtgctgggattacagacgtgagccactgcacccggctcctccggcaagttttactgagcacctactacatgccagggggtccaactgtgaaccaaagtccctgccctcctggagcagacattatgtaaatggagacatcagtaaacaaaggtataatgtgacaggtgtgggtaaatgctacaatcaagaaaagagagggattgaaagtgcaggggtggggagggcataagatgttccattttcaataagatggttggggaagatcacttaatacaatgatatttgggcagagccctaaaggaaacaatgaagtaaggcgcccaaaaatagactctcattacatcaatgctaacaatttcctttttccatttttttctttccaaagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacagtgagttttatctctgtttctccacttcgtccccatcatcaagatctttattatttgctattccatgaaataggaggtctacaaaggtgttttagacctggggctgggctcacctcttggccctgccacttcctagctctgtaaccgtggactgctttgcttctctgagccttggttttctaaatctgaaaagtggaatgataatttgtactttgcagatttgccccgtgcctgtataaggcagtaggaactgctgttttcggttttgcagcctgacaggaagtctggagccaggttcaggtgggctggatctagcgctctcatctctctggcccaggattttctttctttctttctttctttctttttttttttttttgagatggagtttcactctgtcacctaggctagagtgcagtggtgcgatcttcgctcactgcaacctccaccttccaggttcaagcgattctcccacctcagcctccagagtagctgggattacaagcacacaccaccatacctggctcattttttgtacttttagtagaaatgtttcaccatgttggccaggctagtctcgaactcctgacctcaagtgatccacccgcctcagcctgccaaggtgctgaggttacaagcatgagccaccacacctggccccagtgttttcttaatacagcaactccaccccctcattataacccaatgttcttttgtgtgtgaacaccaagtgtgcatgcacctagtacccaaagctcagaggagaagactagaccccaagaacaggcctaccccttctttctttccctgtgactcaagtcagttccctaacacactgtgttaacagccccagctgtgttactttttcaatttcccactttacaacgagtttccaagagaaccatctggtctcagcttcctgttgtaggctatgcgggtgtgcacgtgctcatacatgattagcaaagtggtaaggataactgaatccccctgtggcaaacaattcggatacgacatttgctggatttgtgtgcatgtttacgtatgtgtataaacagacatctgtgtgtacacacagaaaagaaagaaaatcagaatttatagttcatggtatttgggttgttaaagaatgcatattaaagtaacagtgagatatgtttcatggctcaaatgataaatatgaaaaatacataaatatccaggtttagagggaatacaaagagtgtgctttggcatggtccatctgaagtaattggcagcatgtattaaaaaccttaacatgtgcttactctaatccagaattctttagtaatttgtcccaaagaaattattaaggccaggcacagtggctcacacctgtaatcccagcactttgggaggcctagaccagtgtatcacttgagctcaggagttcaagaccagcccgagcaacatggggaaaccctatgtctacattaaaaaagaaagagagaaagaaagaaagttaggggggagggagggagggggggagagagagagagagaaagagaaaagaaagaaagaaattattaaggacaaatgcaaaaatttagttccaagaatatcccatgatacattaagtctttaataaaaatcagagacaatttaaatgttcaaaacagtgaatcagttaaatcatgatacagtcacttagtggaatagcattagcaatgaaaaattatgatgtaaatcaggacttggcagattttctatacagggccagagaagaaccactttagactttgtgggccacatatggtctctgtgacatattcctgtctgtttttgttttttgcacagtgtcttttgaaccaccagagtttgagattgttggttttaccaaccacattaatgtgatggtgaaatttccatctattgttgaggaagaattacagtttgatttatctctcgtcattgaagaacagtcagagggaattgttaagaaggtaagtggcttctcctgttaggatcaaaacagttctgagtgggcaatcaatgcacttgactgtctcttttgaaaggaaatttgcagttgaacaattaaagctaaaacgtcaggcttcagtatggtccgacttagggaagaagtcactatggttcattcactattgatctaaacctgcagcacagtgttctttaaaagaataagccacggctgggcctggtggctcacgcctataatcccagcactttgggaggccgaggcgggcagatcatctaaggtcaggagtttgagaccagcctggccaatatggtgaaaccccatctctactaaaaatacaaacattagctggatgtggtggcaggcatctgtaatcctagctactccggaggctgaggcaggataatcgcttgaacctaggaggcagaggttgcagtgagccgagatcgcaccattgtgttccagcctgggtgacagagcaagactccgtctcaaaaaaaaaaaaaaaaaaaaagagtaagccacatgcacaacatcaaggaacacacaggagagagggtgtgggagggagatgcagagtacagccaaatttcagtgaaccctggagagatttatttgaaaaggagagtttagctgagccacccgtgaaaagcatctgtcgctgcctctctggccctcacacacagtaaggaagtggcttatctggcaggttctgtcctctcctaatttctgcaaaggacctgactctcagtaacctcagggttatctggtatcagacagccctgcatcttcaatttttgttgtccctagccctccaaatgctggaataagtggaaatggacaaattgctctcaccggtgtagcagcagcttatgtctgtagagccctttgccaagtataaaacccttgcaagtgagaccagcctgagagataatcagggtagatgcatttcaggcggagggcacaggaagttcaaaggctctgaggctggagtgggcccggtgtatttcagcaacagcgaggagaggtggctgaactggagtgaccaggcaggagatgaagaggaggtgaggtcagagggtaaatgtggctggacctggtaggagtttgtgggtctgggtcttctgagtgtgatggaagcctgtggaacccaaggcttaacagagcatcctggctgggctgttaaaaatagaccacaggggcaaagatgggagttaggagaccaactaagacacaatccagggtggcagtcacttaagaggcagtaacaaattatatgattattatcatttttcttttaatatcgacatggattataatcagtactctaggaaaaggagcaaaaatgggtgaaaaataagtttatgtggcctaaggactatgtggagtgtcattaaatctgtttcaatcatgtctcgtttgtgttcaccccataagcaactaactctatgttttagattatgattcctaaaataagagactgttgcttattaggatattgactactctataagaggaaaaactgtagttaataggcatcttcttcataaggaaaattagcctttaaatccagaaaaaaaaataagctactagtataatctaagcaacagatggtggtggcttggaccttgatagtagaggggtaatgagtagtgagaggccatcaaattctgcatatattttgggttttgtttgtttgtttttgagatggagttttgctcttgttgcccaggctggactgaaatggcatgatcttggctcactgcaacctccgcctcccgggttcaagccattctcctgcctcagcctccctagtagctgggattacaggcacccgccagcacacccagataattttttgtatttttagtagagacagggtttcactgtgttggccaggctggtgttgaactcctgacctcaggcgatccacccacctcagcctcccaaagtgttgggattacaagcatgagccaccatgcccagctcataattctgcatatattttgcatgtggagcaagactaacttccccattaactatggaagatgatgaatgaagcaggtgagggttagatagggttagagggtttgggacatgttaaattccaggtgtccgtaaggaatctaggaggagacgtggggaaggagctggatgtgccagtctgttgtccaggagagaacccgcagctagagagagagcctgggagtcactggcttcttggtgcatgttgaatgccctaagaccagatgaggtcacctgggaatagacactcagagagaaaacaagacatccagtgacagagcccaggaacattccaaaatttggagatctggcaaatgaggaagaaacagcaaaatcgactgagaaagagcaaccagcatggtagggagagaagcaggtgagagtgatgtcccggtagctgagagaagaactttccagaaggtgaaagtggtctactgagtccagtgctgtaaatgggacaattgaagaggactgactattggatttagcaacattgtgtccttgataaaagtagttttaatagagttaggggcaaagagctggttggagtagattcaagaaagagtgggaggagaaaaattggagacagtgaagagagctcattcttccaaggaatttttccaaacagggaaggagattgtgtgctggccactggaggggaagcttttagtttgttgggtcgtaagtttgtttgtttactaactcctcctcccaaacagaaatttacagaaaaacatcattactgaaggctgtatttgagctgctaggaatcctcatttattaaactgctagtaagaatgtattttaaaaactgtaaaacatgatacaaaagttattattcatgaaagagccttcatatcatcttttaaattctgaagtgaaatgcaactacaggaaagaagaggcaaggtgtttaaagggagatggctgggcacagtggcttacgcctgtaatcccagcactttggaaggccaaggcaggcagatcgcttgcggtcaggagttcaagaccagcgtggccaacatggtgaaaccccatctctactaaaaatacaaaaattagccaggcatggtggcgggcatctgtaatcccagctactcaggagactgaggcaagagaatctcttgaacccaggaggtggaggttgcagtgagccaagatcatgccactgcactccagcctgggcaacagagtgagaccccatccatctatctatctatctatctatctatctatctatctatatctgtctattgataaagggagaagatgagaaactagacatcagtcagttttgtcacagacaagctctgtgaccttggagaagttacttagccacactgagctacagttttctcatccgttgaatggaggtaatgcctattttgcagactgttttgaaagtcaaaagggttaatgtttatgaaggcactttctcaagtgtaaagtagacacacactgtccatgagagaagataatcttgtaaaaatgacgtcacagagacttttattcctctttgaagacttttatctcatttgtaaaatgaaggcgctagactagatgtcatggttataaaatatgtgtgtgtgcaggtgtatattaaaagtgcatgtaggtgtagttttctgataaattacttgctccagatgacttataaatcctttttcttaccaagcctgtgataaatctaaccctgtttgagatttgaagacaaatcccaaaagagattaaggcctacctctaaatgaaattctcagtcttactgattttttgcttatgtttacagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcaggtatgttcatttttttaaattcatgttttgagtattcatgcttttactctgagggcaagcctatttaaagaaaagaatctgaaaagaattcatggagcactaaaggtctttcttccagtaaacacctcacagagatgttttctgttggttcgtgtgtatgatctggtagagtcacttttatattgtcataccaaaaaacaatcagatactactcgatgagatcagaaatcttgaaatggaaacgcttttgtttcagggagtcaggattaaattcagcactgtgtgccctttgtgtggccattgctgaagccaaatgccagaagaggtggagttgcttgagacagtggtatacagtggcattaaggggtgaaaaggtggaagcagcgaggttgggtgcagttcatggatgtgatctggcatcagctctcgctcatagatgaaaggaacccttgccagggtgtacgagaaaatcactgatgaaggctgaacacctttctgttacacagacatcagaacaataaacagtgtgatcccaaaccttcttcccctttggagtgagaacaatcaagcctcggaactccctgctgattgttttctcaggaagtagccaagtttccacctgttttaccaaaagtgagaagctatgcaagtctccctcaaagaagcccttctaaatgtcccaaccgcagtgttaggggaaagaggtcccaatccataccccaagagagggttcttggatcttgcgcaagaaagaattcagagcgagtccgtaaagtgaaagcaagtttattaggaaagtaaaggagtaaagaatgactactctatagacagagcagccccgagggctgctggttgcccatttttatgattatttcttgatgatatgctaaacaaggggtggattattcatgcctcccctttttagaccatgtagggtaacttcctcacattgccatggcatttgtaaactcatggtgctggtgagagtgtggcagtgaggacgaccatcttggttttggtgggttttggccggctttactgccatctgttttatcagcaaggtctttaccaacggtatcttgtgccaaccccctatctcatcctgtaagttacaatgcctagactgtctgggaatgcagcccagtaggtcccagccccattttacccagctcaagatggagttgctctggctcaaatgcctctgacaccaatggaagtatctttaatgttctgatttaccagaataaaaataaggtaggatctataaagaaattactttagttgtaaaccaaaataaaattctaagccccccaaccaactgaatggatccctcctctcagccaagggccgagtaaagtaaagtaaacctgaaacactagttcaggccatgatgggagtgagtggtccagacgtgcctcacgggaccttcctacctttggaattcaggcacagctggccagcactaatattaaaacagaaaccttaagactgacaaaaagatgctttgtagcactaataccagcatgatggatagcaggccctaaaagaaaccaaagtgttttaccccaaaatacatttctttgacatattttgaaatggccctgcaaagctgtctcttgcagggaaaatctgctttctataaagaacccccttcccagtccaggtgttcttcctgatccaagagagaattcactaagagtctggcacttttttaagtccagtaagaaacatttacagtctgttctctctgaagcctgctaccagaggcttcatctgcgtaataggaaccgtggcctccgcaaccctttgtcttaacccagatgcttccttttattaattccaagtttttaatcagaaaatctttgaatctacctatgacctggaagcccccccacttcgaattgtcccacctttccagattgaaccagtgtacatcttacatgcattgattgatgccttatgtctccctaaaatgtataaaaccaagctgcaccctgaccaagggttctcgggatctcctggggctgtgtcatgggccattggtcactcatatttgactcagactgaatctcttcaagtatgttactgactttggctcttttcattgacaaagtgatatggtcacttgtgaatgaagtgagccacggaacgttgcctggcacataacggtgctctgtgttggcttcactacagggcaatatgatttgattctctagtgttcctcaagaccagatgatgcacaggctggttctaaaggaaaaaacatgtcaaacacctttagcgtaagttatttttatgtcagcaaatacaggcaaacttaaaactgcatatagattctgactatagctctttcaaaaatataaatccaaaataaatgtgcatgtctttgttctaacaccagctatctgacactaactagttgtccaatgattccattcatttctgatactaccccaggttagcacagaccccacaggttaaaggctcagtcccacaaaactgcctgcccccacttcagatgccagccacaagtcatgggtgacaaggttccctgcacttccacctgacttggctacaaattcaggagttcccatgacctccctttaggtttgataatttgctaaaatgactcacagaactcaggaaagtgttatggcttatgattaccattttattataaaggaattgatggacagccattgaagaggtgcacaggacaaggtctgaaagggtcccaagtgcaggagcttctgtccctggggagtcaggtgtaccaccctctctgtacattcatctgttcatgaatttggggactccccaacccttggtgttcacagtttgtattgggtttcattatgtatgtgtgattgattaaattactggctgcaggattgaactcagtctccagcccactcccctccttggatagaggtcaaatgggggagctggaagttccaaccgtctgatcatgtggttagtttttctagggaccagccctcatcctgaagctatccacaccctgccccatcacctcacaagcataaactcatatgtggcccctaaaagaggcttgttaacaaaagacactcctaacgttcaggaaattccacaggtttttgaagctctgctccaggaactagggacaaagactggatatatatgtatattttattatatcattgattttacatacaaacgaaactcttatagacaataaaaactgaaattagtgacctggcagacagatggtggtttattgaaactcagtccccagttccaaggtgaatgtgttgctgatgagaaggcacaagctccttggaggttgatgaattctgtgatgactcactttctcccctgactcttttccatttcacctactaagatgttcatgtaacaacatcctctcaggtcattccatttttacttggcgtgaatgcgtcatgttgcacatcaagtcagccctcattctttgattattacccgagataggtcaagtaccgctctctttaattatccaaatactgtacctgatgtcaaattcttgtttgaaactcaggaagcaaataggttcagataacgtggcctctgtcactatctgcttgccatctgacgtgccctcaaccagccaaactcagaaaccagacaggtttggatggtgaggggtcttggaaggatagcctgagaccagcattaacataggctcagcagtaagcactgtgacccaatcctagggcagactgatatggggggattttagcccagacatctggagaaacaccttccccttgtcaagccttaaaactaatggtttgtctcttttattaatattaaggccctaaggaaaagctctattcattcatttgacaaatgtttattgggggcctgttatgagccagattcttttctggatattgaggatttagcagtgaacaaaacagattaaaaacttctcaccttgtggagcttacattgcagtaggagacagaataacaagatcaacatgtaaaatagacagtatgttaagtaagtaccatggaaaaaaattatgcgggaaaggaggtgagggggatgtcaggttgaggagagcaggttgctgtttttaataggatagtgtcttgatttgcatttgctagaagcagagcctgggatgtgaattcatattcaagtgtgatttattggtgggggcatcttaggagaaggggaaagagggaacaggtaggtacagggagagagaaattaagcaggcatgtggctctcagctgagcctgatcccaaggggttctcggaagcgtgaactgtatcctcaagtcagcagccagtcagttactggtggtgatctatggcatggcctccagatgaggcagcccccttttgggcaagggcagttccttatgtgtccggagttggttcctgccaatgggttcgtggtctcgctgacttcaagaatggagccgcagaccttcctggtgagcgttaacagctcttaaagatggcacagacccaaagagtgagcagtagcatggtttattgtgaagagcgaaaggacaaagctttcacaccctggaaggggacctgagcgggttgccactgctggctggaggtggccagcttttattcccttattgtcccttcccgtgttcgtttctgtcctatcagagtgcccttttttcagtcctcctcgtgattggctacttttaggatcctgctgattggtgcattttacagagcgctgattggtgcgttttagagtgctgattggtgcgttttacagaatgctgacttgtgcattttacaatcctcttgtgagacaggaaagtccctgattggtgcgttttacaatcctcttgtaagacaagaaagttccctaagtcctcactccacccaggaagtccagctggcctcacctttcacttagagaaggatcagctctgagagatatcagcagacacgtgcggcagcagtagtgggtgtgcactgactggaaaaggggacatgggcaggccacccacagcatccaccacagatggccacagatggccttcctgagaaggtagcatttgaataaagacccaagggagatgtggtaagcagaataatggcccccaaagatgtctacatcctaatcccagatatgtgaacaggctaacctctatgccaaaggggcttgtgggtgtgatgaaattgaagatcttggccaggcgcagtggctcatgcctgtaattccagcactttggggggccgagccaggtgaatcacctgaggtcaggagttcgagttcagcctagccaacgtggtaaaaccccatctctactaaaaatacaaaaattagccaggcgtggtggcatgcgtctggagtcccagctacttgggaggctgaggcaggagaatctcttgaacccgggaggtgggggttgcagtgagccaagatggtaccactgtactccagcctgagctacagagcaagactgtgtctcaacaaaaagagaagcaggagactcagaggcagagaaggagctctcacagcagcagcagaggtcgcagagtgaggatgaaggagggggccatgagcaaaggaatgcaagtggcctctagaagctgggaaaggcaaagaaatgggttttcccctagagcctccataaggagttcagtcctgccaacatcttgatattttttatcccagtgaaacccattttggatttctgatctccagaactattaatataatatatttatattgttttatgacactaactttgcatcatttgttacggtggcaatgggaaacaaacacaaggtgagggagtgagtcacgcaaacctatcaggggaaggagttccatatgcggggttcagcaagtgccaagtgcccgaggcaggatatgcctggcacggcacggcaggagtgaactgaacaagggaagaatagtaacagttctggtcagaaaagatggaggagcctgaatgacatagaacttagaagccgttgcaagagatggggaccctcagagggttgtgagcaggttgctctccgtgatctgacgtgggatgtaaagggaacatccatccacatgccttgaagtgggagccaggtgacccctgggctgattactgcagtcacccaggggagaggcggtcttacttgttccagagaggtaagtacgggaggaactataagagactgatgttagtcatcgccagtcttttcataaagttctttatcttttccattaaagatcattgtgatcagatattaccaaccccgttgctcagttcagccctctgcttgtgaggtttcttattttttgcttaaaatatctccacagtgaatccagagacagacaggtttgtccaaggccaaatttttaagacacgacctggtctctccttcccaagatgggttgatctggtccatctttcatgaagaagatagttaacagcagtaacattcaatcacagcttctcctttctgagtcagaacattgatgggattcatctcttttcaaatatgaatatttaaaaatagcatgcatgtataattgtcatgaccccaagtgagatttctattttttagattatcatcaagctgaaaacaaacaaaaattctaagttctcctaaagaattctcagactcatgagaataccccaaattgaggaatattatcctagcatattaactacaatttacacaatttggtttggacatagagtgcattgtagctgttatatgcaagttggatgggtacatgagtcacaatctctgtattatgccattccttcaccagtgaaatcactttggtttacagtacccctttcaagaatgtaaacgctatacatgtcagaattttgtatcctaaaggcgtgcctctgtggctagatctgattctggaactgtcattgatatgacaatccaatccttcacactcttgatggaggtgagagtggattcttgaaccctgtgctatctaacagtgtttttactgaactatcaagggtttttactgaacttctttctattcattccttaaccttctggaagacttagagtacataatccatttgatttccttttttctcccctctatctatttttgcctgaggctatagttcgaggattaatactaatgaagacctttctggaagtgcaagagagccttagtgatataactactgatttttcagtctggtcgcacttcaggaaaataactatggtcagtcaaaaagctgaaattttccaaaaggaattttgatgagaaactaaggggaactgttaatagagcaaggcaggttctgcagagccctgacttgtggccccagcgtggctaaagtccagcctcagaatgacccagttggttgttttcaagcaaactttccttccccacttcttcctgcccgcagcgcatgctaaccagtgtggctaccgaacgtttgagatgtgtttcatgtgactgagagaccgagctcttaattctgtttaattttaatcatttaaattcagccagctgcagccagtggctactccactgtacagtgcagttatagaacataaactgaaggaaattttacttttaaaagctaagtctattttattgtttaaaaaatgcacacttagataattctccagtctctggtatttctcaatataaaactgttttttcaaacctttggtttcttgatcatcttgtaacaccaggccaatgtacatttatttccatctgcaattgtttattgcattttttgaaataaagtcatttaatttttcatcaacagaatcagcagaatctgccaaaataggaggaataattactgtgtttttgatagcattggtcttgacaagcaccatagtgacactgaaatggattggttatatatgcttaagaaatagcctccccaaagtcttggtaggtagtttttttgttttgttttgttttttctatctttgttttttattttaacttaagaatttgtatttatataaatattttcacagaagaaaatctcattttctataaacaccaaaatgctttctcactctgagttcttttccatatctataaatgtatattttgcagggtttttgttttgtttttgtttttattatacttttaagttttagggtacatgtgcacagtgtgcaggttagttacatatatatacatgtgcagttgtaagtgtatctgtgcatctgtgcattttatgttttctttcctttttttttttttttttttttgagacagtctcactctgtcacccaggctggagtacagtggcgtgatctcagctgactgtaacctctgcctcctaggctcaagcaattctcgtgcctcagcctctcaagtagctgggactacaggcgtgtgctaccacacctggctaatttttgcatttttagtagagatggggttttgctatgttggccaggctggtcttgaactcctgacttcaagtgatccacctgccttggcctcccaaagttctgggattacaggtgtgagccactgcactcagcaatgttttgttttgttttgtttttatacttcatcacataatttataatgatcaggtagaatttcattattattaacataccatttttcatttaaccatttctcagctaaagggcatttggatttcttttccttttcttttctttggtgatgatgaatagtacaataaacatttttatatggatcgtctttttgttttggattatgtcagtggaacatatacacaaagtggatttatcctataaaaagatttaaaaaggactaggcacagtggctcacgcctgtaatctcagcactttgggaggctgaggcgggtggatcatttgagcccaggagtttgagaccagcctgggcaatataaggaaaccttgtcttagagaaaataaaaataaattagccaggcatgctggcacatgcctgtggtctcagctactcaggaggatgtggtgagaggattgcttgagcccaggaggtggaggctgcagtgagctgtgattgcgccactgcactccagcctcggttacagagtgagaccctagctctaaaaatatataaatatcttaaaaatataaagaagcagccaaaggagaggaagttaagaggagtaagtcagaacatagtctatgtggccagcagcctgcctggtttgaaaggcagctgctcccactcactagtcacaaaccttgagcaagtttcttaacttctgcacctcattttctcatctgtaaagtgggcataagaatagtaagcctggccaggcgcggtggccacgcctataaacccagcacttcgggaggccaaggcaggtagatcacgaggtcgggagttcaagaccagcctggccaacatggtgaaaccccttctctactaaaaatacaaaaatttgccgggcatagtggcgggcgcctgtaatcccagctactcaggaggctgaggcagagaattgcttgaacctgggaggtggaggttgcagtgagccaagaccgcactactgcactccagcctgggcaacagagcgagactcccgtctcaaaaaaaaaaaaaaaaaaaaatagtaagcatacctcatagagcagttgcaagggaaaggtaaattatatataaagcaccaagagtcatgcccagcatatagtaagcatggtgtaactgttagctgttattattgctgtcatcatcatcaactgcatcatcattcaatctcattaagtttattttttatttttttagaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagtacagctgatacggactctctctctctttttttttttttttaagaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttttgagacagagtctcgttctgtcgcccaagctggagcgcaatggtgtgatcttggctcactgcaacatccgcctcccaggttcaagtgattctcctgcctcagcctccctcgcaagtagctgggattacaggcgcctgccaccatgcctagcaaatttttgtatttttagtagagacaggattttaccatgttggccaggctggtctcaaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaa

SEQ ID NO: 1762 - DNA, 32832 bp, Homo sapiens; identical to SEQ ID NO: 1760

SEQ ID NO: 1763 - DNA, 4972 bp, Homo sapiens
gttgtgaacttacactttattcatatatattagatattgataattttaacaaatgagttactttccatttgggtacagtcacagttgtcaacaatatttggaagcaccaggcatgaaatctcctgagatgctatgttttcatcagggtcacctgacacattcaagttctgtctgacatgccattaaagcactggctcagattgcaggcatattttcaaaccggcagtaactggatagtatcacttcacttataagtgttcattgtatcatcaagtgaaataaacacacaacccatgggatcttgcttaggttggctgcctagttggcccctgagataaagccttgtaatcacatagccttgcctaattagtcagaaaacaaaggattaagtgagacagtcacaggatataggaattataaataatacatatattaatagatattcattttcattacacaaaagttgctattataaatacttatttgattgatgagtctaaaaatatattccccatataaataatgttaaatattaataaatagatttagatttaaaattcaaatattgcaggcaggacaaccattactgggatgctcttcgacctcgaaacagcatctgactcctttttcgcttccctgttttagctgctggcgacagttcagccatcacttggatgagttcatgtattgctttgcgttggacattcaagtcagttacctatcgggaaagaaaagagcaaaattaatttcaggcatataagccatcaggatattctgctaatgtcatgatggtcagtgaaaataaaagtattcctttaaaaaatggaccgtattaccttaatatacaatatttacttcttcagcagttgaagctaaaaattacaattacatttctagttgtgctataatgtggtggagtccatcacatatctttaaatctacttctatagaattcttgaaattatatagtgaaaagactcctggttgtggagtcagcataaaaaggtgggtttgaatctcatgcatgcaataattctgaccttgagccagctacttaacctctctgaacttctattttctcatctaaaggaggatgagactgtttctatgacctctctatcatcaatctaccaattatatcactttatacttcagtctttcctgtatgcatcaaatgagtaactataggtcaatgattctcactgttgtgcatagcagattaatccggaaacctgtcaaagacctcagagatccaggtgcatgaagtggaaggactgtgccctgtgcattcactaagctccccaggtgattctgacatccacctaagtttgagaaccactgatctaggttaggtaccctagaaaacaccaaatccaaaacgagtgaaaactgtaatttttaatttctcccagattaggtcagtctctcaatttccataatagattttaaaataaacacccccaatcatatttatatatggcttactgatatataaagtttaaaattaagaattgcaacaacttttccagtaccctgccttctaggcaagcaaattgaactacttgcatctcctcactctaaccaatagggccatttagatgatgcttcataaaatgtggaccatttaccttcctcttggctctgccattacattttttctaatcttgggaacactatggctactcaccacatttctgaggatggctgggggattacagctaaagactaattgtcaaagggcataacatgcataaaatagcttagcaactgagccaaagagaataataattaatagagctcactcaagattgcccatcaagaaacaggaggtttgtagcttccagaaggaagaaaccacagattttttttcatttttttaaggcccagttcctgcagagtagaaaaaattttcgacaagctgtgtgtttgcaagtgacagattttactttccaatgttcaaatcatcaccaagaaactaagagacttatccaggactgaacagtaagccaggggcaccactggattagaaacaagtgctgagtgtctagtttataaccaaaggagacctgttgccatgtctctcctttctgtttctgggggcttacatgagaggagtgagaggcaggcccagcaatagtgaaagctgagcacatatcctaagaacacaaatgctagcttgaagaccctggtccctctcatttgagcccatttatatcaaagtcaaccccaaaggaatctagaggcctttgtcttctagaaaacattttgaaaaacatgatttgtctttatgcctcaacgttatctttctgtttatagaagccataacttaaagatacaagttcatgaggtaagacttaggagtctaaggagttctccagctgagatattctgaaagttgatagagagttgatagaacaatcttttcataaggtataaattctatctatttttccctaaaaacaaacaaacagcaaccattcttgcttctaattgggcagtacaatctgataggttggctagagacttgcagtggggtgtccctggtacctattcaaagactgtagctttcttctatctcattctcattttctattctttgcattgtagagttttggagcaaagaaggtcatcaaacttatacagtgagcctaacagtttccttttaagatgaggaaactgagccccagccagccatgtgattcatcacagttccttggtggctgagttgggaggagaacacacatcttctcagctcctcccactgctctttccattaagacagacagcctctcattcaaagtaagagaatttccatcatatgagcaagggacaatgagagaactgcttctcagtactccccgcttcttcctcacctacttcctcttcactggatttgtcaactcacctgtctttacgcaatagttacaatgccagcatttctctacattacatacttcagcgattctcttactggctttgcaaagtcacccaaacacgaatggaaatagtaaggtagagtttcagccatgagttgagttcatagctttagcaactgttaaatagctaatgtctactttctggagaataaatgctttgcaagaccctcggcaatgaaaccaaagaaagaatttaaatagcctcaccgaataattagtcagcttttcgaagtcatctcgtttctttttgttgctattgaaaaacttgacattcatgtcttccttgatggtctccacactcttttggatgctctggtcatctttaaagtttttaaaaagtttgaagtaaaaggagacaatttggctctgcattatttttctgtcactctccttggaaggaaagagcacaaacagaggatgatgtgaatttatccatcagaaagcaagcaacaggaaaattagccaaatgggaatattcagcttacctctttccaattcttcaaaatgcctaagaaaagagttccattatccgctacatctgaatgacctgcattctaaaaaaaaaaaaagaaaaaattggtttacaattagcccataaattgccttaaaaatatatttcaagtttcattgaactcagatgtgacaatattcactgatttccttttcaactcttctgcttagttctaacaataagtattcccaaaaggcttatgtgagatatagacaaagactattatgttcttttagcttttttatttcccaatataaccattaaattgcaatgtcacaaatgagctcaacaaagctgatactccaaaggtcccaaaaactatagtaagctaaagaaagtattttcaagctaggctaaaaaatacaaaaacaaaaaacagcaaagccaccccactataaaatactgccccccaatggtacaggtttctattacatctactgtgccttcctgtagggtattattatacgagctttaaaagatagttccaaacatgtgcgagtgtgtgtgtgtgtgtgtgtgtgtgtgtgatttgattttgtgttgtaagaataaaatcaattgtgaatgtctgaatattattatgacagctataattataacagctaagttttaaacaaataatgaaatatttaaaatgtaaaaacttttcattaaccatcaataaaattttaaaagaaactcaaaaaattcacttaaaatttttaaacattccttagccagaatcataattcttccaaaatcccagtgagcaacgaagttccggaatacttcacaagtaatatagatagagaagcagaatgttgaaatcactttttggagaaaatcacctatcagttatttttttaagccaaagctttaaggacctttttgactttaatttgtaaacatttcctattacctttttaatgctaatcttgaccttagagtctgagaagtcaaaaactaataaccaatcatttttttcaatctgcatactccttgactatcacaactgaatgagttcccaccacaaaattattaacatcattatgcttcatacccatattatgcccatcttttggaaaattcataaatcccttttaagtctctatacaaactgagcagaaggttaaaacaatatctagattatttagtcaaggaactcatctagtcaataattaacaaaataacaccaaatctcaaaatgactgcctacaagagatgacagcctatcagagatgctacagcaagtcgatattcagtcattttcaaccacaaacaagtactattaaaaagtcatacttacaaaatatttcttaaggttttctgcttcttttacatatgggtcctggcagtaacagccaagagaacccaaaacgatgcagagctgaaaagccaagatataacttgtatatttcatcgtttccgagagaattaagccaaagaagttgaaatcagtagttcttgtatcaagctgatcaggtccaaaggacttaactgatctttctcttctaatagctgatcttcagatgatcagaacaatgtg

SEQ ID NO: 1764 - DNA, 21947 bp, Homo sapiens
cgagttttaaaattctttatttaaaaatctctaactgtaatgtttcataaaaaatatacacgtttctatttacatattccattaattctattagtttgaattagattttaagtccaattttgaaaagcttgcagaatttcttctgaaattacttaaaattactgtatgcataaacttacaaaaacatatgctataccaaggcagagaaaagaaaaaaagtgaagtggctacaaaggtccctggggcatcacctgctcacctaggaaccaggagtactggatactgttccgttactggtaacctatctggatgtaaaggttcataagttacaatgctttttttgtttaaaaaaaaaaaaaagtctgtactttacaagccaaaagtgaaaatgccacacatcctctttacgctttcatgtacactaagtcactccatttggttgataccaactaagatacaatttctgagatcataatcttttcatgaaattaaagcagaaaactgtccaggaaaatcagacttcaaagttggtgcaacttagctgatctcatgaaaattctttggaatcttctgttggtctataaccaatcaaggactctttaccgctatcatccacaagtagatccactagcacatgtggtttatcataaccaaaggaggtgggggcttttattacggttatgagctcttgtccttctgtttttatttcacctttattatttgggggaaattctgagtcagataaggagctatgtgattccagacagctggaatcagtatcaaaaccatttctggagtgatcactctcagaacaatttctggagtgatacgagtttaaagcgatgctgccaggttcagactggttactacttaaaggtgaagaactctctctctctattggagtcagatggctgcccgggaccacgtcaggaatattttcttcagtagtcaccacttctgttatactagaaagttcttctgtatgttccacttttcctggattgtcttcggtatgcatgcctggaactgttgctggagacaacggctcttcacagaccacctccttttctaaggaaaatggctggtatgacgtgatgagtgatacatattttgattcaggttttgtctctaaagtagcacttcttaccacagagatctatggggagaaaaattgattaaagataaaaaattgttaagcttaagtgcctaccctcaaaaaaaacaaaggtctgaagtaatggaccaccaaatggcacatttaggataatgggtgaatcagatgttgccatttctttttaatgaaaggtcccatagtaatattaaaaacaaagttttagaatttttaaaaagccatcagatatcttactaatatatgttgctttttgtacgttactgtgatggttaatactgagtgtcaacttgattggactgaaggatacaaagtattgatcctgggtgtgtctgtgagggtgctgccaaaggagattaacatttgagtcagtgggctgggaaaggaagacccgcccttaacccgaatgggcacaatctaatcagctgccagcatggctagaatgtaagcaggcagaaaaatgtgaaaagagagactggcctagcctcccagcctacatctttctcccatgctgaatgcttcctgcccttgaacatcggactctgaattcttcaagtttggagcttggactggctctccttgctcctcagcctgcagatggcctattgtgggacctctgatcgtgtgagttaatactaaataatactaaataaactcccctttatatatatatatatgaaaaatataattaatatatattatataatatataatttataatatataatatataatttataatttataatatattatataaaatataatttatattacataaaatatataatttataatatattatataaacatataatttataatataatatataaaatatataacttatattatataaaatatataatttataatatattatataaaatatataatttataatatattatatataatatataatatatattatataacatataaaatatatataatatataatatataaaatatagatttatataaaggggagtttatttggtattatatatatatctttatatatatattccattagttctgtccctctagagaatcctaatacaattatcttccacatgtacgcacattatgtttacaaagtgggcacatctacttaagtaatattctcattacttgccttcatcattataatttttagtagctcatattatttctttatactgataaataatttaatagatggggaaatgtttccaatttttactagctatggaacatgttaaatatcctgtacatctttttatttatgaaattatttccttataatacattttttaagagtggagtgaccatatcaaagaaatggtatgtttacgtcactattacactgaatacccactgtgtgcttttattcttaccagggctagattacttttcaccagcatttacccgttatgctactgctggtactactggatatccaggtttcttttttcttctctagcgcgtgtaaaatggcatactgcaaggttactttgtgcttaattactagtaagaataaaatattataattcatttgtgagttgactactaactgttgagagttcttatccactttaaaggtagtttatagcaaattttaatgtgccctttgagcatcacagatattattcctgtcatatttgactcaaatagatactattctgttacctttaaatgttctttacatcaaaggctttgaaatgttggacattaaaatcgtcaaactcctacgttagtctcatttttggccaactttcctttcatactccaaccataatgaagtgtttctgtatttgcagagctttcaaagtcatgctttcttggctctggacctcagcacattctgtcccctagtgcctaaactcctgtatgtccctcaagactgctcaggcattgcctctggaaaagccatgactaaccccaccccaaagctggacaaagtcctcatgggctcaggtataaatctttgaatctatcacacgttatatagccaatgtatatttatcttttcttccccctagactttaagatctttaacagaattgtctcaccgtgtttttccctgagaataaaaaaaaaaacaaaatacttgctgcacagcaaaagacacagtatgtgattttgcatgtgtggtagactgactgattgatggcaggtgacatcttgttgaatatcattctactttaaaaacataatttaagaaactatcaaaaaaggttcaagttaactttttagtgtatataaaaaaattaaatacattaccaaggacttgggtaatattatgcttttttccttcaatggattaattttcttaatataaaaacagatgaataccaggctaagcactagaaagagtagtaaagcagcaacaactggaatccaaagagaaccttaaaaaaggcagaaatcacaagttacaattaagatggaatactgctattatctatcaaaaagtcttagtgccattcttgaatagatttacaaattagtgaatagggccagagttttaaagaacactgaaggaagcagaagttaggaaatctgagtaaaaaattaggtatctgtcttagatagcaatatggttcttcccagctctgcaattctagaactttctgggactattctactatgacacaacatagttaaaatagcttttctacaataatttccttacagccctacatacagtgtgtttccagggttatgcatttctttcggttaaaaatgcaaaagaataattttaaaaatacctctccttagaaacaaattctggcagctgggcacagtggctcaagcctgtaatcccagcactttgggaagtcgaggtgggcggatcacgaggtcaagagatcgagacaatcttggccaacatggtgaaaccccatctctactaaaaatacaaaaattagctgggtgtggtggcatgcgcctgtagtcccagctacgtgggaggctgaggcaggagaatcgcttggacctgggaagtggaggtagcagtgagctgagattgtgccactggactccagcctggtgacagagcgagactccatttcaaaacaaaacaaaacaacaaaaaaaaaaagaaagaaattctggcaatgtttattgctcttaagatgatttagccccactcctcagaatttcctgttacatttatttcacgactgcaaatacttataaagcttcacagatgtacatgcacacagcaatgctgcacaggaataaagtccccttagttataaaccagacataaataatataaaataggaaagatttgtttccaagcacatacatctagaatcaccattgtgtactttgctgtaatgctgccttttatttttgcagcacaatcttcagtattttttttttttcatagttctctcttccaaattaacagcactctaacatactgtgacaatgtccggcatcctttagggcattttgttacccagaattttctaactatggaagttactaatgaatgcttctattacgcttattacagggtgtgaaaaaagttaaatcattacaaaagtaaaaaggaaaataactacaaaaccaacattagtgctgttagaagtcccacgggctgagcaagtgctggctgcaaggcattgaggcaagcaggcagggctgctgctcaggagccacggcaatgccaccgtgtggccatactatcagtgcagtgtataattcaggctaaaaacaaatctgcggcatttgcattatttcaaattttgagcattaagaagggttttatttttcaaatagcataacgaaaattagcataaaatgcattgcactgctttaaatcacctatttgaaaccttcatataatggcttgaagttattagtattgaattttaggtgtttgttctggctcttcagcctatatttccattcctcgaaaatatacttgcatcataaaattttaaacctatgaaatctattctaaaaaaatcctaaggaaaaaaatatatgtatacacacacacacacacacacacacacacacacacacacacacaaagataatcatcaaagcatgagttacaatatatgcttaaagcaatacacaaaatcatatatactatacaatatgatcatgtctatgtagaaaaactaaagaaaatatcaaactgtgaataatggggtatttttgcatggtagaactacagattattttgttttcttctggtttttcatattttataaattatctataatgaacacttacatttcctaactgcaaagaaaagtccaaacttctttaaggttcctgacacctgagagtaacagttctaaagttcaagttctagcatatatatctctacctccccaccccccacattaaaagatgaaataaaattaattattgtaaaatgttataaaaatgacccattatctattattcaaacccatctataaacttttttggatattaatctcgagtctttgtccagtccacgtcatacagttgtaaccagtgatcgttcctgctcttcagtctttaaattacaatccccataaagaacattttagtggattcacaacatcttgctatggtgaagtaacaaactgacttataattcataatcctgaaatgcaaacatttgtgtagttttatgtacttattatatattttttctttcctgggtcaaggggccatcacatggctttccaaattagttgttctatatctttaaatgtgtgagaaactgctttatttttaattttgaacttctctaaggaatggaactaatgcaaatgaatattgttaaaacagatcttttgaaactgcaaatgagtttgctttcctcacatgatcctattttagttactgctccctctatatttagaaaaaaaatggcaagaacttaccttttatactgctattgaaaatggtaatacaaacttcttttgacttttcagttgtaacaccccacacatgtaagactccttctgctgaaacacagtactgagaattcagtgaggatactggaatcgctaactggcactgaatctcgtcacaatcatcttccttctgcgtgagtattttatactggatctagatgaaaaaagaaaacagtgaaaatgcacagcttcttttaatctgaaaaaaaaaaaaaatcaccatattagtcctggtcaaacaactgaagaaatatatatgattgacttgaacatgtctaaaaatagctttactatcaataagtcaatttgttacttcaacacagcacgatactatgcatctgttatattccttataaaaatggtaaatttaaaaactcaaattgcaggaatgtttattgttagttgttaaactaacaaatgttcatttgtcctattcatttgtccagaaatttagctggtgggaaacagaagtattaatattactttacgtcaccgccaatgaggaagaaaatcctcattttaccagtggagcaatggaggtgtactgggaaaaatcctagattagagccattctgctaaatgaagcaaataaaaactaaatgtattcacatggtcagtgttagtgactaactctgtatcatttttgctttaatagcattcacatatttttcttatcaaatctatgatctgtgagtcttgcttgaatatttataagcatcctattttcattacactacagaaaggaacaacttttgctagctacacaagaatttccattatgaaaaatgtgaaacacatacctcacttccgttcattctcacatacacattgtacaccctaatgtaacaggtagtttcgggatcataatcgacttcctgctcgtctccatttacaaaaactgaagggtgaaatatgtcaatcatgatttgcttctcctcctttctgatatccagtttaggtggtccaatttttcctggggaaggaggaggaggaagtataataaatactggccttggaactaaatggtacatttcataaaattaccagaatctatcaatcaacctattgtttttgttctggttgttctaaagcaggaccacatttaaaccactccacaaatatctagaagatagtctcggggtccttaataaacaaatgtttcataaatctcaggcaagaagtactcttatttaatctgaatgcctatttagcagtttaatttcatttctagttgtaaataaaaatagttataaactttggttaaaaaaagacttcacataatatagactctattaagtaatttttcctttatctttgcttctgtggattaagaagcctggattctaaaaaacgtttcagaaatggcattagttttcttccctcatcaaaactctttttactgtgaaaaatcagaacttattccataaatatttattaggtctttgatgtttgagactttgttgtgaaccatttatctagtcttcacatattactgtgtaccactgtgtgccaggcaggtctgtttttaacccatcagtgtatcctcagggcccagtatactttccggcacgtagtaggcccttgataaatctatatggaaaaaaatctaacatgcagatggtgtggtaatcatatgacaaaattgtggactctggggaagaaaagtatttaaagggtaaggagaggaagagcctgtagaagagaccgaggtggcacaatctaaaaggcaggagcagagaaaggaagtgaggctagagggaaagggacccaagggctagaagactagggaggagtcaagtgactaaaggtgtcttttacccaggagtcagggtctgagagctaaggcaggatgtcatagttggaatacaggaactggaattaaagattcaagagtttgaggtgacagcaaacatcaggtacactatgggagtgggatgctggaagactgaagacctgaaaatcacagtggctgaagagaataaggaactctgcaattttttaatgtattaaggtggtattcaggttccccaggcattcagaataagagttagctgccaaagtccttagtgaatataacttacaaatgaatgacaaaagatgggaagggcaagggtggtgcaggggaccgctgggcagcacagacccataattgtatgaagtggaaatgtcatggcatagaagcagctaagtgatggccacctgttagccctattttgtggggcttgaaagaaggggaggatacaggttgagtatcccatatccaaaacgcttgagatcagtagtattttcggtttctgagtttttttttctggattctggaatatttacattatatttaccagttgaacattctaaatctgaacatccaaaatgctccaatgagtatttcctttgagtgccatgctggcgctcaaaaagtttcagattttggagcattctgggtttctagacttgggatgctcaacctgtactgactctaaattcctccaagtgtttcttaagcattgtgataattttcagcaactgctaataaaagcaaacatacagaagacatgtataaatattttccaatttaaaatttacatgtgtacacattctactcaccatctcggcatacagcaaattcttctgactttgcataggcagattctttttgtccaaccctggctttaactctgacccaaagagaatttgatggatcaccaacatgatcagaaatattacaataatgatgagaaatattgatgcaggcatcaatccattctgaattcttaacactaaaaagaataaaaaaatgcgaagataacttttattgttattaaataaactcaaaccatttctgtctgtgctttgctttttattcacagcacaaagcggtagaaagagcagagctaagaataggatggagacgccagagaaagtaggaaacccttactctttagttagaagaactacaaactctgttacagtaaagaggctcaattcaaaatgtaagacctatgcaagccacattccacattcaattttttaaaaatctgtttttttaaacaactctaaattccatttatatatgttaattatagaagtaagcacattaaaaaaactaacagttgtcaaaaaagttttttgaaatttatattgttctactaaaaatacactacaggaagatgacatagtaactattagctttatttgtcatgctaatctcagaagtttagtgatacttctctatttcaatactgataaggaagaggaaataagaggcaagaaatatttggcaaagaatttgcatctttagtacttttggacctctataagcagtttagaatgttttgccacgtgggaaggctgatgaaagaacacagttgtggaatttccaaggacctaaacaaaaatggaataaaaaggataaataaaagagtgacactcacccatagttctttacctctacggtaaaaacagggacctgtggcatgatctggtactcccaatatacgatagggttcatgttataggattcaattgtaacattagttggtgtaggcactgtaagaaaataaaaaagtaaaagggacaattgtaagaaactaacattaatattggaaagccttattgtaagatgccacattgcccagatatgtatatttgaagaaaagtagaattcaccaggataccaaaattatttaaatgaagagtagacatctagaaattaattttattgaaaaatctatagaagagttctgattcgttttaaattatggaaacatcattgcaatataaaggaaacacaaatacagcatgaagcaataaattcccttaatatgatagaagttttataatcaaatgcactgattattgaattaataatcctcatttcatcactagaattttcaatatttgatactacagattgtattcaatgttgatagggtttggctgtgtccccacccaaatctcaacttgaactgtatctcccagaattcccatgtgttgtggcttggacccagggagaggtaattgaatcatgggggccagtctttcctgtgctattttcgtgatagtgaataagtctcatgagatatgatgggtttattggggcttctgctttttgcttcgtcctcattttctcttgctgccaccatgtaagaagtgcctttctcccccgccatgattctgaggcctctccaaccatgtggaactgtaagttcaattaaacatctttttcttcccagtcttgggcatgtctttatcagcagcatgaaaaaggactaatacagtaaattggtaccagcagagtggggcattgctgaaaagatacaagaaaatgtggaagcaactttggaacagggtaacaggcagagactggaacagtttggagggctcagaagaaataggaaaatgtttggaactttacttaagagacttgttgaatggctttgcccaaaatgctgatagcaatatggacaataaaatccaggctgaggtggtctcagtggaggtgaggaacttgctgggaactggagcaaaggtgactcttgctatgttttagcaaagagactggcggcattttgcccctgccccagagatttgtggaactctgaacttgagagagatgatttagggtatctggtggaagaaattactaagtggcatagcattcaagaagtgacttgcgtgctgttaaaggcattcagttttataagggaagcagagcataaaagtttggaaaatttgcagcctgactatgagacagaaaagaaaaacccattttctggggagaaattcaagctggctgcagaaatgtgcataagtagcaagaagcctaatgttaatccccaaggccatcgagaaaatgtctccaggccatgtcagagacattcacgccagcgcttcccatcacaggcccggaggcctaggaggaaaaagtggttttgtggccaggcccagggtccccgtgctgtgtgcagcctagggacttggtgccttgcgtcccagctgctccagctgtgactgaaagaggccaacatatagctcaggctgtggcttcggagggtggaagtcacaagccttggcagcttccacatggtgttgagcctatgggtgtgcagaagtcaagaattgagatttgggaacctctgcttagatttcagaagatgtatggaaatgcctggatgcccaggcaaaagtttgctgcaggggcagggccctcatggagaacctctgctaggccagtgtggaaggaaaatgtgaggtcggagccctcacacaagtccctactggggcactgcctggtagagctgtgagaagagggccaccatcctccagactccagaatggtagatctgctgacaacttctggaaaagctgcagacatttgatggcagcctgtgaaagcagctgagagggagcctgtaccctgcaaagccacaggggcagagctgctcaagaccatgggaagccacctcttacatccgcatgacctggatgtgagacctggagtcaaaggagatcatttcggagctttaagatttgactgccccactggattatggacttgcatgggctctataactcctttgttttggccaatttctcccatttggaatggctgtatttacccaatacctgtacccacactgtatctaggaagtaactagcttgcttttgattttacaggctcacaggcagaaaggacttgccttgtctcagatgggactttggaatgtggacttttgggttaatgctgaaatgagttaagactttgggagactgtttggaaggcatgattggttttgaaatgtaaggacatgagatttggaggggccaggggtagcataatatggtttggttgtgtgtccccaccgaaatctcaacttgaattgtatctcttggaattcccacgtgttatgagagggacctgggggaagtaattgaatcacgggggctggtctttcccatgctagtctcgtgatagtgagtaagtctcacgagatctgatgggtttatcaggggtttctgcttttgcttcttcctcatttttctcttgccgccaccatgtaagaagtgcctttcgcccttgctgtgattctgaggcctccccagccatgtggaactgtaagtccaatcaaacatctttttcttcccagccttgggtatgtctttatcagcagcacgaaaacagactaatacaaatgtctacagaggaactggctacaatgaggatggccaatttcactctaaaataccatcaacctctcaactctacacatactactatttatgccttccacactttttctatagtacaggaatagatacctaaagattgaacaatggagccacacattccagtttcatcaacactctgctctctggggtgtgcagggctttttacaaaacatacccaacatttcttcttgccttcactctttcagaaaacatctgttgataagacttgagtcacgtaagagaacagacagaagtcattttaacatctaatcagacactaccaaaatctagttattaaaagtagtcatgggccaggtgcggtggcccacacctgtaatcccagcattttgggaggctgaggtgggaggatctgttgagctcaggagttggagaccctgtctccgcaaataattaaaaaattagccaggtgaagaggcctgtgcctgtagtttcagctactcgggaggctgaggaagattgcttgagcccaggaggtcaaggctgcagtgagctgtgactgtgccactgcattcagttctcttagaaaaaaaaaaaaaggagtcatttttccccactgtttggtgtaaaaggttgttatccaacaccccttggaaaactgaacacacacacttctcctttctcccttcacttctttacagataaacatgaatgtacacagttagcgatgtgaccccaaatttatggttattcaatctcacctccctggaacactctattaaacatgatttacttatataactaaaacaaataaatgaatgtccatgtggataggaacagtggcttccaaacataacttataatcatcctcaaaaattgtgagagggacagaagtttctatttttccaaagtgccttggatgataatgatgatgatttatatttatatcaagcagactgcttaaataagaaaaatactccctaggtcaaacattaataaatttgggttctttcttggccacactgctaaatacttcagatttcctgatctgtcatgaggtgttactttcatatccctaagatatttgcttactgctgaagggaaaatctatattttccccaaacaaaaattccaatattcaagaccaaactggtatattgccttaatttacaattatttaacacatatattttcaaagcagaacatggattaagagttttttaggtaaataataggcactaatggacaattaaatgctatcaccattattattttccttttctgattattttttcctttattgcagtggttctctgtgggaagtgattttgttgccaggagacattaggcaatcaatgtctgtagacatttttggctctcacaacctggagaagaagtgtgtgggggaggtactgctggcatctagagggcagagaccaagggtgctgctaaatatcctacaatgcatcagacagcctccacaacaaaaaataatatagccccaaatgccagcagtgccaaggttgagaaaccctgctttatgtttacaatttaagtgttctttaaaaaaaaagttgaggaaaaactaacttaaaaacagaatgctttacagtaaacctgtatatttcatggctcccctcaaacaaatgaatagatttggttattgccaaaagatctaacttctatattatttaccaaaatggtgtaataatttgggccaaaaggttgagattatcaagctggggagggtctgaagattcaaatacttcatactactaacttgacctttttgtggccagtgaccagacacctaggttttctccttctgcttccagaggcgcagctgaaggctcttggtacctgccatctctggttctctaagcaacttccttgtaggtgatccctaaggcactgttcttgccagagtagccttggctctttgttttttgtagagttcccatggccattcatagcaggggatactgaggcttccttaagagggtcttttttctatcacacgtttgcatctcaacctcctgaaacaactcaaatacttcacaatccatattttaggtagaaataaaagtcattcctcttcacctgggttcaatcaacattaatatcaaataacaatcacacatataaatatactttttcaaccggaaaacagaggtacttgatgctaagaaaactcatactaaatctgagccttccttcggagaccatttcttcattttggcatttttttgcctctcgagaggctgagaattttcaaaccaggtggtcctggtttctttttaacagttcttcccatgattgagcaaagtctcacctgttactataagacgcaagaagaaaccaggtggcactttcagcactctggttagaaacctcctgagctagatcacacagctcctcagacattctctacttttggtgtcactgaaggctacagtgtcactcagctttctgccactacatagcaaggaccccccttcctctaggtttccaagactggaaatcctttgcttccttttaagctccactcccctccttttgagacagagtcttgctctgttgcccaggttggagtgcaatggcatgatctctgctcactgcaacctctgcctcctgggttcaaacgattctcctgcctcagcctcccgagtagctgagattacaggtttgcaccaccagacatggctaatttttgtatttttagtagagatggggtttcaccatgttggtcaggctggtctcaaactcccaacctcatgaatcgcccacctgggcctcccaaagtgctgagattacaggtgtgagccaccgggcccagcctaaggctctctttttaattatacccagtaggaatggctttataatggtatacgctcaacctgaaattcctgtgagaaaaaggcatatagaagtcaatctgcatactagaatatcaaacaaagtgcatttgtacttaggaaggggctactgaatcacacaatggaaaactacaaacaggagtaggcttgtgcagcattagattagtttttaacgtgaatcaaagtatgtttcctataatttaagtaaaagcctgatatggttagactaggacaaggacttaaatcatagctttcaaagcaagacagacaggtggtaggaggaaaatatttcaatggtttatagcaaaaagaaattactactaggttaaaagaaaaacttataaatttacaccaaaagatgtaatctgtggtttttaatgctaccagaggagaaactgtgtggttattagacatctgcctttgttttgccaaatattattttttgccaaatattatttgccaaaataatatgacagacataagcagttttcttaagcttcagaattttgtaatgtgaggtttaaattgttatatattcagattaaattaattaaggcttacaattaacttctaatacatttacactatgtaaataaaaatatatgtagaaacagcaaaagagtattattatctctggggcttaagaaaagatcttaccagagtgatttcatgaaataagataatcttacagattttcccatctcttgaaaatgccaagatagttttgtgtaactcatgttgcttttggaaatggactcagaattatttagtgtattacatctgcatactatccggagtaaactttagctattttaagatctaattcccagaactcccctacaactcacagctgataatttaagaaaactaaacacaggagagaagaatttgtttttcctaacactttaattacaatgcagaaaaaaaaaggagggccctggttaaagccaactgtttcctcagaaagctgataagccagaagagacaggatatgaaaaaagagagacaacacaaaagaccagtgaagatcagcaggtgatacagagcagtgctatcgacgggaccataacaatgtcacaaaggaccaaaaaatagcagtcgtgatagctctgcaataaatgttggtgaatgtagggtggatggcaaactacagatacctgcagagtatagtctgaagacactggccatttcctctgcatagctgggtgacaggaaccagggctgctacctgagtccatcctgtaaccaccaaaagcatctgtgtctctttaaaaaaggacagcccgaggagttcatcacccatcttaacacactagtgtaaaaagactgtataaaaggtttgtacatctatggtggaacagggctatggactctgcagaaatcatctgacaacctgctcaccaacctcttcatgggaagagcacgctgagaagcataaggaagtgaggatgaagtaaactgttgttctggattctaagtcatctgacactacaactcaaaaacaaatgtttcaaattaaagcatctggatcttttccttaagaacaactctcagagaagatctaacaccttccccatgttaaagatacagggacaggaatggggactgtcacaaaggtttcatctgcacagcaaacagaaccagcataagaaatccacactgaataaatgaaaagtaccaaatcaaggcctttgtatttttgtcagaacatatttgattacaatctccctcccgaatggcttccagtggtgataaaatgactatttttcttaatgctttccaactttcaccgtagcaaggagccgcatcccccaggtttaagctgagtacagacattttgataattcttgcaggtgatgtttcaagtgttcattgaaatcttctaattgaaatttttctttttaaagagccaggcataacacatagtggcctgcagtgaacttgtaagtaactaacctcccctatatttttccctcgcaccaccaccaagttggggcttatccaataaatatctgctcagccacttttctgacttgaaatccagggctttattcttactcctatttatccaatttcatctagttgggtttggtctggcattagttctgactggaccagaccaatctagtccctgagagaagtcatttctcaacactaattctcttttggactaactcattctgaattgaaaaacagttgaggaaatgaaaaaacaatgcaggcctttccagtctactaaaaaaccaaacttttttgtctgttggaagagatggaagaatgagttagctgctgagcctgttttaagtttctcatactgatctggttaagtttgtttttttaaaagccaacacaatttctcacatatgactaagggaatttaatatttaaagatatatttgttaaaataataatgcacattattgaataatccctaacatattaagtatttactacaagacacacagtgtgcttacctttttaatgcattacctcagatactcatcacatccatcccgtgagggagacaatgttaccatacatattttaccaatgagaaaacaaaggcttagagaagttacgtaacttgacaatatgcaaagttttgttggttttcattaagaaaaatgcttccaacatctttgtgatcgtttaataaaataaggggtaaattacctccatatttaaattggaattggagaagactattttctggtgacttcaaaagcatctgcttcaggtaatgtttcctgattttattacattatcacaattatattatggccactgcaaaagttgaacaatgcattaaaatgaataatttcttaaaaatacacaagacctaaacagatacctagtattctgattactatgcattaggataatctaaaataaaggcacccctttaataagaaaattacaagtaaattcctttctgttaggaattcacttcattctggttcaaacctcattctgattctttgttcaatcaaaattgaaccattaattactcatctggtttgtaaagcaacttcactactggtatgctgccaaattttgtaagatagctgtttattacttttctttaggttttcatacacaaacacacacacacacacaaacacacacacaaacacgagagacagagtcttgctctgttgcccaagctggagtgcagtggtacaatcatggctcactgcagcctagacctcctgggctcaagtgatcctcctacctcagcctccccagtagctaggactacaggcacatgccaccacacagggttaatttttgtatttttttgtagagatgggttttgccatgttgcccaggctggtcttgaacttctgggctccagtgatccttccgccgatgtgctgggattacaggcatgagccactgcccccagcctaggttttcttttagatagaaccaaaatatggtcctttcaaagtctgtgtgaattatgaatcagaataaaatgaaaaagaaaatttaataccctattcaataaatataattaaaaagtattatcctgtgtattttgaatctctgaaataactatagaatccaaagaaatagtgaaaaatttaaacagtactcagagctttatcctaaagtcagataattagtaggaagcatagctgataaactgtacaaggtcagtgaagagccttccagttggtgtgaagtccagcctagctcttcagctattactcagagtgggacactcatctggatgaagaaagccagtggcacaccctgattcacttaaaaatatatactacttttatgtgtaaaagtgcatgaagagtgaaatactactgattaagtggcacacacagattttattttcacttaagaagtattaatgaaagcccatgaatgtaacacaatacattcctaaacacctggatttcctggagactgactatatcaccatattcacttgtctgcttccctgttcttaccaggtcctctcatctaagatgaacttcaactatagagtcaagcccagcaacagtaagaataaggctgggaagctaagcaagagccagagcattgttggtttcttcctactttggagattttgtgttttaaattaactttaaaagaacagggaacacaacaaaatctagagaaatgcactgaaaaatctagagaaatgtgttagaaatgcactttaaaaagagggctcactgaaactaatgaaaagcaaggccggggtgcttgtctcttctaggggagtcaggaaaggcttcacaaaagtgaccccagttttagaacgagaggtacagagacaaattcaaaagtttctgcagaatatagaaggctgcagttgatcttcccacgggaggcagacaggcaatcctcctcccagagcaagctacaaggacgtgcaaattgtgcactcacaggggtcacacggtgcactcatagggccccgtattcagaaggaagggcctggcacttgctttaacgctatgcctgcgctagcgttatcctctttctctgctgacatccagtcagaggcctactaactcttccttctaaatgttctgctaactgtcctcttctccacttaaactacttatcgactccaacttaagcagcagcctcctaatgggccttgtgtttaccctcaaactattttataagatgactggtctttctaaatggcatgtctgatcctgcataaaatcatttccctttgtaattgataatccaatgatgtcagcattagtaaataatgactgacttcagcaaggcatagtgggtgtattattttgttggctcaacacctgtacttcaggcacgccattccgcttcttctggtaacccaacccaaccctctacgagaatgtccttcccatgcaagctggcacctgaacctagctgggcaaatcagagcctttccctggcattttgttagaatggaggaggctgcaagatgtcaaaactcagaagctgtcagcatccatgattcctgccaagtgtggaaagctgtcaatacccagacagaaataagaaatggagagtcctagcagtttgggttcctggttctagcctcttgagacccagctggcatctataattttctgtttaactctggtttttctgagacaataaattcctctttttgcttaagttaataaagctaggtttcttgctggtacacataatatggcaattcattatttggttcctacttctccacctaacctatctcctccccttgtaagctctcacacacactttacaatagaacgcttaatattccacgaattcaacatgctatcacacctctgcacctcagtctctgcacctctggttccaacactggggtcacctttgtgaagtcttcactgacttccctaaaagagacaagcaccccgccttgctttccactagtctgtgcctaagtgcaagctcttaccgcaaagtactgcaactgcccatgtggatgactgactagagcctagaagagcagttaagaacttggactctggagccaaattgagcagctccccactgagtggctatgacctctctgccagttgggcaggcctctccgtaactcaatttctcgtccataaagagagagacaaataacgcctactccagaagattgttgtgaacacagaaccaaaacgtggacctttcaaagtccctatgaatcataaatcataataaaaaaaagaaaactgaattgaaaaggtttactgttttctctggagctcgtaatcacaattactctgcacttcagaaaagccaccctcaacatttgttttctaggaaatgtcaataagcaggtggaaataaaatgctccgaagaacaaacccgtacgaagagacctactgccaaatctgctagtgagtgccggcaatccaccacttccagactgagacctaagacggactgccacttacttctcagctgccacttacttctcagctggcgacataatgcatactttcctaccctaagcactttgagtccccccccccacccccgctaagaaagaagtatttaagccacgaactgagaccacgatgccacatgctgatcaggacactcacagtcatgcgtcacttaacgatggagatccgttctgagaaatggagaaatgtccccttaggcaatttcttcgggcagtagaaacccagacaaacccagatgacacagcctactgctcttaggtcatgaacctgtacagcctgtcactgcactgaacactgcaggcaaccgtagcatactagtgagtatctgcgtatctaaccataaaaaaaggtacagtaagaagacgatattataatctttgagaccacgctgtcccacattgaccagcaacgtccttctgcagcgcataatcgtatttaaaagtggattacaagagtcggaaaaacaagcggcgtgatttgttgtggcggcaaccagggaagaggcaggagaaaggcaaccgacgagttcaaaccacggagccccagtctcgcgaccccacctcgcgtccccgtcgcccgctcagggcccgacgcaggggtcccgggctagggcgacctcggagaagcggggcggggcttcccggctggggcggatccctccctccctctcgtcccgacccggccgcagccctgccgcgaacgacggtacctgaggacggccccagatccgcggtgcccatctcagccctgctcacaccctgcatgacaaggggtaggagaaagaggagagccatgctgctaccgacggtcgctggctccaaccccgagcgcctgcgggaccagcccagcactgccctccagccccggccttacgtcacttccgtcaccggggtctgt

SEQ ID NO: 1765 - DNA, 34627 bp, Homo sapiens
gttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaaagcccgggggtctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgctgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccaggtgagccgggcctgggcctccgcggcgggacgcgggcgcagccgcagcatgtgggggctgggggactcccggatcgtggggtggggggaatctgccgggtgctcagagtgggtgggaatctgcggggtgctcctggtgggtgggatatgcggagtgctcagatcaggtgggaacctgcgggtgccccaggtgggggtcttgcggggtgcccagggctagaggggcccgctgggagcccgcagcggggctgggatgggcggccaggagttccagacaggagctgggcagcagcaggaagacggggggcacccctcctggcgtcctggccgccgggacacccctctccgggagaggacactcggtgcccctccgtgaagccggtaacctcggctgcgccacctcccccacccgcgcgcccgcgccgggaaagccagcgtggccccagtctccgaatttctcggaatgaacaacagcaaattgaatccagggctccggcgggggccgcctttgctggccactggttctgcagcctggcgagactgcgcttagtccccgcctggagtgcctcccgaaggcctggctggaagctagactcagtccctttgtagtagcagcggtggagcagggaccagcgtcttggacgggtgacccagactcaattccgactttggccgagggcatgtttgacactgggtgtgaaatctagacagttcccgcggtcatagagatggggcagcagcattcaggcagggctcagaactgtccgggtcccatcagtgttggggcggaagaggaagagtgtcaactgagccaggcatttatttattttattgttgtttgagacagggtgtcgctctgtcgcccaggctggagtgcagtgggcagcatctcagctactgcagcctccgcctcccgtgctcaagcgatcctcccacgtcagcctcccaagaaggtggtattattggccacgcctggccaatttttgtattttttgtagagaggaggtctcactgtgttgcccaggctgttcttgtactcctgagctccagcaatccacccgccttggcctctgaaagcgctgggattacaggcttgaggcaccgtgcccagctgagccaggcttttaaaaccggttctgtccctacccagagagcttcttacctggcggcctccttaacctctgacaccagctgaccacgcttatgagccaaacataaaaaccaaaagaaacccaggcttggtggctcacgcctgtaatcccagcactttgggaggctgaggcagcatcatgaggtcaggagttcgagaccagcttgaccaacatggtgaaacccccgtctgtgctaaaaatacatagctgggcgtggtagcgcccgcctgtaatcccaactactcaggaggccgaggcgggagaatcacttgaacccgagagctgagatctcaccactgcactcccgcctgggcgacagagcaagactctgtctcagaaaaaaaaaaaaaaaaaaaagaaaaagaggaaaagaccttaatgacaaatgtgtggctagaacattcttgtgtatgtatctgcttttgttttgctgggttctttcccctggggagagtgatatcataggagtctcgagaatttagaagattcttcccattcgaagctataaccttgtgttgtgggtttgttttttctaccggcattccttgcaaaggcccataagttccgtatctccttgatctggggtgccttgcacttgaggaaattattaactgcttttccatgggagtcagacagatgggttcaaatcctgactctgcttccacttggcttcacgtcttgagcaatctgcatatgcctcctccctaggcctcctcctaatgagagttgatgattgtcctagtgtgggatcagcaggcgagtgacttcatgccagagaggagtgactagtggtgatctgtggactgtttgtgacttacctgtgatgagtccagaggttgaaagatgtatttagaaactatagtctgacattgccacaacatccagctacctgtccatcttgttaatgattaactttaattgtattctacaaaagttttggtctatgtgatatgttgcaaaataaaaaaattttaaaaagtgaggccaggctcggtggctcacacctgtaatcccagcactttgggaggctgaggcgggcggatcacctgaggtcaggagttcaagaccaggctggtcaacaatgatgaaaccccgtctctaccaaaaatacaaaaattagggggcgtgatggtacacacctgtgtcccagctactcaggaggctgaagccgaagaatcacttaaactcaggaggcagaggtgcagtaagctgagatcacaccactgcactccagcctgggcgacaagagcaagactctatctcaaaaaaacaaaaacaaacaaataaaaaaactggctccattgatcctttgaaaagtagtagcagctgggcacggtggctcatgcctgtaatcccattactttgggaggcagaggtgagcagatcacctgaggtcagaagttccagagaccagtgtggccaacatgttaaaaaccccttctttactaaaactacgaaaattacccgggcgtggtggttggcgcctgtaatcccagctacctgggaggctgaggcaggagaatcacttgaacctgggaggggaggttgcagtgagccgaaatcatgcaactgcactccagcctgggtgacagagcaagactctgtctcaaaaaaagaaaaaaaaagaaaagaaaagtagtgtagtgctttaaactaatctctattttgcaactatttgaacattttcacattaaacagcttaaaaacaaacctaatggatatcttcaaaagaaacactcttttagtcaaaacacaaagtgaaaatattcacaatgattatatggcaaatgggtggtagaaaggttttcacactttcccataacttaccggtgtaattttgaaattgcttttatggtcagagaaaaaaaaaagtgttggaaactttttttttttttttttgagatagtatctctctccatcgcccaggctgcagtgcagtggcatgatcacagctcactgcagtctcaacctcttgggctcaagccatccacccacctcagcctcctgagtagctgggactacacgtgcacgccatcatacctggctaatttttgtatttttttgtagagatgaggtttcaccgtgtttcccaggctggttttgaactcctggggtcaagagatccacccgcctcagcctcccaaagtgctaggattatagatgtgaaccacccagcctggctccggaaacagattttttaaagggagacatagtatctatcccttagagttctgtaagagtagaatatgtaaaatatgggacctgtggcaatttgtagccatgagctgttaagtagtggccgtttgcgctagatagaaaaatgtaaccaacagcacaagtgcagtaaatcaactgaccagttagttacctgagtgttgaggaattaaggcttctatttgtaattgtagcaggtgctgctgactttttcaggggattggatatgtactgtgccacagaattttttatcattatttgctgacttgaacagccagagcttctcatatgcttagagaccaccgagaaagacagtaagtccccagcaacttaaaaaccattgcatgtgaatgtccactgggtaagctcctgagtgttcataatctcagcaagtgaaaatatcatgtagctggaatgcttttgccacctttataaacgatcatgatagtaacatttattggtcagacgagatgccaagtgctttatatacattacctctcttaattttctcagccattctttcgaactaggttatatctctagtttacttcctggaaagtcaaacctttcttgataggaagagccaaataatctaggtcaataacttgatgtccagttgttgttgttgtttttgagacggagtctcgccctgatgcccaggtgggaatgcagtggcgctatctcggctcactgcaacctctatctcccaggttcaagcgattctcctgtctcagcctcccaagtagctgggactataggcacctgccaccatgctttgctaatttttatatttttagtagggacggggtttcaccacgttggctaggctggtctcgaactcctgacctcaagtgatccccaccgcacccccccccgccaacccccgccagcctcagcctcccaaagtgttgggattacaggcatgagctaccatgcctggcctagtatttcttgaagagaacaatttcctggttatggctgaggaatcagaaaatgcctttttatttctcatctgcaaggtgatggaggtgggatcaatgatgttcacctaattgactttcatcataatgtccccgcccccaatagaaagatcctaaagggtcagtccttaattatcaagattaaatgattaatgttaattatattttattttattatctgtgtgtgataagtgttaatcaaactatgctgttaagacccaggatatcctcctattctttttgtttgtttgtttgatatggagttttgctcttgttgcccagctggagtgcagtggcatggtcttgactcactgcaacctccacctcccgggttcaagtgattctcctgcctcagcctcccaagtaactgtgattacagtatgcaccaccgcacctggctaatttttgtatttttagtagagacagggtttcaccacgttggtcaggctggtctcgaactcctgaccttaagtgatctgcctgcctcaacctcccaaagtgctgggattacaggcatgagccaccgcacccagcccctcctattcctaaatatgcataaagtctgaaatgcctggatctgggataggtagatcaaaggtgttgggatgggtcaggaaggcagagttgttcattcacctcttcactggttgttaaatggtcctagtgtttggccctgagtgtataaaaatgattaagacaatgaatgtagagaatagtctacttagagaccttgtcagaatgtctgtattaccatgtgtactataatagatacacatacactatgtgccatgatttttcaaaagtgctagaatagaaatatttttaaatgttataggacactacttgccaggaagagttgaagaaagtccaatagaggaagaacaaactgagctgggttttgaagcatggagtttcagattaaagaaaagaagaaaaggccaggtgtggtggctcacgcctgtaatcccagcactttgggaggccgaggcaggtggatcactaggtcaggagttcgagaccagcctggccaagatggtgaaacgctgtctctactaaaaatacaaaaattagctgggcacagtggcgggtgcctgtaatcccagctactcaggaggctgaggcaggagaatcgcttgaacccaggaagtggaggttacagtgagcctagatcgtgccactacactctagcctgggtgacagaacaagactgtctcaaaaaaaaaagaggccgggctcagtggctcacacctgtaatcccagcactgtgggaggccaaggcaggcagatcaggaggtcaggagatcaagaccatcctggctaataatggtgaaacctcgtctctcctaaaagcacaaaaaaatagccaggcgtggtagcaggtgcctgtaatcccagctactcgggaggctgaggcaggagaattgcttgaacctgggaggtggaggttgcagtaagccgagatcacgccactgcgacactgcactccagcctgggggacagagtgagactctgtctcaaaagaaaaaaagaaaaagcaatatgcaaaattatgtaggtccaaaataaaataggatagagtttatggtattttagcgagtggtggtgattggtctgggataagatcttgaaggattttcagcttactcaagtctgaactctaccctccatgccaggaatcggcaaagtttttctgtaaagaactagacagtatgcactcagatggttacagaagtttgattaaatggctgatttctgaattaggtatggcgcttgagactctgcctagggagagtgctcaggtcatgcttatatgtgaaaatgtgtcgttattttttcctcttgctctcacacatgtcccttggtttcctaagtgaggttttgaaaatgaaattttgacagttgagccaaaatgccctctataagcacgtgtatttccttctttaaagaattccctctcaggaattccctctctaatgtattgtaagatttggggttcgaccattaacgcattagtccagttcaataagcttcatttttttttgttggtagcagggtccattttatgggcgaacataccagtaagttccttgccttcggggaagtttaagtttattaaaagcagttacagatatattacagatgtattatacaggaggttctcaagaggcaagaaggttcagcaagttcattgtcttaattacaataattttttttttttttttttgagacagagtctctctctgtcacccaagctggagtgcagtggtgcaatctcggctcactgcagcctccacctcccaggttcaagtaaattctctggctcagcctcccaagtagcttgaattacaggcacccaccaccatgcctggctaatttttatatttttagtaaagatggggtttcaccatcttggccaggctggtcttgaactcctgacctcatgatccacccaccttggcctcccaaagtgctgagattacaggcgtgagccactgcggccagcctacaacaatttttttttttttgagacagagtctcgctcttgtcgcccaagctggagtgcagtggcgtgatctcagctcattgcaacctccactgccgggttcaaatgattcttgtgcttcagcctcccaagtagctggaaatgcaggtgtgcaccactatgcctggctaattgttgtatttttagtagagacggggtttcaccatgttggccaggctggtttcaaactcccaaactcaggtgatccgcccacctcagcctccctaagtgctgggattacaggcgtgagccaccacgcccatccaattagaataactttttacatgttgtatttttaaaattcataactcataatctaaaatttatgctcagcacagctaactttggagacctaccaagaatggtgcaatgattcagcagctactcatggtaagacaagagtatctgggtgtaacctgtatgaaacctgcatctcacaaccactgctccttctccccagccttccagccctggtgtttcccatcgggggccatgtggcctggaacacagaggctgggctgcccaaggacaggccccctggcctacaaaaaggacagtcttatcacagatgtgcaatccttggcacttccctgtggcgtctgcagttctgagactgattttcttctataaatgtgaaaagataggggatgataggaaacccggatataaggcagaacaatgttgcttgggccatctcttacacctcagtgaaacggaaaatgaaggaaatggaaggctggcatgggaaccccgacttatacagtgatgcccttttgctgttccacgcgtcgcttggggtggaagcccttccttgtcccctcgccacccaccccggagccccttggtgcttcctttctgaactgaatgcttagactggggaactagaggtgcccggaaagggaagtcgggaagaagagactattcctgttggttcctccccagagatgggagatggtgaacaggcgtgtggagggcggaataatggtccccaaagatgtccacgccctcatcctcagagtccgtgaacctgggaatgtgctgcctgacgtacaaaagggactccgcagatgtgagtaagttaagagccctgatgtggggagattgtcttgcattgttgggccaagtggccttataccaccacagggtccccaaaagatggagcagaggcagaaggttcagtaccagggagacaagaaggatgcggccaaccttgctggaggaaggtgccctgagccaaagaatgggagtggcctctagaagctgggaaaggcaaggaaatggattctccctggaggctcgagaaggaccccagccctgctgataacttgactttagtcagtgagactgactttaaacttctgaccagcagaactataagaaaataaatttagatgtgattttttaaaatttatttatttttagagatggggggatctcgctatgttggccaggctagagtgcaatgattattcacaggcatgatcatagcacatgcactacagcctcgaactcctgggctccagtgatcctcccgcctcagccccttgagcagctgggactacaggtgcgcaccaccacgcccagctaaatctgggttgtgtggagtcactaggttagtgataatgtgttacagtgataagaagaacctaatacaggaaataaaaggagttgtcagattctttgaatgcccaaccctaagcagacactcaccctgttcctggaaagagccgggtccagctgcgttttctcatggcccaataacaagaagcagacaaactaggaagaaagagaatttattgctgtaacaggaaggtcggagataatccgaccagaccaactcaaagtgtttgattttctttgtgcttacataggtttgggttatgtgcctatgtgtggtattgcactaagtctatgagtaactaattttgtttcaactagaaagtcagaggccaaaaatgtgctttctaagtctaatcaagctgtgaggtccccgataccgtcaaggcctgtctcctaaattctatttaatgaggactgtggtaccagagcatttatttatttatttatttttgagacggagtgccgctctgtcgcccaggctggagcgcagtggtgcaatcttggcttgctgcaacctccgcctcccgggttcaagcgattctcctgcctcagcctcccaggtcgctgggactacaggtgtgtgccaccatgcctggctaatttttctatttttagtagagacagggtttcaccatgttggccaggctggcctcgaactcctgacctcaggtgatccaccacctcagcgtcccaaagtgctgggatttcaggcatgagccactgtgcccggccaggagtttatttctatcttgtctcatttacagtttggtccggagagctgccttagactctccaataaatctattcaaacagctgcctctgttatcttgacttgctccaggtttggaagaagcctgtgtaggatctgtgtttcatttctggctttgatgtctgggcgtcagtttccctggggttaattattagcttaatgtgaaggcagcattgtggaaatttctctgcatagttcggatgctattcagatctgtctgtgtgactgtcatgcaggcctctctgtgtgactgtgagggagcattgacctgccaccacccccctctggaagcatccagtccccaactggctttgggcattgctaggtcatagcagccacagcacacctggtgggcctgcctcttgccacgcagctttacctgtctgccttcggcccaggatgtcatgaggcctgctgtgtgtcaggagaagtgttgttagctggttgggtgaaggtcacccagagctcataggtgtggaggggaggggcatcctataactaaacaaatggccgcagacttggcaattcatctttcagaagaagagccagtggtcaggctgtcagctgatctctttgaggttgagcgcatttaccgaaaatgtgtggcttgaatttcctgctttgaattttggaacagcatgtttttcaaacctttcttccaccttctgggcatttcttattaatctttttggtcaaaagccttatcttgattatgttttctttctaagacaaagggctccctgtgaagtacctgcttgggaaagggaggagttgtggcagtttcttctaggtccccgaaggctccctgtgaagtacctgcttggggaagggagaggttgtggttgtttcttccaggtcaccccaaagagagggattctgatattggtggtgtttccgggggagtatattctttctctgtttattgccccctaacctttttttttttttttttttttttggagacagagtctctctctgtcgcccagactggagtgcaatggtgcgatctcagctccctgcaacctctgcctcctgggttcaagcgattctcctgcctcagcctcctgagtagctgggattacaggcgctcaccaccgcacctggctaacttttatatttttagtagagacagagttttgccatgttggccacactggtctcaaactcctgacctcgagtgatctgccttccttggcctcccacagtgctgggattataggtgtgagccactgagctcgggccgtgttgtcctctaactttaatgtgtgtgagaagcagctggaaagcttgtttaaaatgcagatttcctgggggcctcaggacctgcactttaaccagcacccctgtgattgcgatgctgggggtccttgagagacgacaactctgatggtgcccagaagtcggcgttccttgccctcccctgcagcttgggctttgcgtacctgatttaggatgtttgtgtgtttttgcgtgtgtagtgtgtgcacgtgtgcacgtatttgcggacatttaccagacacttccttggtactaaatctgaaagctaacgcgtgtcacatgatcaccacgttaatcttcgccacagccctgtgggtgtatcattattgaccccttattcctgaaaaagaaaactcaagctcagacaggtgaagtgacctgccccgagcctaatgcagttactaatggtagaactgggaccccagtccggccagactccagggcccaggacctgttcgtaacaactgggacctgcaggtggaaaggctgccccaggcgcctcttttctttttgtgctgcctgtaccagtagggccatctttgtagccaaaagtcgggggtgtggggccatgcccagggggacctggtaatgccatttctgcactttgacaaaaactgagttgtatgaatgacttagataatggacattgaaacatttttgtaattatttccctctctctcctcccttcctccctcttctttttctctgtccccctcaagaccctctttcccagctgcccgctcctcagcacccgaagattcgcctgtacaacgcagagcaggtcctgagttgggagccagtggccctgagcaatagcacgaggcctgttgtctaccaagtgcagtttaaatagtaagccggtatttctgttggatccttgctgggagctgtgggggcatcgtgcggaaccctggggccacatactagtccctgcctctgtgcagggtttgttatcaaacccgtgggaaacacatcgttcttggagcttgtaaaatctctgaggacagaggtttcacagcctcccactcatctgaaggcttaaactacactggcagtcaggactccgctgtctaaccacacgggttcttgctttggtggaaagttcattctttcgctggtttcaggagaaaggttgtaaaaataggcttccaccatggaagaacaggaggcagcttttagtcttcatcttcgggcttaaaaatcggattgatttaaccttatagaccaaatatggcctgatcagaaatttgtttggttaattacaatgaattctgagtttctcaactggttttccattttgcatattatcctggctctttcatctgtctcttgcctcttcaagcttttgcagaattggccatcacttgatttgcaatataaatacatatagaaagagggcaaagtccacatcctttgttattttttgtttacgttgttaagtaggttaattgaagagtaaggtgaagttattggctaagtcattttgtactatttggtaaaccaaatgtaaagacatgatgatgtccagtgcttgtgagatgggactggttcatatgtgttcacctgatgctgtttgcagaatcaattagcatagccctttcaaagaggaattctaccagacatttgaagtcatggaaatgtccatagtagttttccaatgtgtgtgtgtgtgtgcacgtgtgcatgtgtgtctgtttgttgttgttgttttgaaacagagtttccctctatcgcccaggctggagggcaatggcatgatctcagctcactgcaacttccacctcctgggttcaagtgattctcatgcctcctgagtagctgggactacaggcatgagctaccatggctggctaataggtatatttttagtagagatggggttttgccatgttggccaggctggtctcaaattcctggccccatcctcaagtgatttgcccgcctgggcctcccaaagtgctgggattgcaggcatgagccaccgtgcccagccttcatagtagttttatcctacacagataattcaaccccccatcaaaaaaaagagagacaaaaactataatcatgaagagatacatggaagtgtatattcatatccatcagtaggaaagtgaccaattttagcctgctaacttacgcttgaacactaaaccacagacagccaatagaaaggataattagatgtcatctggtagaaattgcaactctgtaaactttggcatgtatttgtattttttatttcttatttttgttacttaaaaaaattttttattcacttttatactgaaaagttgcaagtggtatgtatttattgtcaagaatagaaaggggccgatcatggtggctcacacctgtaaaagaatagaaaagtaggccaggcatggtggctcacgcctgtaatcccagcactttgggaggccaagacgggcggatcacgcggtgaggagatcgagaccatcctggctaacacgctgaaaccctgtctctactaaaaatacaaaaaattagctgggtgtagtggcgggcgcctgtagtcccagctacttgggaggctgaggcaggagaatggcgtgaacccgggaggcagagcttgcagtgaaccgagatcgtgccactgcactccaggctgggcgacagagcgagactccatctcaaaaaaaaaaaaaaaagaatagaaaagtaatgtggaaaaatgacaggcaattgatttgttagaggagtaggtttccaggtaacttgtttttctttttctttttctttttttttttttttttgagacaaagtctccgtcacccaggctgaaatgcagtggcacgatcttggctcactggacctccgcctcccaggttcaagcaattcttatacctcagccttctgtgtagctgggattacaagtgtgcaccaccccacccggttcagataacttcttttttttttttctgagacaaggtctcactctgccccccaggctggagtgcagtggcatgatcatggctcaatgcagccacaatttcctggctcaagagatcctcctacttcagcctcccaagtagctgggactatgggcgcacactgctgtacccagctaatttttaattttttgaagagatggggttttgccatgttgcccaggctggcctcgaactcctgggctcaagtgatccacccacctcaacctcccaaagtgctgggattacagacatgagccatcacactggcgtttcttatttgtttttaaatgtccgttgtaacagtatttgcttaatagaaacaggtgctaaactgaggtttgagagttatctctaaatcacattgatctgttcctccagtagttataaattacgaacattaagttacctgtaattaatggagcaatccaccagagcaggctacacaatttgcaagacccagtgcaaaatgaaaatgtgagaccctttatttaaaaagtattaagaatttcaagatggcaaccgcagagcatcaaatgaagtgcctttctgagaacgggcttgatgtgagcgcacaggtcacatgtcaggaagttggccctaccctcagcattcagcaaacattacaccctagagctaaacaagaagcttgttgtgagagtcacggctgatgtattgacttaggcttgatgctgatttatgggctccttggccttgaacaaggaagtacgtttactgattttcagaggagatgcttctaaaaatgggataaaacgttattgcattaaaaaaaaaaacctttgatagagtttcatttgataaactaacctgtttcactttgtcttcttttcaaaaagcattttatagatattttctcagggataaaggttggttttattttttatttatttatttatttattttgagacagagtctcgctctgtcatccaggctggagtgcagtggcgtgatctcagctgactgcaactttcggctcattgcaacctgcggctcactgcagcctccgcctcgtgggttcaagcgattctcctgcctcagactcctgagtagctgggattacaggcacccaccactacgcccggctgatttttatatttttagtagagacagcttttcaccatgttggccaggctggtctcgaactcctgacctcaggtgatccgcccacctagcctcccaaagtgctggaattataggtgtaagccatcacgcccagcctagaggttggttttagtaaaagaaacataggttagggtacatgtgaatattcctgttagaaaaaggtgaaatcggggatgatttctttttctttttcagtttgtagatttgataatggaagagggcctttgcatttgtttttagatactttgttttagatacaaacatgtgtttgggactttttattagttttgaggcttgtgagacttaaatttccaccgtgtttctctacaataaagcattgctatgattaaaaatgaagatgcctttgttttttgacagagtatcaagaccaaaattacatggagcacttgatgggagaatttcaagtctaaatcatgggtagcagacagtggctgcaggctatttggctcccagtgtttaattttttttttcttcaatttgttgccaacattaagaaatctggacttttcacttagaaaaaaataataataaataacaggaaaaaaaaccaatcctgatgtcagttttccttgaaaatgcagacagtcgggcagcaaggccccttccagatcacgcctcctggtctactgccagcccctctctcagacctgcccagccctgtcttctcaaacatttgtttttcattttcttctgattttaatagcaatccatgttctttatagaaaatctggacaatctagaaaagtagaagaaaataaaataacctgttgttctacactctaagaataatcactattctcattttattttactttttattttatcttatttatttatttatttgagacagagtcttactctgttgcccaggctggactgcagtggcgtgatctcagctcactgaaacctccgccgcctgggttcaagtgattgtcctgcctcagccttccaagtagctgggattacaggcgcccgccaccatgcctggctaatttttttgtatttttagtagagatgcagtttcaccatgttagctaggctggtttcgaactcctcacctgaagtgatctgcccgcctcagcctcccaaagtgctgggattacaggtgtgagccactgcacccagccattattctcattttagacttttttttctaaattcgttctcttgtttgaaaattgtgtgtgtgtgtgtgtgtgtgtaaaccaaaccagactggggtcacacttctggggtctatttccttttttattttaacttgatgtagttaaatgtgagcattttttcatgtaattatttctgtgtggacattgtatgtttcattatgtgacatatcacatgtgttgtatttaacttttccccagtcatgggcgtagacagttggcagcttgtgcctgtcctaagtcatgacctcgtacatgaatcatatctggttattttcttacacttctagaagagaggttgctgggtcaaaggggatggacttacttaatgtttttgtgagtgacctcacaaaggctggacatagctcttgagtcccagggacaggctgagccccggcagtggcaggggtttgggggagcaggccctgcactgcatttgaggaagagccgtgcatgttgctcttggaggaggaggagcggggcggttagagggtctttaggtatctgtctaccttgaaaaagaaatcactcacctcttccagagcacgcccctcacccccgacctgagaggagaggctcgtggtttgcgatccctctccccattagggtctgtcaccctggggctgagtagtaggtatctatggcgggtgtcttcatggaagccctggccacgcatcttgaagtggctttcatcttgtcccttgcaacttaagcggaagatgcatcttggagagggtcggaggtacagttagaagcatgtgtggtacgtgaaagccggtggtcgtggggatacagagcggtctccagtctcgtctcctgtctcccatggccttgctttctgggccatagttgctgttgtagggggatactgtccgctgcccctactcaggctcccagcagccacctccttggcctttctgaagtctgtcacctaaggcaaagaggtcagagctggggactagagtcccacgtgggagtgtggcattgggactctgggaaaggcactgtcattcacaaggatgtgtggccatgtatttggcaaggttttcatatgggtgagacaaatcctctttgaatgggcagctatgggtggaaagaaactccgcaccagcaggaagcaggactggagtttgtattaacacagttccattcccaaaacataggctacagagactgagtttgaagtattaaaatcagttatgggatggaatgggagaaaatatttgcaaatcatctatctgacaagggacttgtatccagaatagataacgaactcttacaattcaacaattagaagacaaataacccaattaaaaaccacagctgggcacaagggatcacacctgtaatcccagcactttgggaggccaaggcaggaggattacttgagtctaggagttcaagaccagcctgggcaacaaggagagacccccaactctacaaagaaattaaaaataaaaataacagtagcagccaagcacagtggctcacgcttgtaatttcagcactttgggaggccgaggtgggcggatcacatgaggccaggagtttgagaccagcctgaccaacatagtaaaaccccgtttctactaaaaatataaaaattaaccaggcatgatggtgcatgcctgtaatcccagcacattgggaggccaaggcaggtggatcacttgaggtcaggagtttgagaccagcctggccaacatggtgacaccccatctctactaaaaatacaaaaattacctgggtgtggtggctcacacctgtagttccagctactcgggaggctgaggcacaagaatcacttgaacccaggaggtggaggttgctgtgagccaagattgcgctactgcactccagcctgggtgacagagcaaaactccatctcaaaaaaaaaaaaaaaaaaagcgggggggaactgtatggtacatataaattgtatctcaataaacctgcgttttgaacaaaagctctggggaaactattacacatgaaacagagaattctgtgaattgaaatccttttttccttcccagcaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatggtaagagaacttgagtatagaacttcctttatactttccaggttttcttcacttgcggtatcgactccacacacctctgtcctgcctgtcaccctaaatgaccagcagacaaatgggtaggacagtcaaacccacactctgaccttggaggctgatgctaagggagtgtgatttgctaaaccaggggttggccaactacagcctgcaggccaaatcgggcccaccacttgtttttgtaaataaagttttattggaacacacagttacatccatcttttattgtgtctatgactgctttcacactacaatggtagagtagttgcaatagcagctgttgagcctgcaaagtctaaatttactgtggctctttactgaaaaagtttgccaacctcatgctagaagggatgctagcatatctctctgatcacccttacttattctggtgcaacttcttttgtgttgcagaataggcaccttgaatggtgcctggcatgtagtaggtattcagtaaatatttgttgaatgactgagtgaacaaatatgtccccagatattggaaggagacagaagaaccctcagattccagttcctacatttgttcctccagtaattcatttgtcacgtagtcagccatgccagatgtttcttccgtgtctggtttatgcacacacagggcatgaaacttacatggatcttgatttagacaaactaatgtataagacaattgaaatgtgatcaccgtctagatatttgatatataatgaacaattttattgttgacttattttcagtgttataatggtgttttggttatgatttttaaaggaggaggaggtctggttaagatgttaaagtttatgttatgtgtattttaccacaataaaaaattgggggaataaaaagagttcctgctgggcgcggtggctcacgcctataatcccagcactttgggaggccgaggcaggcagatcacttgaggtcaggagttcgagaccagcctggccaacatggtgaaaccccatctctactaaaaacacaaaaattagctggatgtggtggtgcatacctgtaatcccagctacttgggaagctgaggtaggagaatcgcttgaaccggggaggcagaggttgtggtgagctgagattgcaccattgcactccagcctgggcaacaagagtgaaactccatctcaaaaaaaaaaaaaaaaaaaaaaaaagcaaaataatccaaagaacaggagggacaaggacaaagcttccaggcatagaagaaacaaaattggccataagttgacagttgattcagttgggtaattagtacatgagtgtttgttaatgatcttccctctactttttttttttttttttttttgagacggagtctctctctcttgcccaggctggagtgcagtggcgcaatcttggctcactgcaagctccacctcccaggttcacgccattctcctgcctcagcctcccgagtagctgggactacaggcgcccgccaccacacccggctaattttttgtatttttagtagagatggggtttcaccatgttagccaggatggtcttgaactcctgaccttgtgatccgcccgcctcggcctcccaaagtgctgggattacaggcgtgagccaccgcacccagcctatcttctctctactttctatgtgtttgaaattttctgtaataaaaagtttttttttgttgttgttgtttttgaggtggagtcttgcactgtcgcccaggctggcgtgcagtggtgcagtctcggctcactgcaacctctgcctcctgggttcaagtgattctccctcccgggttcaagtgagcctcccaagtagctgggactacaggtgcacgccactatgcccgtctaattttttgtatttttagtagagacgggatttcaccatgttgtccaggctggcctctaactcctgacctcgtgatccgcccatctcagcctcccaaagtgctaggattacaggcgtgagagccaccgtgcccggccaataaaaagttttttagagaggatcatgcctgtaatcttagcccattgggaggctgaggtgggaggatcgcttgagctcaggagttcaagatgagcctggggaatatagcaagaccccatctctatttttttttttttttaatcagtggtttgtgctaggtactgtgagggacagaaacagagaagacagggcaatcctgccagctcctcgtctgctgtggacaagccatttgtccttgggtgccaaaccaccctccatttgagctataaagtgtcaaataagtgggaattaggagtatgcaaacaagtaatgatggctgggcgcagtggctcacccctgcaatcccagcactttgggaagctgaggcaggcagatcatctgtggtcaggagttcaagaccagtctggccaacatggtgaaaccccatctctactaaaaatacaaaagttagccgggtatgatggcacacgactgtaatcccagctacttggaaggctgaggcaggagaatctcttgaacctgggaggtggaggttgcagtgggccaagatgacaccattgcacatcagcctgggtgacagagcgaggctctgtcatttaaaaaaaaaaaggaatgatacttaccgccactgcccagggatcaagagaaggtaacagaagcaggatgtatcgtgacagtgggtccggtgccagccagctgccgcttccggccggagtcaagcacccatgtttctgttagttactggctgggctgctgttctctgccctcgtgcttgaaaagcttgacacagtggtggtctcatgtcacatctgccactttcacctctgctggtggcgttagaatcagtaatggatatggaggtggtttaccaagcagaggagtgagatggtggttggagggggcaggctttagcatcaccctcacctgggttcatatcccaactctgccatttattggctgtgttactgtgggcaagtagtgtcacctcctggcttccgtttcctcgtctgagaaatggggataaccttatttgtttttttgttttgttttgttttttgagacagtctcgctctgtcgcccaggctggagtgcagtggagcgatctcagttcactgcagcctccgcctccaggtttaagtgattctcgtgcctcagcctccccagtagctaggattactggcatgggccaccacaccccagttaattttggttttgtttttgtgagatggagtttcactcttgtcacccgggctggagtgcagtggcccgatctcggctcactgcaacctctgcctctcaggttcaagcgattctcctgcctcagcctcctgagtagctgggattactggcatgcaccaccatgccccaccatgcccagctaatttttgtatttttagtagaaacggcatttctccatgttggccagactggtcttgaactcctgacctcaagtgatctgcccacctcagcctcccaaagtgctgggattacaggtatgagccaccatgcccatcccgtgatacccttatttggcagtgacactgatcgtgagaggcttcgtggaaaggccatttacctggagactccacacattgtcgtccagtgttccctagagccagccttcctccagtgctgtgagaggaggcagattgttctcgcctctagatgaggtttactgggttcatgtcagattccgggccaggactctcttcagaagggcaggtctgagccctgtgttttcagccgtgcagtggccagctgtggctggtgtccacactcccatgtgctaatggagatgcccaaagaatgtgtccaaagccagtccctgcaggtgcttctgcaacgcacttctgcacactctgctcacttagctgggacaagggaagctggagaacgtgtgtgctggtgtccctgggcaggctgagtggaagagcattttgtcactagcagtcaatccacaaacatcactatggctggtggtgggccaggcctgacctcacttctgccactgggagttgtctggacttagcacctccaccagaacaaatgagggggcacaactacaaactcagcagttcttttgcacagagagaagcttggccagatcatacacctaaccctcaccaacctggagtgcccaggggagagaatccagccctgctgttgtgaacacacagtgacaggattgtctccttgtgtaaaatgtgcagacattggtctcttagaacttcgaggacccaaactgtactttgatctgagtttctctggtgaattatacaatgtgcatgcttacttaataaatgcttgataacccctcattgatagcacatcatgagtcacagtcctagcctgacctgtgaattatatgaaaagcctgaacaaatagacttacatggcaacacttctcagttattgtgtttaaatatagtatgggcatggtgctcacgcctgtaatcccagcactttgggaggccaaggcaggcggatcacctgaggtcaggagtttgaaaccagcctggccaacatagtgaaaccctgtctctactaaaaatacaaaaattagccgggtatggtggcgtgtgcctgtaatcccagctacatgagaggctgaggcaggagaatcgcttgaacctggaaggcggaggttgcagtgagttgagattgcaccactgcactccagcctgggtgatatgtgcgagattccatctcaaaaatgaataaataaataaataggccaggcgcggtggctcacacctgtaatctcagcactttgggaggctgaggtgggcggatcacgaggtcaggagttcgagaacagcctggccaacatgatgataccctgtttcttctaaaaatataaaaattagccaggcatggtggcacacgcctgttgtaatcccagctacttgagaggctgatgcaagagaattgcttgagcccgggaggtggaggttgcagtgagccgagatcgcacaactgcactctagcctgggcgacagagcaaaactgtctcgaaaaaataataataaataaagagatagataaaaacgtgtgtgtatatatctacacccactatatatatatatatacatatatatatagcattatataatacattgtattatatctataatacatatgtgtatgtgtgtggttttctctttgtaattctttttcagtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggcaagagcatctttcttttttgtttggattttcttttctttgcagtttctggcttagcaaaagaaagaaacctttaacatgggcaagaacagggtgtctccatgtccccgtgtccccatagaggctgagccctgagcctgttttcattgtcctcttcaagacctgtttttccactcggtttgctgagacctccctccgccaggctgatctgaagggccagccatcctttgatgtcactctgtgtcccttgtgtggggttgagactttgccggtgccctgcttacgatgcctttgccacgctctgtagtttggaggaggttttagtgggcctggttctccatgaggaatccacaactacagcctgcaaggcttaactgtataaatgtttgaacagtttgtgaaaagggcacatgcgaaatcggggggaaacagagggagaaagagctttccagagagcagtaccagcaggtatgagaaggcgtggcatacgtggagaactgcaggtgcttagattggtcagaaatgcaatccacaaggggctgtggcaggtgctcacgttgacagaggtgcatgacatcagagcggcctggtcagcctcggggagtataggaaaaagcatcatggtcttgaagcatctccagtgcctaaattatcctagctgcatttaaggaggttctgttatctatgggaacttcatgatttcctaaattcaacattatgatggtttttgataataagagcttacatttattgagagcttcctttgtgtttggctctgggccagaattttagatacttcatctcatttcatcttttttttttttttttttttgagctggagtttcgctcttgatgcccagctagtttttgtatttttagtagagacagggtttttaccacgttggtcaggctggtctcagactcctgacctcaggtgatctgcccaccttggccacccaaagtgctgggattacaggcatgagccaccgtgcccggcccatttcatctttatactaatccgtttgcagagagagaatccaagtcgttaagtggcttgcctcaggtcagcagcgaatcactggcagagcagagcagagcagagatgcctagcttcagagccctgctcttgaccaccatctttttctgccacacgctttgtatctgcacttctccttcattttttttttttttttaattattgttctttttttgagacagtctcactgtcgcccaggctagagtactgtggtaccatcttggctcactgcaacctctacctccccggctcaagcagtccacccacttcagccacccgagtagctggaactacaggcctgtgccaaccacacctggctaatatttttaaatttttttttatagagatggggttttgccatgttgcccaggctggtctcgaactcctggtctcaagcgatctgcccacctcagtctccaaaagtgctgaggttacaggcatgagcccgttcccagcctcctcttcatttcattatggggaatatgaaactgggaagagtgagactcactgaaaaacagacttagcatctaggaaatagggaaaaatcatttctccatatcagagctcaagatctgggtcgattagaatagagggagcctggcagaatccagaagagagactctgcctcttccaagtctgtcctctccaactggatacggtgccggaaatgcaagagataggatgggccctctggccacgcttttctccaccctttggttgctttcttcactcgagggcaccgtgttgccatgctccctccccaagggcccgcccatacttttgtttttttaggatggagtccatccacttctctgcactgagtcagcccccagagggcgagttgccacttgtatcctagagctgggcagggctgcccagcactggagaactcagctccaggaccctggggccagccttgttgagcagcaagctctaatgaagagcacacagaacaggcttccactgcctgggacccgcttagcaccatgtcacttagcctctctgggctgcagcttcctcgtgtataaaatgaaacaactgagctataagctggagcctgtgaagaggagcagccgtgagggcccccaagtccctttcctccatttgaccagagcatctgtacttggcttccatgatcaaaaggttcaaggatgaaaatgactctgaaagccaccaatgtgatctttgttccagctgtgagtctgtgtgttagggtccccaagacccaccctagatcgctcaaaggactcccaggactcagcacagagtcacactctgatttcgttttgagacagaatttcactctgtctcccagggtagagtgcagtgccacaatctcggctcacgggttcaagagattttcctgtctcagcctccacatctgtgcctggcccatactctgattttttatagcaaaaggatgcaaagcaaaatcggcaaagggaagaggcacatggaggaaagtccgcaggtgtccaggggtaggcttccaggagcccttcctgagctgagtcacgcaggatacacttcattgctccaccagcaagctgtgactgcacatgtgaactgttgtctgccagggaggcttatgagagacccagcgcccagggctttttctgggggctggccacatacgcaccctctgtgtagcgtatgccaaaattccgactcccagaaggaaaacagatgttcctcataaagaaaacacattgtgcaaacagtgtagggacggtaagccaccttaccagtttgggaatgggagggataaacttgaaatccaaattcccaggctgggcgcggtggcttacgcctgtaatcccagcactttgggaggccgaggcaggcagatcacttgaggtcaggggttcgagacaggcctggctagcatggtgaaaacccatctctactaaaaatacaaaaattagccaggcgtggtggtgggcacctgtgatcccagttactcaggaggctgaggcaggagaattgcttgaacctgggaggcagaggttgcagtgagtcgagatcacactactgcactccagcctgggcaacggagcaagactccgtctcaaaaaacaaacaaacaaaaaacgcacacaaattcccagatgtcagctaagggttgacctggaaatcaggcccttcaaagggcattagtgttaggcctgttacgttagctcttctgcagtctgtgactctaaattttaggaattccaattgaatgctgaaataaacccaaagggaatttttgtccttaaaatcgtgtcttcctctgccctggcagtccaacaccattaaacagaagaaaagaaaatgtaaaaccatcaagtaatactattattcatagatcatacaattacttttatatttttattttttaattttaatttttcagagacaatttcactctgtcacccaggctggagtgcagtggtgcagtcatagctcactgtagcctccaattcacaggctcaagccatcctcccactttggccttccgagtagctgggacttataggcatgcaccaccatgaccagcttatttttttattattattttctgtagagacggagggagggggtctcactatgttacccaagctcaaactcctggactcaagtgatcctcccacctcagcctcccaaagtgctggaattacaggcatgagccaccatgcctggcctatttttgtattttaaaaaataacaacatgttctgtatttgaataatctgccttttttcagttaacaatttagcagccttgtcttcccatgttttcaagcatatgttataccaccatttcatgtggctgtagtggattatattgtatctcaaaattagaaaacagttctttgcaagaaaccctatactgccataatagggtatcgctgttttccactttggtatgggacaatgacagccttgccaggacaacaggagccattgcctggaagaccaggtggggaggcagcaaggcctgctcaaggcagcagagggatgcgcagaggagacacagaaccttcctagagtctagggtccagttgtctcctgatgacataaatccttaaggtcattttagctgaaactataggaggctcaagcacatttcggtcaaactagaagcaggttgggaatgaaaggaacattatttcccagaataattttttctctgttgactaacttgaggtatctagattaaccgtgagatacaaaatgttggccaggcgcggtggctcacgcctataatcccagcactttgggaggccgaggcaggtggatcacctgagatcaggagctcgagaccagcctgggcaacatggtgaaaccctgtttctactaaaaatacaaaaatgagccagacatgatggtgggtgtctataatcccaactactcaggagttggaggcaggagaattgcttgaacctgggaggcggaggttgcagtgagccgaggtcgcaccattgcggtccagcctggtgacagagcgaaactccatctcaaaaaaaaaaagaaatacaaaatgtttgttttgagatggagtcttgctcttcatccaggctggcgcaatctcagctcactgcaccctctgcctcctggtccaagtgattctcctccctcagcctcccatgtagctgggattacaggtgtgtgccaccacatccagctaatttttgtacttttagtagagactgggttttgcaatgttggccaggctggtctcttaactcctgacctcaggtgatccacccaccctggcctcccaaagtggtgggattataggcgtgagccaccccatccagcccaaaatgttaaaggagaaaaagattatcctagaaattgggatttactgaagtctagttactacaatgggcactctgagacctcacagccagaaacacagttctaaagctatcagcctctttggccacacaacacaccaattttcacacataaaatgtgtccactgccagccagtgacccactaaaaatggcatcttgttcttctttggttgtcgtgttcacagtgaatttgaggaaacatcagaaaagatgtaggcagcttggccatgttcatttacatgtgtgcttgtgatgtttttaaaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatggtaaaatataccttcttatgtcctttctgaactgggaaaagaatactcctccaatagtgaaatcggggaatgcttatgaggtcatgggtggtgggagtggggagacccagtgagaagagtgctgaactgcaggaataatgagcttgtgctgagatttgcagtagtggaggctaccagacagctaccacttgctttatttcattacaggattgactttagctattaatgtaagcataccaggtgagggtggggggtagagggacttgcccattttactaggacaggaatgctctttaagcagcatggatggaacattaactgatgtttgtgttgtgcgtaggaagatcattctgttcactttcgtgtcctctttttagcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagaggtacgtgtgcacacatctctttttttttttttgagacagggtcttgctctgttgcccaggcgggagtgtcatggtacaatctctgctcactgcagcctccatctcccaggttcaagcgattctcctgcctcagcctcctgagtagctggtattacaagtgctcaccaccatggcctgctaatttttgtatttttggtagaaacagggttttgctatgttggccagactggtctcaaactcctgacctcaagtgatccacccacctcagcctcccaaagtgctgggattacaggcgggagccactgcgcccggccacgcagacatcttaatggtgacacatcagggccccactgcccctggcaacccctaagagtgcagctgtgggcaaagccgtggacacagagatttgggttacaaatggtatggggttgtttgtacacccatgttcatgttgacacgattcacaacagccaaaaggtggaagcactccggtgtcgttgaaggattaatagataaatctttaatagatggtctttccatacaatggaatatcattcagccttagaaaggaaggggattgtgacacatcctaccacacacatggaccttgaggacattatgctgagtagagtagggcagtcacaaaaggatactgtctgcttccacttaaatgaggtccccagagtcatcaaatccataaagacaggaagtagaatggtggttgcggtggtggagggagggaagtgggaagttcgtgttgaatggggccagagtttcagttctggggctgtacagagttctggagatggatggtggtcatgattgcacaatgtgaatgtgcttggcactaccgaactgtacacctaaaaagagttatgatggtacattttatgttatgtgtattttaccacaatttaattttttttttttaatggcatggggttggctaaaaaggtggcctggcctggagattggctgcagtagacccctctccgaggcagcaggtctcctctgctgtctggagaatgctccagggaagtggcctggctggaggacgtgaaggcggtggagacagtgatcaggagcttgagctttggggcccacagggtgcttaggagggccctaaggcagagtcaacacccagagctgtgagtgccaggccccgtgtacccattgcccagtgggtattgctaatatttgaaaggacttgagaaagaacagtagcgtgggtcttgtggaaagtcttattttcctgcataaccccagccccctgaggctctgtgaggccattgggccttctgaggacacggtcaggacattttggggatcagaggcgagctgagagaagaacatttaaaaagcatttgcagccgggcgcagtgacccacacctgtaatcccaggacttggggaggccagggtgggcagatcacctgaggtcaggagttcgagaccagcctggccaacatggtgaaaccctgtctctaccaaaaatacaaaaattagccgggcgtggtggtgggcgcctgtaatcccagctacatgagaggctgaggcaggagaattgcttgaacccaggaggtggaagttacagtaagccaatatcgcaccatagcactttagcttgggtggcagagcaagactccatctcaaaaaaataaaataaataaaaagcatttgcttctggaggcttcacattattcttgggtaaacctagagtaaaggtgttggaagcagaatgttactcagttacatgtgggatgaacagaggttagataaggtccaagtctgcagaaacatagcagcactttcagaaagaaccctagtcacttgttccttcatctgccatgatgtattgtaggtacacaggcagtatacagattccctactagaacctccctggttaatattgtcacaaaatcacagctcctaacaggtctcagaatcttacttgcagtaataatctctctctctcctggtagaactaccagctgagccccagtacatgaatatactatgagtcattcctctgagacatgaacagaaaacacaggcctgtcagttcacttttctaggaaagcataaagaacatccgccaaaggtctctgagttacatgggaacagtgaatcatgtttcacttataattctggggtttcacaagggtacatgttttggttttgttcctctttcagtcagtcagctacaagcttattgtcttccagtatctttcagcatttccaagagctagacactagattcttggtaacttggtgaatctatggctaagcctaaagcctgcgggagcaaaagggaaattaatcgctgggaaacacccctttatatgttaaggcctaaggccctcgctcccagattctctgcttgctgtgcgctggtgcaaggggaggggtggaggagtgcctgagaccaatgcttgtgaacttgccctctttttccccatcacagctgaacaagagcccccagtccctccttcactgaaaggttacaattttagagacgtcttaagattaataacccacaggcctacactgagggttgcaaggaagaacttgcttttcttccaatcagaaaatcagaagaaaaaaacaaaacttgcttttcctgagttttgcccttttaaactctcagcatattaacatggtcagccctgggatgagtattaaagtgattactgagatgaggggtaaggagtattcaactattagaagttgttggctgggtgaggtggctcatgcctgtaatcccagcactttgagaggccgaggtgggtggatcatgaagtcaggagatcgagaccatcctggccaacagggtgaaaccctgtctctactaaaaatacaaaaattacccaggcatggtggcatgcgcctgtagtcccagctacttgggaggctgaggcaggagaatcacttgaacccaggaggcggaggctgcagtgagctgagatccacgccactgcactccagcctggcaacagagcaagactccgtctcaaaaaaaaaaaaaaaaaaaaaaaaattagccagccgtggtggtgcacgcctgcaatcctagctacttggttgggaagctgaggcaggagaattgcttgaacccaggaggcggaagttgcagtgagccgagatcgcgccactgcactccagcctgggcgaaaaagagactgactcaacaacaataaaaaattgttgccgggtgcagtggctcacacctgcaatcccagcactttgggaggccgaggcgggcggatcacctgaggtcaggagttcgagacagcctgaccaacatgggaaaccccgtctctacttaaaatacaaaattagcagggtgtggtggtgcatgcctgtaatcccagctacttgggaggctgaggcagaggttgcagtgagatgagatcgtgtcattgcactccagcctgggcaacaacgtgaaactccgtctcaaaaaaaaaaaattgtttcattgttgaataaaaagaaaaataagttatgtcattggtggacagaatcaacttatatctgaataaaataactataccaattaaaactaaagtaggccaggcgtagtggctcacgcctataatcccagcactttgggaggccaaggtgggtggatcatttgcgatcaggagtttgagaccagcgtggccaacatagtgaaaccctgtctctactaaaaatacaaaattagccaggcaaggtggtgggcacctgtagtcccagctacttggaggattgaggcaggagaatcgcttgaacctgggaagcagaggttgcagtgagctgagatcacaccactatactccagcctaggcaagagtaagactccatctcaaaaaaaaaataaaaataaaaataaaataaaaacaaaaactaaagttaaaaggtctggtatactgaactggtaaactaattacaattttgctttccaacctcctcaagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtcta

SEQ ID NO: 1766 - DNA, 7183 bp, Homo sapiens
ttctggttgacaaagagggtatttatttagggtttactgggtacagggagaagggctggatggcttgggatgcagagagagacccttcccctgggatcctgcagctccaggcccctttgggtggggtcggggctgggaacctatgaacattctgcaggggccaccgtcttctccacggtgctcccttcgtgcatgacctggcagctgtagcttctgcgggacctccactgctcgggcgtcaggctcaggtagctgctggccgcgtacttgttgttgctctgtttggagggcgtggtcatctccacgccctgggtgatgggggtaccatctgccttccaggtcaccgtcaagattcccggataaaagtcattcatgagacacaccagtgtagccttgttggcttggagctcctcagaggacggcgggaacagagtgaccgagggggtggccttgggctgacctgtgtggacagaggagggggtgagagatggcagagggagtgtggggtgttgtggagcgcctctctctgtctaaagtctctgggagggttcatggtgtggccgcctggtccacccagggcctctccttccctcctcattccctcctttccactggagccctctggagagcagacagccctgtgccttcctaggagcccttcccaagtcacctttcccaggtgtcctggcccagccctttcctctgcagcctcggtttccccgtgtgcacccagggcaggctgtgctccctccttcctggtttctggagtctgagtttggaatctaggggtctccctcacagcacacaaaactatactggcaggatgtggggagacccaagcctggcatggcctggagcttcccatcccctggggcaccaggctgtgccccagcctggcccactcagctctcctggtgaagcgtgggctccacccagacacaccctggggctctgccgtcgcccctgtccccaccagcccgaccacaggacccttcacatcggctgggttcttggggctgctcccccagactttggggcaccgcagcccccatgcccaccccagcagcctctgatgcccctggacttcacctggcagccatggagttctctgcactcccgtttactccccgctagtcaccttctgagtctaaggtgcccttcctcaaatgaaggtgggaggtcgacccatgaacagagagacaccaggccccagagatgacagggctccagggacaggcacatctctgcactaagagaccctctcctttctggtgactgtcctgggagggctgggctctgggacctcatccgttcctctgtgtccccatgccctgaagacccagcagaggccacagagctgcagcctagacccagagccctctctgtgccctccattggtctcccctgggggtgacccctgtgtccccaggcccccgtgtggccctcccaggctggatgggcatccagccctcagcctagaacctggggtcccagggactgtctctaaggccactgcagggcccctcatcagaaccagcctctgtccctcactcagacatctgccctgggagaggggaggagccctgaccccgcccaatcccagcccaggccctgggaccaggctgtgtcctgctgttggaacctgaaggcggctgctcccactgtgggggcccttcctgccattaccctgagactaacacatctcctccaggccccatggacaaaggtaggggtcagtgcttaaggctgggagggcagaggggaagaagccccagagagagaaaacacattttccagagacaggagagggtgggacagcctgggaagttagagccacttacttaaaacggtgagctgggtcccgctgccaaacacatgcgtcactgagttatgcttggattgaaacccccggggccagcacctggggccagtccaggagccgcgctggagcaggaacctgctgggagtgaggggcacagggctgcagtgtgtaggctgtgacccaggcacagggtaggggggtggccagtgtcccagtagtgtcccccagtagtgtctctgtgcctgtcccttctctgaggcaggtgctgccccagcgtgtgtccccctctctgaaactgttggtgctgatggcaacgctgggcccagtaggtcccagcaactccctgagtgacacatcccctcaggcagctgtgccgtgtggctgaggagtcctcagctggctcggacctgtccacctcacttggcctcattttaagggcctctgaaatctgccacaagtgtccccagtcaaggaggctgacttcctccctggaccaggacattgggtcattcctgactcaagaggagagtcctctgcttttatatctacccatggagatgcagctcagtctcactttgttcatgaagccttttctgatcattcattccatccgtccgtccatccatctgtccatctgtccatctatgcatctgtccatctattcatctgtctttgcatccatctatcatctgtccattcgtccatccatctacctgtccgtccatccataaatccatcctgtctaccaggcactgtgtgctggggacatggtgtggtcccccaggctctcacccccatctctcccaggccatggtcaacaaggccctcctcatggtcatgtccaaggtccttctgctgtacctggtgtctccgctggatgcgacacagggctggcccctctttccagtgactcttttccccttggggtctgagactcccctttcctcttcccctggcatctgtttctccatggcccatgcctggctgctgactccccagaccccacccagacctctttcttagccattttcacactctgtgacccccactattgcccacatggtgaggctggagtctatcccagctccaaaccctctcagctcctcaattgcctactgaccttgcccagtgggctacccaacaggagcctcaaactaatcacgtccagaggagatgaccaccttcccccagcccagctcattttctgtcttcatctcatcacaatgaccatgggcggtctcaacccctcagccagaaacctggagtccctggactcagtcacctcgcctcccacactgaaatggcttctgcgaacttagctactgcatctagacattctttttttttttgagacagagtctcgctctgttgcccaggctggagtgcagcctggcaacagagcaagactgtcccaaaaaaaaaaaaaaaaaaaaagaagtgtcatattgatctctccctctctctcctgctatgtacagtcccatttccttttatttttttgaaatggaatttcacccttgtcgcccaggctggagtgcaatggtgccaccttggctcaccgcaacctccacatcctgggttcaagcgattctcctgcttcagcctcccgagtagctgggattacaggcatgtgccagcacacttggctaattttttgtattttcagtagagacggtgtttctccatgtttgtcaggctggtctcgaactcccgacctcaggtgatctgcccaccttggcctctcaaagtgctgggattataggtgtgagccaccacaccccgctccatttttatacatagcatcaatatttccactttaactatttttaaacgtacagctccgtggcactaagtacattcacaccgttgggcaaccttcaccaccatccatctccagaactctttcatcttcccaaacagaaactctaaacccgttaactacagtcccccattcttccctccccctcaccctgctaacctcaaatctactttttgtccaagtgaatttgcctattctaggtacctcatagaagtggattcaaatgacatttgtccttttgtgtctggcttatttcactaagtataatgtcttcaggtttcatccatgttgtagaagatttttgaaattaatttaaaaataattaacattcaaaacctattaagacctattaaaaatagtacaggctaggtagggtggctcacgtctgtaatctcagcactttaggaggccgaggcgggtggatggcttgagcccaggggttcaagaccagcccaggcaacatggcgaaacctcatctctacaaaaaattatgccggtgtggtagcgcatgcttgtagtcccagctactggggacgctgaggcagggatattgcttgagcccagcagttggaggccagcccaggcaacatagtgagacccccatctctaaaaaaataaataaaacaaataaatttacaactaaatataaaaagtgatacacaacctatttcttaaaaacaatgaaaatatcttttaataagctatgaatagaaaagtcatttatttgataggagatatttaccagaattctacaggaataatcagtcttttttttttttttttttttttgagacagggtctccttctgtcacccaggctggagtgcagtggtgggatctcagcttactgcatcctcaacctccgaggcttaagcaatcctctcaccagcctcctaagtagctgggaccacaggcaagtgccaccatgactagctagtttttatatgttttgtagaaatggggtcttgctatgttgctcaggctgatctcaaactcctgggctcaaacaatcccgcctcagcctcccaaagttgtgggattacaggcatgagccactgcacctggcccatagtatttctaaagattataaaaactcatattcatatcccccccagcataatacctttttttttttttgagtgggagtctcgttctgtcgtccaggctggagtgcagcggtgcaatctcagctcactgcaacctccacctccctgattcaagcgattctcctgcctcccctcccgagtagctgggactataggctcgcgccaccacgcccagctagtttttgtatttttagtagagacggagttttgccatgttggccaggatggtctcaatctcctgacctcgtgatctgcccatcttggcgtcctaaagtgctgggattacaggcatgagacacagcacccggcccatagtatttctataagatttctaaagattctaatataaaaacttacattaatagccccccaacataataccattttttattatctgtgtctccctccacctgtcacccgtcccttgtggagacccctcgggccttccccatcccagtctctgttctgtaggcatcaccctgcatgtggctgtctcctcacccggcccccgctccttgtggacttgaattggggcaaatctagatcctctgggacctcagccccagcacagagcctgaccctgatggggactccttgctcagaagtccgtgcaggacactgacacccggtcccggcctgccaccatgctgaccccgcctccatggccgggctcctggtgtgggtcaggtcggctgccactgctggagctctcaccacagccaccccagcatcctctgggtgggtgggacgctgaaggccctcaccagtcagggcccctcagattgcagaaggggaaactcaggcccggtgtggtgtctcatgcctgtaatcccagcactttgggaggctgaggtgggtggatcacctgaggtcaggagtttgagaccagcctggccaacatggtgaaactctgtctttactaaaaaaaaatacacaaaattagccaggtgtggtggcagatgcctgtaatcccagctactccggaagctgaggcaggagaatgtcttgaacctgggagacggaggtttcaatgagccaagatctcgccattgcactccagactgggcgacaagagtgaaactctgtgaaactttatttgaaaaagaaaaaaaagagagaaaaagggaaactcaggtcccagagatgcacgtgtccgctcgatcagcttagaggatgggacaggggagagctagaggggatagcttgggccttagaatctgtgcccatgagctgagtgactcggacgggtcacctcacctctccgggctctatccccgtctgcacaaaggggatcacagcaggacctgcctatggggccaccgagagggaggttctgcccctgaaatgattatcgcctgtgggtataacatgcaccagtgaacaggctgttgtgtcccaaatgctcataaatggaccccgatgcttggtgctttgtctggggacctcccaccacacgcagagtggtggcaatggctgaggtcacacagggagttgtggcctccctagagcctctcctgggcttcttctttggaggcacttgcaccctggataagcttgtgtctcctaggggctggtttcaggaggcgatgctggctgaggtctagtgacccagggactccaggaaaggcccctcacaccttagctggagctccagggagtggcccctgcccagtgagggtgggagtggacaggtgacataggccaaggggaaaagaggaggggggggaggaggagtgggaggaggaggagggagaggcctgggcatccttcagggatagcggccaccactcctgtggacgtcctgcccctgcctccagtcctgccctaccccaaggactagggggaggtgagggagacattggccttggtgccaaatgtaagtgggggaagaaatctcaggaatcaagataaataatattttaatatgacattaagcaataaaaattaattcaaagatggacaaaatcttgacactttagttaaagtcagtgtctgtggctcccctccagggattaaccttcctcctcacccctctggctcgtctccccttggtcatcctttcccgcctctgccacccagacccccacatcccctggaatctctcaccccttacctgccccaccggctcctcaggctggaccggctgcttcctccaggggctccagggcccagggccctgctctgcgatgcagctgttgggcgcagcaggccatgggttaccacggccagacccagcagcagcaggggccagcgctgcctgaggttggggcctggctcaccaggggcctcaaggcccccctggcctgtccctggcctcatcggccctcagggtcagaggtccttgtggcctgacttgcagtgtgggctccctagagagtggtgccctggtccctctcgctggcagcagctgtcccattgcaccccagtccatgtggcc

SEQ ID NO: 1767 - DNA, 7183 bp, Homo sapiens; identical to SEQ ID NO: 1766

SEQ ID NO: 1768 - DNA, 61352 bp, Homo sapiens
gtgacgtcagagcaggaagtgtttgaggaagtcgcgccgcgctgcccgcgttaagattcccgcattttaatgttttcaggggggtgtcatagccccgggtttggccgccccagccccgccttccccgccccggggagcccgccccctgccccgcgtccctgccgacaggtgagtccccctcgtgggtgcggcccgggtgccacctgcaggccccgccgccccgctgcctgcaaggcccggaagacccctctgtgccgctgggaagtcgcagcttgcggactggggagcgtttcacttgtgcgggttggagttcgggaagccgggagaaacagctctccctggggtggcttcttgggggtgggtggctttgaggggaacctgcgatttatgggaacattgtaaagaaacacgtgacctcggcgatgctcagaagtaggttctgcccctgccacctcgggcagaaggcgggcaggcccgggcgcccctggtggagtcagctggggatcccctcgctagggcaagggcgtgggcatcgcctccctcggtgactttcttccttgcctgatgccacagcaaccggatgggggagggtgagagggacaaaagtttgccacaaagtttggaccaaccaaacacattggtttctttacaaaataaaaaaccagttgtatttttcttctctcccattcaagagcagtggtatctcttgccttctccatccctttgagctccatttttttcttaatcctaaccttttttccccatcccaaattgcttatagagttagcacgacatcagtatgagctggtcaccttccctgacaacgcagacatgtggggcctgggaaatgaaagagcgccttgggacagggggatttggaaatgtcatccgatggcacaatcaggtaggccctctgtgcagcttggggaggggcggggagccaggccccctcctcactgcctccactttctctgatcctgctgggccaagggctcacctttggctttggtcatcttgggacagtgaatagggggactgggaagagggcttcaggacttctgagctgactccaggttagtggtctccatgctttattgactatgtcacctaaataaatagtaaaataaagttaagctcttagtctctattatatatatatggtaacagtagaatatcatgtactaatatatactgatattatatgttataaaacatatagaaataggaaaatttaaaggatgagactaaataaataatttaaaatattttaattccttgaggccagtagttcaagagcagcctgggcaacatagcaagacctcgtctctacaaaaaaggtttaaaaattaggcagccagctgggcgtggtggcttatacctgtaatctcagcactttgggaggctgaggcaggcggatcacgcagtcaggagatggagaccatcctggctaacactgtgaaaccccatctctactaaaaatacaaagaattagccaggcttggtggcacgtgcctgtagtccccagctacttgggaggctgaggcaggagaatcgcttgaacccatgaggcggaggttgcagtgagccaagattgcgctactgcactccagcctgggtaacagagtgagactccgtctcaaaaaaaaaaaaaaaaaaaaaaccttaggcagccttggtgcgtacctgtagtcccactacattggaggctgatgtgggaggattgcttgtccaggagtttgaggctgtagtgagctatgattgtgccactgcactctagcctaggtgacagagtgagaccttgtttcaaaaccattttttaaaaattattttaaatgtcgggtgcagtggcttacacctgtaatcccagcactttgggaggccgaggcaggaggatcacttgaggtcaggagtttgagaccagcctggccaacatggtgaaacctcatctctactaaaaatacaaaattagctggtgtggtggtgcatgcctgtaacttcagctactcaggaggctgaggcaggagaatcgcttgaacccaggaggcagaggttgcagtgagccgagatagtgtcactgcattccagcctgggtgacagaatgagaccctgtctcaaaaaatatatatatatatatatatttaaaatatttgctaattatgatgtcttcccagtattgcttgcgatactgcacggcaaaaaataagcagatccacatgaaagtgagaattcatttagaatgatgatgaaaatccatatttcaaataattaacatttttttaaattttgtagagatggggtcttgctatgttgcccaggcttgtctcaaactctcatcctcaagcagtcttcccgtctttgcctcccaaaatgtttggattacaggcctgagccatgggacctggcctcagctgaggttttttttttattttttgtagtgatggtggtctcacaatgttgtccaggctcgtctagaactcttggcctcaagtgatcttcctgccttggcctctcaaagtgctgggattacagccatgagtcattgaacctggcctgtttttatttttaattgacacataataattgtacatatttatggggtacagtgtgatattttgatacataatgtgtaatgatcaaatcggggtaattggcgtgttcatcacttgaaacacgtatcctttttgttggaaacagtcaaaattctttcttctggctattttgaaatatacaatatttttttttttccggagacagagtctcgcactgttgcccaggctggagtgcagtggtgtgatcttggctcactgcaacctccgcctcttgagttcaagtgattctcctgcctcagcctcctgagtacctggaattacaggtgtgcaccaccatgccagctaatttttgtatttttagtagaaatggggtttcaccatgtaggccatgccggtctcaaactcctgacctcaggtgatctgcccacctcagccacccaaagtgcttggattacaagcgtgagccactacgtccggcctgaaatatacaataaagttttattcactgtagtcaccctgttgttctttagaatactgtaacttattccacctaaccgtaattttgtacccattaaccagtctctccctatttccctccacaactccccccacccccaccaccctttcctgcctctggtgaccactattctactttctacttctgcgagattagtttgttgttgttgttgttgttgttttgagacggagttttgctcttgtcgcccaggctggagtgcagtggcgcgatcttggctcactgcaacctctgcctcccaggttcaagtgattctcctgccccagcctcccgagttgctgagattacaggtgcctgccaccacacctggctaatttttgtatttttaatagagacggggtttcaccatgttggccaggctggtctcgaactcctgaacttaggtgatccccgccggcgcgcccccccccccccccgccatcccagcctcccaaagtgctgggattacaggtgggaactaccgagcctggacgagatcagtttttttttgtttgtttgttttgttttttgagatggattcttgctctgttgcccaagctggagtgcagtggcacaatcttggctcgctgcaactggtgtctcccaggttcaagcgattctccagcctcagcctcccaagtagctgggattatagccgtgcaccaccacgcctggctaatttttgtatttttagtagagacagggttttaccatgttggccagtctggtctcaaactcctgacttcaggcgatctgcctgcctcggcctcccaaagtactgggattacaggcatgagccactgtgcctggcatttttttttttttaatttttaatttctttggagatagggtctcaatctgtcatccaggctgagtgcagtggtgccatcatggctcactgtagccttgacctcctgggctcaaatgatccttctgcctcggcctcctgagtagctgggactacaggtgtgcgttgccatgcccggctaatttttgattttttgtagataggaggtctgtctgttgcccaggctggtctcgaattcctggacacaagtgatcctcccacctcagcctctcaaagtgctgggattacaggtgtcagccaacagactttacccaactgagatcagttttttattagctcccacggatgagtgagaacatgtggtatttatctccctgggcctggcttaattcccttaatgtaatgccctccaagctcatccatgttgccacagatggcaggatttcattcttttttatggctgaataagagtacattgtgtctgtgtaccacattttctttgttcatttgttcattgatggacatttaggttgattacatattttggctattgtgaatagtgctgcagtaaacgtgagggtgcccatatctctttgataaactgatttcctttcctttggatagatacccagtagtgggattgctggatcatatggtagttctatttatagtttttcttttttttttgagacggagtcttgctctgtcaaccaggctggagtgcagtggcatgatctcagctcactgcaacctccgcctcccgggatcaagcagttctcctgcttcagcctccaagtagctgggattacaggtacatgccaccatacccggctaatttttatgttttcagcagagacggggttttaccatgttggtcaggatggtctcgaattcctgacctcaggtgatccgcctgcctcagcctcccaacctgctgaaattacaggtgtgagccactgcgctagccttgtttgtagtttctcaaggaacctccatactattttccataatggctgtgctaatttacattcccaccaatagtgtatagagttccgctttctccacatccttgccttcatttgttactttttgtctttctgataatagccattttaactgtggtgagatgatatctcattgtggttttgatttgcatttgtctgatgattagtgatattgaacattttatcatatacttgttggccatctgtatgtctgagaaattcctgttcaaatcatttgcccatttgaaaaattggattatttatttttttgctgttgaattgtttgagttccttgcatattcttgatattaatcccttgttggatggatagtttgcaaataatttctcccattccataagttgtctccataggttccataggtttattctgttttttcttttgctgtgcagaagctttttagtttgatgtaatctcatttgtctacttttgcctctgttaactgtacttttgaggtcttatccataaaatcttttcccagaccaatgccctgaagcacttcccgtatgttttcttgtttttttttttttgagacagtctcactctcagctgagacaggtgcgatctcgggtcactgcagcctctatctcctgggttcaagcgattctcctgcctcagcctcctgagtagctgggattacaggcagcgccatcacacccggctaattttttttttttttttttttttttgagacggggtctcgctctgtcgcccaagctggagtgcagtggtgtgatctcgggtcactgcaagctccgcctcccgggttcatgccattctcctgcctcagcctcccaagtagctgggactgctggcgcctgccaccacccccgactaattttttttttgtatttttagtagagatggggtttcactgtgttagccaggacggtctcaatctcctgaccttgtgatccgcctgctcggcctcccaaagtgctgggattacaggcgtgagccaccgcacccggccacgtgtggctaattttttttttttttttttttgcaacggagtcacgctctgttgcccaggctggagtgcagtggcttgatctcggctcactgcaacctctgcctcctgtgttcaagcgattctcctgtctcagcttcccaagtagctgggattacaggcacctgccaccatgcctggctagtttttatatttttagtagacacggggtttcaccatgctggccaggctgttctcaagctcttgacctcaagtgatctgcccaccttggcctcccaaagtgttgggattacaggcatgagtcactaacaggcgcctggcctgttatttatttttaaaaagccaaaagccagcttcctcctcctgccggctgaaccccacacagtctgtctgcacctgcctctccatcattcctccccttggctgcctctgttttgagcgctgagccctcttgccggacaggcctccccctcctccacattcctccaggaccaactctaggccatctcctcctcatatgcgtctgggatggctttgttctgtggcaactggttctcccggtgagttcctctgggctggttcctgtgccgcccttcctgtctgcgtgtggagtaagtcttgtcaggaccctgcattcctggtcagccagggctgggtctggcctttggagttccttcagttctcctgtagcaagtgcctgacgttgtatatgtgctaggtgccccaaatcatccactctgccagtccacaaatatttatcgaatgtctattatgtgtacattggtaattaaagcagacctttggagaagggaaggagccattagtcaactaattataaatgtaagctcctaagtatggtaaagtgtgagttgggagaaggacccagtgcactgagaccttccgttggggtgggatcagtcagtgtcagaggaggttccccaaggaagtgacacttgaactgaggccctagtagaagtcagcttgacagagaaggtgggaggagagttccaggccaagggagaggctcctgaggggcctctgtggagggcaggtgtggcaagtgggcaagactgaaggccagcgtggccggaagggaggatggggcacaagtgcctgggtggctgagggtggacggtgcaagtcagatcctgtggtgttttttgggcagtttcagccgaggaggttttgttttgatggaggagcagtggaacgatgttagagggaggcgctgtgcccatggggacagattgggagggcccaagcagtgggcagcgtgctgggaaaaaatcagctctcggaagaaatgccttgatccatagtgtgcagcagttctcatggagtagctactcccaccagggctgacttcaagccaccagtagtttaatagcccgctccggcctgattcctgagtagttaacaaccagctctcagtgactgctactacagtgtcactggctccgtcccagtgatgcaggcagaccaggtctgaatgttttggagtcgtctaggtgagagatggggagaggtgggcagacttaagagatatttagcctggtgcagtggctcatgcctgtaatcccagcactttgggagcagaggcaggtggatcacctgaggttgggagttcgagaccagcctgaccaacgtggagaaaccccgtctctactaaaaatacaaaattagccaggcatggtggcgcatgcctgtaataccaactactcaggaggctgaggcaggagaattacttgaacccaggaggtggaggttgcagtgagtcgagatcgtgctactgcactccagcctgggcaacaagagcgaaactctgtctgagaaaaaaaaaaagagagagagagatttaaggggtggaattaacagcgcttagtggtggagtagaggtggaggggagcaggaggagtggagtgcctgcaggtcctcaatgatgcctacccgtgagcccggcccaggccaggaagctctctaccttccttccccgtgggttctccccaagtttgggaaatctctagggctgctttgggtgctgaggagaagtctttgatcattgtccaagttcagaagatgagcgtgtatgttctctgttgggaacccctctgttcacagcctcttaaaagaagcagctgggctatggtggtgttggttccttgactctgatggttttactccacgtaacaacagtgtgcactttcctgacactccatgcactgcatcttgtctgcagaagaaggaatgttgtagttatcacaatagaagttacatgaaaaagcccctaagcatgggtatcctcagtcagagaagtggcctgataatcagaggcatcatttactgagaacctgctatgcgccagcatcaaactaggtatttacgtgctttctctccagccctcacaactctgaaaggaagtactgttgtctttgttcccattttatagttgaggagactgaagcacagtctctgtgactcacccacagacctgagctcgcaagcaaagaggctaggattggaacctgcgtctgttcggaacccaacctcatgctttttccattgtgcctgtggcttctctgtggtgaggactcagggggaggccttggtgttccttaggctctcattgttcaccacagtctaaacctttttgaagcaggaaggggaaaacacttctttattgattttttgttgtttgttttttgagacagggtctccctctgtcacccagactggagtgcagtggctcgatcagggctcactgtagccttgaactcccaggctcaaggagtcctcccacttcagcctcctgagtagctgggactacaggcgtgagacaccacgcctggctaatttttttatttttgtagagatgaggtctttctatgttgcccaggctggtctggaactcctgggctcaagcagtcctcctgccttggcctcccaaagtgctgggatttcaggcatgagccactgtgcttggttgaaaaacacttctttggaggacaaaacacttataagtcttccttgttagacagagaaccccacattgagtgtttcccagggagggagggcagtgaacaagcgagccccaccacaacctgcttcccctgttcttgtggttctcctgccacgcgggcctcaccattccacattgtgtcgggactccctaagacctccagcccaggggtcagcacaaaccacttcccagtaccgtttagataggctgatattttcaatgagacctttgttaaatacaaaggaagaggaggaggagataaccgagtgctcccacctggcagcatgttttgggagtgggggcgggaaacacgatactcagtcacacagacctgggttcagatcctggctctgtcagcgtcttggctgtgggtccccactttttgcatggattatggggattctccaatactgatctcctcagtgctgggtccccaacatggctgggcaggatgtgggtcagctaccttctggaagccacccagggtaccttgtgatatcatcatgttctgtgtacacttggctgtgaggagggccaggaagcgctgcctggggccctgcgggatgctcgttggggtggaggaggcagtgtgtgtactggctgttagaaggcagagtattaacgatcccttctatgaagcagcacggacctgtacttgtccctttatgggacaaggcaaagctttccacagcttatctgtgtgcttggaagccttaaagcctctgctccgttcagtcacttctctagggatttatagagcctgggcccgagctctgtcagggataccaggaaaaaagggtccctgcccttcgtgtgcttactctctgatcacagtgatccagggagcattcagaaatgcattaagtgagtctaaatccaagcaccgaactgcatggataacagtggctgccatttttccagggcatcatgtggcatctgagctgggttccctgtccgcatgatctctcccgaacgctggggaagggaggcttcttggggtgaatggagctttagcaggatctggaaaggaggtacactttcgagggcctggcaagaagacagaagccgactcaggtgggcagagcagcatctccacagggccagaaaaggaagtgaggctgcggtcgtttattcccggctccctgtggtcggatgctgtgtttcattttagctgacatccctggagtggatggagccatccccatcttatggatgaggacccagatgcttgtaccatgggcttctatcgcacctttaccaggcggtgggggagggagttacacctggacctgcttgtctcctgagcccgagtgcctggcttctgtgggtgaggcggcaggccactgtgccccttgggggtctgcactgtagggagtagggtgaagaagtcatggccctcttagcgtagaccaggcgatgctggggcccagggtctgtccagttacctgctgagccaggggtgaaactgcagctggatcccggacctttttggctcccagccctgggtcctcctgcccagtctctctggtcccagccctgcacctcctttctgaagcattcatttcagggggtggggtctgagaaggaggaggaggtttttactaattgcccccatgtccacagtggcctggttggatgcttgccatgataacgggacactgggctttctgcgctaagggtctaaacatggctcttggcctctgtgagtttcccctgagtcgctggaagaggcaaacttgaggaagctgggccccttttgtttctcctgtgactgggtcttcagctcgcatctgccaggcaccttttggtctgaggatgtgctccccctctgccttttttacaccttatgacacacatgcttatatataagttttatgtttacatgcatcaaaggcaaggaattgcaaactctgaggaccttcataatcactacattcaatctggacatacaggggaccctttctccgttttctcaaaatacagaccagttttttgttgttttgtgtgtgtttattttttgagacagggtctcactccagtagtccacgctggagtgcagcagcatgatcacagctcaacgcaggtctcgctctattgcccagccttgacttccgagggtcaggagattctcccacctcagcctcccaagtagctgggactacaggcatctactactatgcctggctagtttttaaaaatatttttagtagagacagagtcttgccatattgcccaggctggtctcaaacccccgggctctagcgatctacctgccttggtctcccaaagtgctgggattataggtgtgagccaccatgcccagccacaaagcagttttaagttttgtccttcacgaggagttcatataccagaagttgggtactgagatggcgcaggcctagtctgggtttccacagaactaagctaagactcagtagattccaggaaaaataaagtaagccatccttcttaccttacatgtgtttgagttccactgctagtgaagaacaaactccctggggtttcagaaccggtgatcgtagcctgcttctgttttaattgaattttgctttctagagcaggtatgtttttagtaacaaagtcattctgtttgcatttctgtttcaaatgaaacattactcatggaaaaactgggaatatttcggaatacttcctagaggcagatgaaggccactgtgttaggaaaagtttaagtatgtctgtatctacgcagaccttcctaggcccagggagttaggatttcgcctcaactctagggcgaagctgagctgtctgtgagtagaaagttagttttggtatctatgcccagttatttcaagacttgttcagtgttcacattgctgagttcagtctttttagtttgcatttggatatttaagaccaatatcaagtcttcagtatcagaatctcctcctgattctgggttgggccaagtgacagctgtgtatcaggtccagtgtttgtgttgggcaaaagactgcaattatccaatttgtagctagacagattacctaaaatcacttaataaactaagtcatctaatctattttttggatctgatgatctgtcctgtttcatttatgataggtagaataatcccccccaaccccaccaagaaatctggatcctaatccctgaacctatgactgggtggggcagcatggcaaagggaaattaaggttgcagatgaaattaagttttctaatcagctgaccttagagattggcctggcttccctgggggtcccagtgtaatcccaagggttcttaaacgtgggagaaggaggcagcagagccagggtcagccgatgcatgtgaggaagatggcgggacatggctgacacacggatgggctaaggggctacgagctgaagaaagtggcgcttctagaagatgcagaaggaaaagtagggaaacagactctcccctagagcctctggatggagcatagccccaccaacatcttagctcagggagacccacatcaggcttcagcagatagaactgcaaggaaataaagtgtgttattttaagccaccaagtttgtggtaatttattacggcagcaatagaaaacaagtgccctcttctgtgtattgaagttacgttgctgcagatttttcagtatcttggtttagtctcagtcattctaaggtaacgaaccataagttacagtctctttggctaaaccattgcttggaatagtgtccatggaaatgttgcagggtggatggaggtggatagatgctcttggcaatggcacctcacgctgcagcggggccatcggtctctgtttgtggaaccctgcgttccccacgtctgagctcctctgcaaactccgcctaactggaggcaagtgtctgtagcagtgtctcagtcggctcagtgctgctatcacagagtagctgagaatgggtaatttataatgattttatttctcatagtcctagaggctatgaagtccaaggtcaaggcatcatcatagggtgaaggcgaaagggcaagagacaaaagggaccaaacttgtccttttataaccatcagtcccacctgggatgcagagccattgtggccgaattgccccttaatactgaggtgatgtcctggcgcagtggctcacacctgtaatcccagcactttgggaggccgagacgggtggatcacgaggtcaggagatggagaccatcgtggctaacatggtgaaaccccatctctactaaaaatacaaaaaattagccgggcgtggtgatgggtgcctgtagtcccagctactagggaggctgaggcaggagaatggcgtgaacccgggaggcggagcttgcagtgagccgaggtcgtgccactgcactccagcctgggcaacaaagcgagactccgtctcaaaaaaaaaaaaaaaataccgaggtgatactgctacaacaggaattggctttcattgaattatggaaaactgtggaacttaagccatagcagatatcgtcaggcagagctgctgtggatgaagctaccacagaactgggcaaaaatgtgtctgagcactgtggggaagtgaaacctgaaagcaaattcacgtcagcctgagaacagaccaggaatcgggaggtacagggaggtgtaacatggtctgcacatcaattaaagaaacgttattcttttttttttttttttttttttgagacagagtctcactctgtcacccaggctggagtgcagtggcacgatctcggttcactgcaacctctgacaccagggttcaagcgattctcctgcctcagtctcccgagtagctaggattacaggcacccaccattgcacccagctaattttttatttttagtagagatggggtttcaccatgttggccaggctggtctcgaactcctgacctcaggtgatccacctgcctgggcctcccaaagtgctgggattacaggcatgagccaccgtggctggccagaaatgttattcttttgacacattccctaattcttgaaaagcttgagatggacttgtgtccaccatggtttgtaccactgtactaatcagtttaatagcaacaaggtggccgggtgcaggggcttaggcctgtaatcccagtgcttagagaggctgaggtaggaggaccacttgaggccaggagtttgagaccagcctgggcaacatagtgagactccgtctctacaaaaataaaataaaaataaaaaaaattagctggacacaatgacacatgcttgtaatcccagctacttgaagctgaggtgggaggatcgcttgagcccaggagttttaggcagcagtgagctatgatcactccactgcactgcagcctgggcaacagagtgagaccctgtctctaaaaagaaaaaatagcaacaggttttacaattgttgagagaggtcagctcttgttcagagagcgcctcagaatctaggccaaagatcagggttctactagacaaagagaatgagaaggatacttagggcagaacctggatgcccatgcctactgccgcagactggactgagggggtctcccatagtcacagacgtaagcctgtggctgcaccatgggtgagccttggaaacagtgctcagggaaagaagcctgtcacaaaaggccacatgatatatgattccatttatatgaaatgtccaggacaggctaatccgtagagacagaaagaggtgggtggttgcctaggactagaggggctcggggagtagggagtggctgctgatgggtgtggagttttgttgtgggatggcagacatgttctaaagtgtgccgtggttttggtctcacaactcttgagtatgccagaaactattgaactgtgtaatttaattggatgaattgtatggtgcatgaattattctcaatagagctgttaaaaaaaagtaggcatgcaaggtcaccatctgatggaaagcttagccaaagtggtattgggctttgatgaaagcagcttctgagagtattttagaagtgttgacagtacctcctttctggcatggagtctgctgttccatttccacctttttttctgaagcttttggttcttggtgtcggtgttaaggattggtttattggtcagtgactcagtggtcttattagacagcttctggtgtatgtggaggtttccatttttccttttcttgctgtgaaggtccttgttcctgcagggatcctggccagtttggtaactgtgagactgaggtggcttgagtgccatgggaacagccacactgggaggccttgccacagtcctctgtgtgtctttttttgtttttgtttttgtttttgttttgaaacagggtcttactctgttgcccagatctcctgcaacctctgcctcttgggcttaagcaatcctcccacctcagcctcctgagtggctaagactacaggtgcatggcaccacacctggctaatttatgcatttttttgtagagatggggttttgccacgttgcccaggctgatctgtgtgtctttttaagtcccattcagtaccatgtctgttgctcacttacaagatttatgattcttttcagtttgcatcttcataaactgagaaaacagaaattggcctaacagggcctctaggacatccttcaagtgagccacagtagagtctggtacaatgctgaaatcttctcctactgctgggtgccctgtgccaccctgcaggtgtggctcttgcccaggtgtgtgtgcgggtagggagtttcgtgctgtaggtacacaggaggtgcaggatgttggtgcaggtcagcttgtttagcagtggcaggatcggctctcaggctggggctccgggagctgctgccttgggcagctgctgccccgcagttgtcttggagacccccccatagccaaaagaggtgacagtggtgcagtggtgactcccttgtggcagctggagtgcccgaggccagagccgctttccctgctgcccgtgccacagcctcagggcctgcccgtctccagtgtccccactcatgcaccagggagaagaggggaggccgccaggagccagtggctcagctcatgattcaccaggtggaggagccaccgctgaggatgctgctggttacctcgatagaggttaaagcccatgaagatggacaagtctataatttaacaaagagaagagaaaacagcctgttactctgcagaaagtaactctttggcatgtgcactgaaggaattacctgttacaggagtatagcagagggtgagaccctcttgagctcggcagaccgtggtgcccatgcacctgtgctggcaagtgtagcagagcagggccaagcgccagggtgggtggggccgtctggctgtagtgtcgtgggaagagtggctggaaatgcagataggagccaatctctgtaggatgttaaacaggagtactcggatgacctgggttccctgctctgcagggttactaatacctgctagaggcttgttttcaagccctgaaagatgggtgtcagtattcccattttacagaagaaactgagtcagaccaagtggtttacccaaggtcacacagctagtaaatggcacagttggaatttgaaccagccagtgtttcatctgctatattatgccatattatgcttgcgttctctctgaaaggacaaaactctcacatgaaacaatgaagacactcaatgtggtgttcactattaggttgaaccacatgcaggtgccatttttgtaggtcaatgtggtcaattatcagcagtgtcccatgggtcagcctaatacagcagcagccggggttcggacagggaaacctctctgcgcaggaatggtcagtagaggtttcatggcggagctgggaatggagcagggccttgaaggctctgtagactctggatggatagaaatgaggtgggagaggctgggtgcggtggctcacgtctgtaatcccagcacattgagagtgcgaggcgggcagatcacttgaggtcaggaattcaagactagcctcaccaacatggtgaaaccccgtctctactaaaaatacaaaaatttgccaggtgtggttgcgcatgcctgtaatcccagctactcaggaggctgaggcacaagaatcacttgaacacgggaggtggagtttgcagtgagctgagattgtgccagtgcacttcagcttgggcgacagagcaagactccatctcaaacaaaaaaaaaaaaagagagagaaagaaatgaggctggagaggttgggtgagaggtggagtggtaaggagacagcccaaagggcaggtgctacgtggctgtcgatcagggtgtacatgtgaccttggagcaccaggaggtgattgcaggtaacgcttggggcctggagacccctcccatgcagcagacagggtgggatttggcctgcagctcgctctgctggtccccactgtgctgtttctgtaggaaacaggtgagcagattgccatcaagcagtgccggcaggagctcagcccccggaaccgagagcggtggtgcctggagatccagatcatgagaaggtgagggcctcgcgcatagggacccaagggaaagctggagcagcagcccccggtgtgtctagaaaggagagtcttgctgggtgcgtggctcacgcctgtaatcctagcactttggaaggccaaggcgggcagatcacgaggtcaggagactgagaccatcctggctaacatggtgaaaccccgtctctactaaaaatacaaaaaattagccgggcatgggtgggcgcctgtagtcccagctacagagaacaccagggaagggggaagggcatgctgcacactctgctgggattactccaatgacaaggaaaccccgtctctactaaaaatacaaaaaattagccgggcatggtggcgggcgctgtagtctcagccgctcgggtggctgaggcaggagaatggcgtgaacccaggaggcggagcttgcagtgagccgagatcaagccactgcactccagcctgggcaacagagcgagactccgtctaaaaaaaagagaagagagtcttaaatatctgcccctccatcagggcgccagcctggcagtctccacggtgactctgctgcttctaaagacaccagaggaagagcagctaaagtccacactgggccttgtcaagggctgttcatcaatttcattgtattaaataagttaacacagttatcacagtgacttttcttttgtcagcaaaaaaagccttctttcctcctatatttccagttccaaggtggtatgtgaccgttctctgctgtcatgctgtcgctgacatttattcctctagtgtggagacggggctgtccatctgcctggtggctgctgaccccctagctagtgaggcgtgaggtgggctccgaaagagccagtgaggaggacaccaagcaggggctcctctgccagcctcttaaaaagaggaggtgctatttggttatgtcatggttccatttggttacatgagttccttctcagacccttctctgtgtgtccaccttggggtgatgtgtgtgcgtgaaccaacctgccgaaaattaaacagacaaaagaaaaaaaatatgaaaacaaaaagagcaggcaccaccttgtttgcctgcttgcgtgtgtgacacatcctccccatgtggagggcatgagattgaaaggtccttgtaggagcagtttggcagcacgatgaggacttgggatgtggcacgcacaaaaaactgaagttacacgcagttgtgccctcagggtctgagttctggtgctgtgagtggggctgggtgagcgccactgacccaggcattgcggttggccacccgtcctgggctctgtcttcctctgtttcaaagccctgggttatcctgggcctttgttgctgagacctggtgggggtggtggggatgggtctgggcaggagcctgggtctgctctcatcggttttcctcctcctaggctgacccaccccaatgtggtggctgcccgagatgtccctgaggggatgcagaacttggcgcccaatgacctgcccctgctggccatggagtactgccaaggaggagatctccggaaggtgaggctcccacggctgccaggtgcacagcctgtctgggcaggtgggacaccaggaagagggatggggagacctttcacttctgtcatcatcaggaagcttggggagccccagtgactccagcagggctgctttgcctctcagatcctctgttccctgcccacctggggctggtgtgtgtgtgagtcagaggcgcttccgagaacaccagggaaggggtaagggcgtgctgcacactctgctgggattactccaatgacaaggaaaactcatcacaggtctgggcgtggggaaggactgggcaagttccaaaacaaatgcttcctccctgggcatgttagggccacgttaggcctttggtgccagtgccactgctctccttattaggagggattttattctagagatgggacagcaccacacacgggggcagggagcatagcagagagggagcaggattcatgatcagagagccgggccagggctgcagacccgccccaatccatccgatccacctgacccacctggactcatctgtggggctctattctccaccttctcaccacaccacctcctcttccctagaatgttcacttctggtgggtggatggcagcccctcctggtctcaggggcagttgggtgccctcctccccattgttccctatgacagtaccacacagcctgctagtacatgttacctcattcgatttccaaaagctcacacatgggtgcacaggtatggttcccacatgatgggtggatgtcatggcccagagaggttgggcctcacacagctgtagcagcagagcctgggtcccagcccacacagacccagctgcaggccacctctccatctctgaggctgaataaggccatataacattatgaaaactggaagctctgaacaaaataatttttttttttgagacaagagtctcgctgtattgcccaggctggagtgcagtggcgtgatctcggctcactgtaacctccatctcctgggtccacgtgattctcctgcctcaccctcccgagtagctgggattataggcgcccgcccccacgcctggctaatttttgtatttttagtagaggcagggtttcgccacatcagccaggctggtctccaactcctgacttcaaatgatcacccacctcaggctcccaaagtgctgggattacaggtgtgagccactgcgcccagccaacaacaatttttattttaattgaaaaagaggtcggttgctctgcgagtgcacctcttcactccagaagggtcacaatagtgggggcgggagcccaggcgtttattcctgttcagtggccattcccagacacacttcaggtgctgttctcactgttcctccaggcccttgtgcctcttaaaaaaaaatttttttttccactttggaaagctgagacaggagaatagcttgaggccaggagtttgagaccagcctgggcaacataccaaggccctgtctcctcaaaaaataaaaaatgaaaaattagccagatgtggtggtgtgcgcttgtggtccctactactttggaggctggggtgggaggatggcttaagcctgggaggttgaggctacggtgagctatgattgtgccactgcatgccagcctgggtgacagagcaagactcagtctcaagaaaaaagataatcctgtctcagaacaaagagacagataaataaaataaaagaaactttccatggggcttggcgtgctggagtggctctccctggagataggcatgtcctgggagtggcactcacagcaggatatgaacacagcccttggcatcacccacaatgagagatgggggaactcaacagcacttcgattttctccttatttttctaacctttgacagtcacccattactaactgcagctgtgtagagataaagccatgttgtagtcaagtggagacttctcagagggcagtctggaagtaggtgggatgtggccagattacagagggctctgaagtgaggcagaggcttttagacttggtcttttaggtggcaaagagccaacgagccagggaagaagagatcgaaagtttaacatgactggcctggcgtgggttgcaggatgattgagggggaggcaggaagggctcgcatcctaagggacccctgtccttgctgtcacccagcggggttgggggaggacactgttgcccagtgtcttgttatgtgttgtttcctttgttccctctaaaaagttcaaatctataatacacccgtgggcatggagaggcaggcttggccagcacatggggacatgtaagagtcgatgttaaaagtctacatgctgggtacgtaaacagatgagtgtttatgaatatgacgtgaattccaatggtgaggctcagatgggaagctcctctctccgccctcctcggaggccagctcccagcagcacacagagcctcttgacagtcgagggggccaggaaggcaggggattaagggcttgggcttgagtttcagattgacctggcgccgcattccagcactgccctctcacagctgtgtgagctgacaggtatccgaccgtgtaacctcagtttcctcctccaacacggggattccacccgtacttactcagtggtggtggttagtattaaatgaggtcacgcagggaaggctttgctgagctaatctgtgcagagctcttccggcccctggcacgtagtaagtgctcagtaactgttctctactgttaccatcacccacatggctaggagatggcagggcggtggtcggagggtggtatccagtcatgccctcccagcctggcccgtctctaggactctcatgcacagagaattcctatttcctgtgcttagacttcagcctgccttgctcagaactgcagcagctggtgagaatcaaactttactcacctcagaggccccttgctgtgaggatgtgagagccctggggtggtcaggactgcttcctctttctcctcctcctcctcctccggccaatccctgctagttctgcagccctggcttcctcaaaagcaggtcccctaaagaccagggcccagggtcagcactctggtcacatgggctggtaagagacatgtgtggatttccggtggtttgtgaccaccagctctgatgctgcttttcactttcttgacagtacctgaaccagtttgagaactgctgtggtctgcgggaaggtgccatcctcaccttgctgagtgacattggtaaatcccagtcccggaattcaggccgtgtccttcagggagagtgtggtgcccctgtgagtccctgcggagccctgcaggcagacacttcaatcctttggtctctgtggaaggggaatgggagcccagggacgggggaccctggtggagtagggaggtcaacaaggagtcagccagacagatgctgaactcaaataggtttcccttccttcctgattaactcatcaggtgaattatgatgtatagggaataacagatttcctttcccattataaagctcccctccctcctttcctggaatggccggcgctggaataagttgtcattcgaatgagttttgtcccttggcagtgaatttttccgctcccacgtaggcagttctttgccaatgagaggcgtaggaaaaactgtcctttttaatcccttgggtactgttggcttccccaaatgagggcatctgcggcaccctctgagaaggccaagctggccattcatggagaagagtgacctcagcctgcagaggtcagtggagcctcctagaccctggcgctcactcaggaggggtctgagggctgggcgctaaaggtcagcacctggccccagcctggggagacagggagagggacttgctcagagctttttgttttttttaaaaaataatctccagggttgttggtgcaagttgatagttggggtctaaggtttagagttatcagaatttatctttgactctttgcctccagatttggagaatgatgccattttcatccctccactacctcaacctttcaaagctgtatacattttttctttttgtttgctcaagtttttttggaaaattgtcaaatatatagaaaagttaaaagagtagtacagcaaaactcacataccgttcccctcggttcaccagatgttaacattctccctcatttgtaaagctgtcttctctaagccagggcctggaagggttgatggtccaacactgtcttgctagtgtgggtctggtctcttcctgactgctgcttttgacagaggagaagcaagaaggaaaggaaggggaaaagtcaagcaatgacatatttaaggttaagatccaaatagtctgacacagaaaattcccatcttgctctgtgctgtgtcttcgtccctttgggtggagttcacatggaggatacgttgacattacatcagttttatttgactcgaatgagcacccagtgctggcccaagggatcccctgcacatggcccgcatgagtctcttctctgtctacctagagcataatccatcagttagaaattccacttgttttcttgacaccctgacccaaggctcacccatccatgttttgcttggaggcttacttgattgtattttttacctcagtggccagattcttcatttgttctctgttgaattgggttgaaggcaggttagcaggttggggagtattctcttgcttttcttgggtgatttttattttgtttctctttggttaaagctttgtcaagttattattttttttttggatgtttttctctcagatatttttctttcactccttaggctgttgatgactttagcaagtagttattacgaaagtcttttttttttttttttttttgagatgatggcttactctgttgcccaggctggtgttgcagtaggcgacctcagctcactgcaacctctgcctcctgggtccaagcgattctcctccatgagcctcctgagtagctgggattacaggagcacaccaccacacctggctaattgttgtatttttagtagagacagggtttcatcatgttggccaggatggtctcgaactcttgacctcaagtgatctgcccatctcagcttcccaaagtgccgagattacaggcatgagccacagcacctggccaaaagtctttaaattattggcacaagtgccgggcgcagtggctcacgcctgcaatcccagcactttggggggctgatgcgggtggatcacaaggtcaggagttcaagaccagcctgaccgagatgctgaaaccccatctctaccaaaaacacaaaaattagctgggcatggtgacgggcgcctgtaatcccagctactcgggaggctgaggcagaaaactgcttgaacccaggaggcggagaggttgcagtaagccgagattgcaccattgcactcccgcctggtgacagagtgagactccatcttgaaaaaaaaaaaaattattggcacaagtgcacataactctcagcttcctcatatggttgtttattctgcaggtgttttgctgctgatattcacagaacctctctggttacgtattcttttggtctgggtccactttgaattcagttactattgacttgtgtggtagcttttatattattttattcaaattgtgtgcatgtatgtatttaagttacacataaattagaataatgaaaacaggtgcttcttcttaagtgcttgtgtgctataggtctcctatagatagataggtaggtgaatattaaattctgtaggttgctgattctctgtctgtcttctctgtgaccctgagttggaaataatttgactttgaagtactaactagtacactacagttaaacttcttgagggcacaaacttcagtcactgcttatcttcagcatctagaatagcagtatataatcttctctataaatatttgtcaaatgagagctggatgcggtggctcacgcctgtaatcccagcactttgggaggcggaagcggacggatcacctgaggtcaggagtttgagactagcctgactaacatggagaaaccccatctgtactaaaaatactaaattaggccagacgcggtggctcacgcctataatcccagcactttgggaggccgaggtgggcagatcacgaggtccggagttcgaggccagcctggccaacatggtgaaaccccgtctctactaaacgtacaaaaaacccaaaaaactaaaaactaaattagccaggtgtggggcatgcctgtaatcccagctactcggggggctgaggcaggagaatcacttgaacccaggaggcagaggttgcagtgagccaagatcgcaccattgcactccagcctgggcaacaagagtgaaactccatctcaaaaaaaaaaaaaaattgtcaaatgaatcaaataaatcctaaaggaaattaaaataagtaaggacctagtttttttttaaaatcaaatgtccacacatcatgaacagctccaggtccaatactggctcctttgcttattagcagtgtgaccgtgggcacgttacttacacccttttattagcggtaaaatgggagcgttactcaccttgttagaattatggaataaaatgaggtgatataaataaagctcctagcacaatgctctgttcctgcagaatgtgcagtcagcaagtgttagttccttgctcatttccttcccgctctggattttgatttttggcctctccttttggaaaccttcagtgccttctttagggcatgacctgaggctggatccagggaaccacacgggtgggtgccttctgagactcccatcctggaagaggccagccttcctcagacctgttcacatctccgccaccttttgggtgcagtgcagccccggttttgtttttgaggctgctgatgagctcgtattttacttttatccctgtttctgatttgtattctaaatccattaaatttctttttgcaaggatctggtgactgagccggagttcatctaacatagctcttttgtattttggaacatttcctgagcatattttgttccagtttgttccaagtgctggcctcacatttcctttgttggagttgccactgctgttctctgccaggttgacttcagataagtggcagagccacacccttgaccgctgggtccggattcattgccttttcttctggattaaactgttggcccctactctcttctgtgccgctaacctcccagagacacccgctcagaacagtgtcaagataacagacatggataggatttttccactgaatttcaaattgcccaagaagaggctgcagagtgcctgtgagaaatgagcagatggccaggcgcggtggctcatgcctagaatctcagcactgtgggaggctgaggcagatggatcacctgaggtcaaaagtttgagaccagcctggccaacatggtgaaaccccatctctactaaaaatacaaaaattatctgggcgtggtggcgtgtgcctgtagtcccagctactcaggagactgaggcaggagaatcacttgaacccgggaggcagaggttgcagtgagccgagatcgcgccattgcactccagcctggcaacaagagcgagactctgtctcaaaaaaaaaagaaaaaagaatgagcagctgcctggcgggcacagaggtgagccccctgcatcctggccaggactcttctgccagaccatcactccatgctgataggagacctgggacccatgtggagcagctggaaatgatatggactgccacgtaatgtgaccctaaaatagctcaaggaagttatatgtgagtggactctatttaaacagtcttgctcattatcctttggaaaacattggcatgtgttttcttttgtcaagggaggctcaaaattctgggcactcaagattgcagggcaggctgtggtgctctctcctgcctgatggggtgtggctctgctgggcgggcctgggtcttatcagatcttagattggaatcagcctttcctggattctgcaggtggccagtctgctgtggtgacaccatcctgtgctccaggcctttcgggaacccacccctctgttgctgtccctgcttccttctcgagctgctcctagcaggcatccaggacttcagcgttaaagaacagagggtttcagagaaaacatttggctttggggaagagagctccattccaggaactgcacatcaggtgcactgtctagcattgtggatcttctgactggttccattgcatgcatccatctgactgaagtgtggattatagcaaaagatcatttgcacataaagctttttggaaagcataagtaaccaggttaataaatacagtaacaatgagagagaagacagcaggccctcagtcatggctccaccattttatagctctagagccttgggcgaggcatggaatgtcatggccgcagcgtccccttctttaggatgaggggtttggacctccgagtgctctctagggccccgtctccctctaacaactccatttcactgtccagaaatctggttttcaggatggtggccccgggacatctctgacatccgccagctggtggcctaactgcttcccacaggctctgtgtctcatctccactgcctgcccctgcattcgcctgtccgtccttccctccctgcccctgcgctggctgcccgctgctcctcgacgttctgtttccctggccgttcttgtggcctgtttctcaccatattgttcccagaatctggaattcaaccctgaactcatcctaaagtcatatccatgtctgccaggtctttcttccaaagtcaattccagtagaagctctggttgtcttcttcagccaggtccctcctgccatcccctttcttgtgtcatggtgccactttctgcccgctgcccaggaccaagtgtccgtgtcgaacctggtctcacagagtcagcccccgctcctgctcatagccttgcattacggaggctgcagaccgctgcttctgctgattcaatgtcagagcaaatccctgcagcgacctcctccctggcctccttaaccctgtgtgctaacctacccttctgtcttggaagggcacttccatcacagtccactcttagataaaggcccagccccttcgccgtacctttctcccactcagccctgggcatgacccacaggacccacccgccaacctctgtgtgtgacccttggaacccacccgccagcctccaggcgtgaccctcagaacccacccgccaatctctgtgtatgacccacagaacccacctgccagcctctgtgtgtgacccgcagaacccacctgccagcttctgggcatgatcctcggaacccacctgccaacctctgcacgtgacccacagaacctacccgccagcctccgtgcgtgattccaaacccacctgtcccttgctggccttgcacgcgttgccccttgtggaagctgttcttgcacctcccagagaccctgagcctgcccgtcctttgggcacagctgcagacctgcccctctgtggggattgcctggcctggggtcacggggattttcctgtgggtctttctgctgatgtcacctcatttgctcctttgacgcttggcattgccattactgctctgtgatttctgtctgtgccttggcagtgagggctgacttccgggtttggggccagttgaccagactgtgcaggaagttaggaaaaggctttgattcagtggcatgtttcccattgtgtgcagatagtggacactcaatagagcctcgctgagtgaattagtgaagttgtcgcactttcgccttggcacccaacgttactgccttgctgcctcactgattaattgaaggctattttagccaagtaacctttagccagactcagtctctctccccatgtccacagctggccttcaagtctgttttttttgggaagcccagtgacattgaagtggctggcacagtaggacccaggcagtaggttttactgagggaacggacatcctgttgcctttctcactcagtgatgacttggattaccagccagttgacaaccaaccatctttgtacccttctaacctctatctcagccttttggaccatttctctttccacctgttctctatggaatgtagctcaaacaaaaatgttctgaagggaacttagtcatccctctaaacttgtgatagatagagattcatggacccacccttataaaactgctttcttctcggaagtcttgctgctcttatctgttccccagtttgtggtttgtcatctgaaaaaaatacatagggctgtggggctgtgattcggagctgtgattcatcaataagacccacaggattgtcagcgttcttcagttatgtgtttgtgccttcctcatgagccagggaaaggctggggttaccaccggggcacggcttctgaggagggtgagagaaggaggctgttatcttcctatggcaagtctgccatgtggacccattctgtggaaatgtactgtgtcatttatcttagtttttgtgtttttcctgcatacactgcactgtgtcgtttattttagtttttgcatttttctagaggcagggtcttgctctgttgtccgggctagagtgcagtggcacgatcatgtttcaccgcagccttgaattcctgggctcaagtgatcctctcacctcagtctcccacgtagctgggatgaaggcatgcgccaccatgcctggctaattaaaatttttttttttgtagagacagggtcttgctatattgcccaggctggtctcaaactcttggcctcaagggatcctcctccctcggcctccgaaagtgctgggattacaggtgtgagccaccatgcctggcctcactgtgtagttgtgaatagcttaatagtttgcaatgtggtgcttctcacagctcttctctgtaatgggaacatgaaaaattacctggtacagttttatgctttgtggtgtggcttttaatttttataaacatgtcttactgctattgccagggatttagatttttaataaacttccagattcaacagtatttttcttcatctcaatgtctcatttttcatcaaatttaaacaaagttagattctctgggcttgaaacaattttgattcatttcactttagctctgaagtactgttttgtaaaatgtagcacagtgatactgaaccaagctttttgaaagcttattctctgcagggtacatttaagaggacttgcctatcagaatttttacatttcagtcccagaaactatgtgtaacaatacctgttggattctttaaatctggactttattaagttgacagaggtattgaagaatagatgaccaccccgaaatgaggaataaagtttgttttgtacagttgtttaagcataaaaatagacagatattaatagtagtcagagtattcagttaccaacctcttgtccctcctcactgaagatctggtgacaactctaatccacgtggcgtagagagcggtgcctttggtctaatccgaatgctcctcctcttcactggggggttctggggacatctcacctggttgtgccctgggttttgccctgagatgttagcctccagctctgggggccttgtctcagtctgggcatgtgtacttgctcaaattacagtatctcaacttccatatattctgctttggaaaaaactaacctacacttttatgtattacatcctgatactctccagcagtctgtcatataccaaaacaggtcttttgtgaacctatcagttaacagacactttgagttattgcatggccttgctctctgccagccagtagttcatattcaacagcagtgccatccctgtctgcaaggctgtgttagtgcagctattttttatacttcatttaatttattatgctttttcatttgctttgatttttaataaaagtaaaacaaaaataaaagtgctgatgagaagcattggtcttgaaacattaacacaattgagaacaagatgaaatataattttttaggcacatggaaagcagcgagtctttcacctcatctggacattaattggacctaagctgatctactctgtcacttaggaaggaaatgaaaagtaaggaacagtatgatatgttggaaccacatggtcgaaggctggacttaaaagagcagatgcaaggagagatctggcaccacagatagagcatccctaatcccaaagtccaaaatctaaagggctgtaaaatctgaaggtttttgtacactgacatgatgccagaagtggaaaattccacacttaagtacttaacacattgttccatgcacaaaattattaagactattgtataaaattaccatcagactataaaatcatttataaaaattcagttgtttcatataaggtatatatgaaacaaatgaattttgtgtttaagcttgggttcattaggaatatgccagtattccaaaatccaaaaaaaaaaaaactgatcccaagcattttggataagagatactcatcatgtatagcttaatgttctgagctggaactcctttaataaggtggaagtcagttgttcagctctcagtttgactcttaaatatgttttcagcaaatgttcagcttagagtctttgcagagaatgtttgcttactcagtttctgtggaaggcttttccgttaccctgcacagagggccgtacccatgacagcagataggatcgctgcctgggcctcaggggtcttcccctccccggcttgccgagagggagagagagagagagagagagagagagagaatgagagagagagagagagagagagagaatgagagagagagagagaggagagagaatgagagagagaatgagagagaaacagagagaatgagaatggtggtggcggcgacggcatacagagggttcattgttaaacctctgaatgttactgcttttgactttttaagttttaaacaagaaacaggtcataccattaactatccctctgagtcagaaaatatagacccaagagttgcctgttctaatgtggcactaccataatttgttctaacatttcctaatgactgtctgtttctaattatttcattcaagatatgcagtaagtatccttgggctaccagtgaagtgataccatttgtatctcttcttctgtgctttctcaccacttgacattctttgcccatttttctttttctttttctttttttttttaggtagagtcttactctgtcacccaggttggagtgcagtggccatgatctcggctcactgcaacctctgcctcctgggttcaagcaattctcctgcctcagcctcccgagtagctgggattacaggggcatgccaccacacccagctaatttttttgtatttttagtagatacagggtctcaccatgttggccaagctggtcttgaactcctgacctcaggtgattcgcccacgttggcctcccaaagtgttgggattacaggcgtgagccaccgcgcccagccccatttttcttctgcattgctttcttattgatttataagagctttttatctattaggtatctttactctttggtgtatgtgttgtagatattgtttccccacctctcttatcttttggctttgtttatagtatcttttgccataaactttgaaaaccttttaatgttatttgcactgttctatttataccatgtgactttcctgcatacactgctctttttgctacatgtatcccatggtgttttggagtttttgttgctaatgtgaatgggattttttttcctttccactgcaactggatatagctaacatagagaaaagctattgacttgtgtattcttgttcgtttccagacaactggctaaattttatccagtgtttagtctgttgagctctctaggctacatctccaaatctatctccatctctagtcatagcatctccaaataaaaataattttatctcatttcagtactatttatttcatttctttcttttatagtgcagtgaactagatgtctgtcaaagttattcaccctctcttgagggtaaaatcatgtccttcttgccatctgagctgcaggcgggtgcctcctcatgtgacatcatcacgttgcctcctcacagcagaagctcttggtatcaaatgcttccgtagccagtgttgtgcagtctgctttcttccaactagattctgagctctttaaagttggggatcatgccccttattttatgtccctcacagaacctcccagagaactgggcatgtagtaagtctgtgtagggctgtctgtatgtgtgggaggtgtccctgttctcctcttctgcctccccgctgcttcctggaagccagttctgacctcttgggactgtcgatcatatgaccataggactctgtccccaagggcccttcctccttgcccaccctatagaatttagatttttgagcctctagaccaaagaaacttcccttctcaaaactttattggcgtcagcatcacctggagagtttgttaacacagatcgtggggtcatccccagagacttgaatccagaggtctcaggtggagcccgagaatttcacattttgaacaagcttgtttgctgctggtccaggtagtatagtttgagaagcactgctctaggctgcagttggtgacctcatggatgcaaggcaaagagtgctttgcgcaagtaagccagattcctgtggaagtttaagcctcacgtagcagggcccctgccctccaccctgaggtattgcgctacaagtcagagtatgtttcaggggcatgcggcatttatcttttgcaggataggagattctgtcatgaaaagcattttttaggcctaagaaaaactcacccccctcttcctcagcctctgcgcttagataccttcatgaaaacagaatcatccatcgggatctaaagccagaaaacatcgtcctgcagcaaggagaacagagggtaagtgacctcctgggactgggaaagcctcaggtgggcgtgccgggaagtggcctgggaggaaaggagcacactctgcatatttgtgtgtatttgcatttccttgcctgtgctttgattctctgggaatgctgtttgatttgaaacaaaattgagcaaaaaagttgttgcagattgaggcaagtttaaatggattacattgttagttgctcaagttgcaggaatctgataaggaaaataatgtttgccttcctacctccacccctagcctctgggactagcgcttcttggaagtcgactttttgttttccatttgctttaagagcctcgcctctcgactctaaatggaaaccagtggtcagttggttgtggatgtggctgggaagaggcactgggagctggcctctgctgccaagcctggtccagcctatagtttccccagagctctttgtggcctcctcagtggccacccggctcagacgtggtgttgactgccccacaagcttgacattgtggtctttacccacccactctatgtgttcagctggggtggtgagcacaggctcagctgagtggaatacagtgaatgagttcttagatcacctaatcccttcccatacagctgcccttagcacctaggcctggcctgtgactaccacagggctcgcccttgttccagttcaccctcactcctgtcagtggtgctcagatttgagaactgagggcatttactgagaagaggctggcccggtccttcctgtttcaagtctgggtttagctgtcttgagggctggtgcctgttctgttcattcagcttccctctgatgatgcgtggcagagtgtgggaggacacgtgcctagcatttttacaatatgccttttcttttagccctgaatctaccgtgtcgagggcattcttttgtgtatctggtggctcttaggagtttgggatctaatagtacctgggaattcagaaatacctctgctctaacaccaggcagtcagaatcctcgtagaaggacattgtgttcttataaccctcagctttctccttccttttgttttagttaatacacaaaattattgacctaggatatgccaaggagctggatcagggcagtctttgcacatcattcgtggggaccctgcagtacctggtaagaagtgggccttgcctgtttgcctgtcagctcctccctgctgctgcatttgtggggctcctgtcctgccttgctcccagcacctgagtcccaccggctctctgaatgttttggagatgcatgaggtcacacccataacctggtcgagtcagcattttttgccaccagatgccctgtggagggatgtggtcgtcttctctgatgtccggagggctctgctcatgcgccttgcaccatcccctagcctctctgtgcttcagtgtcttctctgaaaggaaagggttttaaacagatccatgctggtcttgagcggtcctcccacctcagcctcctgagcagctaggactacaggcaggagccactgagcctggccgaggccacactttccatgaggtatttcaggggccactgagtaggggtcagagctctgagctccccaccctttgtttacgttatttggtctgaatattaggtttctgtttgagtcactcattcattcaagcatattgatggagtgtagtctgtgtcaggcactgtgctcagggctggtgatgcagtggggaaaaaagacaagcccttttcggccttcagagcttagggtttagcaggaaagcaagcattactgtgatgcttacacagataactaagaaattacagttgtggtgagtgttacaaagcaagagtgcagggtgttgcaagaatatatattgggtggcctcagcctggtctgggacttgaagggtaaggaggtgaaaagggctggaggtgggggacggcagggggaattccgtgcaaagggatcacacacaggaagacctgcaggtgtggctggaaccgagcacaaaagggaaagagagtcttgagttgaagctgagaacaaggtagagcacagattatgaagggccttcagggctgggctaaagttctagactttatcttaaaacctctgcagagattgatgggttttaagtgggagaaggagcaactctttggaaagcccactcctgacactgtgtggagaaggaatcacactgaacaggagggaaaagtgggtgaggtaggggcagtgaagatgtagagggcaattagattccaggagggcttagcacaaatgcccagcaagacttgtcataggttgcttgatgatggcagtagccaccacaattgggagtgactcaaggagtctgcggctttcagagtgggtctcacagagggctgtgattcaggcgcctgtgtccatatggcatgtgatttggtagatccttctggagtcctcctcagctcagcagcagtcgagcaagggggaccccatgctctaaccaggagctgagtcaagtcatgtactcacatgagctaaaacttctgcccataaccagacatagaggttgacctacccatcccggaatgtcttctcttggtttggtctcccgggcccttccttaagcttcacatttccaaccagaccatgcaccaccctgtctctgtgcttttgcttgccccagtcatttctgtctccacccacctgctaagcccagtctgcacccccagcaccccgtgctgccgccccttcttcggtcaccccagcgctctctgcctcagcagcagccatgcatcacactttccctgcctgtttctaaatatcctggccctttctgcaaccacatggtacctggttcaggggttcaaccagcacttaatgcgtgtatttggtgtggacagcctggcatcattttcctttaacatttgtagcctctcttcccatttctacacagtgcccacgactgtgtcctgccttaagctagttttcaataagcgcctgaaatgctgcaaccctttttttttttttccttttttttctttctttctttcttttttttttttagacagagtctcactctgttgcccaggctggagtgcagtggcatgatcttggctcactgcaacctccacttcccaggttcaagcgattcttgtgcctcagcctcctgaatagctgggactaaaggtgcacaccaccatgcccagctaatttttgtatttttagtagagacggggtttcaccatgttggccaggctggtctcaaactcctgacctcaagtaatgcgcctacctcggcctcccaaagtgctgggattacacgtgtgagccactgcgtccagcctgcaaccctcagttttaaaggagagaagttaaagcctagcgatgggtgtgtgatgtactctggccctgaatctttagcccctccatcagtacctactggagtgagtgggacatagaaaggtcttagaaatggtagcatgatatacccgctaaacatgcctggggtgccctcctcgccctgcatgcatgtgccagtgccctctaggatgaagccaggggtgaaagcagatgggctggccgccccctcctgccgtggtccccccagagaggagcagctcaggtgtaccccctcctgttgctgcaggccccagagctactggagcagcagaagtacacagtgaccgtcgactactggagcttcggcaccctggcctttgagtgcatcacgggcttccggcccttcctccccaactggcagcccgtgcagtggtgagtgggcccggggcacctggatggaggagggagcctgtctgttcctttctcttcacgtaccctgtttccctggcgccccatcaccgggcctgggagatctgtgttgtttctcttccgagaggaaggcctgtcaggacctagcacgagtaggggagtggtctgtgctccaaggacctgttaatagatagagtagctgttaagtcttcatgtggattctgagccttcacatctttaaatacaatgctgtgtcagtgtcatctgctctgtgttcagaagtaagactattgtatgaatatacgcacttacactgagaatgctgtgtgttagtaaacaaataaaacacgtgtacacatgacaagtcaggaggaaatatgtgaaaatttgttgttgacaaatgttactacaacctgaatataaatttttgtttttaaagcgtaagaatgtggccgggtacagtggctcactcctgtaatcccagcactttgggaggccgaggcaggtggatcagttgaggccagcagttccagaccagcctggccaacatggcaaaaccctgtctctactaaaaaccctagccaggtgtggtggcgggcgcctgtaatcccagctactcggaaggctgaggtgggagaattgcttaaacccaggaggcagaggtcgcatcactgcaatccagcctgggcgacagagtgagactctgtctcaaaacaaaaaaagtttaaaaaaaaaaaaaacaacagctgagcataaagcataagaatgtagctgaaattgtgaacctaataaattacacaaaaatttttccagtaaaaattaaaggatatgatgaagatttgtagaattaccctgtattctttagcttttgttttactgattaaagaaataatgcattgtgcaggatatgtttatataaaagttaattatcaccaccaaaaatggtatgtgaggtaatgtatatggtaattagctcaatgtagccatcccacaatgtgtacatcatgttgtacaggataaatatagaccatttttatttgtcagtttaaatcaagaactgggggcagaaaagaaataaaagttaattattactgaaagccataatttaaaaatgaatattcccccaaatcagttagatttcatttaggattgttccttgagaggccacacactagtttaaatgatgctactctgctcaaaatttacttacttcaagttttattttttttggaaccgtaataagttcatgtggctcaaatttccagaagaataagggagtatgcagtgaagtcataccagcctcccaggccctcatttacctccccacaggcacctgctgtcttccaagaatgttttcatatcttccaaggtgttcgtatcttccaggggtgtttgctacgtgttccagtaaattggcatatatttgtttatttgtacattgatgtttcccctcttttttatcccaatggtagcattatctgaacacggtcctgcacatgctttcaagcttttcacaccatgagaatttctttttgagccaatttatctgcaacacaaaaaattattattttgaacttaaatagtactgcatagtttaattaccccctcatttttgccagattaactttgtttcatttttgtgttttggaaaatatggaaacagtaaaaaagcaggaatcaactgtcatcccataattggaaaacaatcactatgaacagttgtgtgtctccaggctcttcagcgttatatttttgtactttttaaacaaaaataggttactataatcttcatacaacgtgcctttcaaactagatatcaaaaatgctgtatgtttttccttattatttgtaatgtctgttatttcactgaatggctgtgctgtggttcatttaacttatcccccgtggttggaaggacgttgataatttttacttcttaaaataacaccaagaataacatccttgtagggaaattcttgcacacagttgtttccctaggataatacctagaaagggaaataacagattaaagagtttgcacgttgtaaaggtttttgatgcatattagttagcaaactgctcaccaggaaggtcatataaatacacgtctccacctggagtgtggacactgcccctttcaccacatccttgccaacactggctattgtcaccttctggaagtaatgaaaacaaaacatgaatgttttcagaggacaagtgtctacatcttgagagtatttgtttataagaataaagtgggccaggcgtggtggctcatgcctgtaatcccagcagtttgggaggccaagatgggcggatcacctgaggtcgagtttgaggccagcctggccaacatgatgaaaccccatctctgctaaaaatacaaaaattagctgggcatggtggcacacgcctgtaatcccagctacttgggaggctgaaacaggagaatcgctggaacccaggaggcagaggttgtggtgagccaagattgcgctgttgcacttcagtctgggcaacagagcaagactccatcttaccaaaaaaaaaaaaaaagaaaaaagaaaagaaaaaaagaataaagtgtatcctttgaaatcaattccagaaaagtggtcttaggtgatggcagtctgttcaattccacgtttacctcccagtgagggaggtgtctgccctgagttttgagaagtggcaaagtatgccccactatggtgacttattttaaaacaggcattgctcctttagctacataggttctggaatattgaggaatttgttcattaatttatagtcacactttatagtatacgcattataaaaatagctttaaattgcatgtacatctatagtgggtttttttgtttttgtttttgttttttgagacagaatctcgcttttttgcccaggctggagtgtagtggcgcgatcgcggctcactgcaagctccgcctcccgggttcatgccattctcctgcctcagcctcccgagtagctgggactacaggcgcccgccaccacgcctggctaattttttgtatttttagtagagatggggtttcaccgtgttagccaggatggtctcgatctcctgacctcgtgaactgcccgcctcggcctcccaaagtgctgggattacaggcgtgagccaccgcgcccggctgtagtggttttaactaaaggaattattgcatttcttcaggtcacttgttgagcatgtctcttatttatgacaagatgagttaaaatccattagaactagaagaacaggtgctttttgaaaatacattcctaatggcccagcgtcttcataggaaatctgttgtctgcagagccatcttcctagagcttccctcatcagtgctggaggaccaggtggccagtttcaagtagatttctctgaaacccaataaggagctgttttgtggactatctagtttttaatgctttgggaaacttttaaaaaatttcactatcttatctcagatggcaggtaaatagtaatttccagacaaatgcaatttgggctttacaattctattataaagccactttgaaatatattttaggacaagcccaagcaataagcatcttattttgggtccttttctaatttcccatcaacagcctaagttttctagcagaggcttattccacacttacataattagaaagtcttggagcccccgacttagagctgtcagagtttcagcccaagctataaagcaccagcctctgccacgcaccggctcttctagctttccagtgccagtgtgctcccgataggccggttcaccacttgccaatgagaattgtttggagcaaagcattttttatttgaatttcctagatgttttgaggaaaaaccgtagttggacattcagacagaatagaaagaacaccagacattgggtttgagcccctgattctgctactctgttgtgtgaccttggacaaatcatttgatcatcatttcctttagtccaaattgggggactaaaaataatgtctgccacatgggcctgtcacggcaataagtgaataaatgatctgtgtcagagtacttggttatctatgaagtattattcaaatttactcttcttattaccaagatttgaagccatttgtatgtagattatttttactggccgggcactgtggcttacccctataatcctagcactctgtgaggccaaagtgagcgaattgcttgagtccaggagtttcagactagcctaggcaacatggtaaaaccccgtctctacaaaaaatacaaaaatttgctgggtgtggtggcgcacaccagtagtcccagctactcaggaggctgaggagggaggattgcttgagcctacaaggtcgaggctgcagtaagttatgattgtgccactgcattccagcctgggcgacagaaaaaaaaaatttttttaccttcagatactacttcacataccccaagaagttccctaagttgggaaatgtataagttcatttatccttagtatttagctgtgtacatttagagggaagtatctatgtgtgtgcgtaggttttgcatattttatgtaaatgtcgtatgcatgctgtaatctaggtttggaagtcctaattttaacctctgtcaaaacacaagagtgtgtaatagatgaaatagaaggtagagcaagggagaaggaaaagccaaggatgagataaggaggcagtggtactatctgcagaactctgggcacaagatggtcagtgactctgctaaaggttgctcttcaaaaactcatccaggcagtcctgaccagtcttaaactctcaaagaatctgcctgactcgatgtgaatgaactgactgctattccaaaagactggggctataagtctcctgtatagttgtaaacttatattacaaatgtaaaatggctcttgagtgctaagtgtcgtagggatatgtatgactgtatatttcattgacatcccagtcaacaattgactgcatagatgacagtggtctcatgagattataatactgtatttttactgtaccttttctgggtttagatatgtttagatacaccaatacttaccattgtgttaccctggcctacagtattcagtaccggagcatgctgtacaggtttgtagcctaggagcaatagggtgtacgatacagcctaggtctgtagtaggctaaaccatctaggtttgtgttatgttcacacaaggactaaaatcacctaatgacgaatttcttagaatgtgtccccgtcatagcaacgtgtgactgcacctaacaagattcatatttgcaggcattcaaaagtgcggcagaagagtgaggtggacattgttgttagcgaagacttgaatggaacggtgaagttttcaagctctttaccctaccccaataatcttaacaggtaaggcacagcggcattacacgaatacatatctttcttgctttttttagaaatacaagtcttggctggccgtggtggctcacacctgtaatcctaacagtttgggaggctgaggcaggtggatcacctgaggtcaggagttcaagaccagcctggccaacatggtgaaaccccgtctctactaaaaatgcaaaaattagccaggagtggtagcacgcacctgtaatcccagctactcaggaggctaaggcaggagaatcacttgaacccgggaggcaaaggttgcagtgagctgagatcgtgccactgtactgcagcctgggagacagagtgagactccatctcaaaaaaaaaaaaaaagaaaaaagaaattcaagtctgaagtgacatctgataacttttaaacaggctatcaggatatcgtcctgtgactaagaaattaacatagtccttcttaatcttaaatctggaatgggttttcctcccttatctccctagaaatcatctcttttctaagttcacataacaatttatctatacctcttattacccttaatagcctctaccttgtatcacattcggttttgcatagggtttatctctgattcaacagcagtccttttaagggtagggaattataccttatttctctttccacccctcatgtggcccaattctgtgtcacagtcaacaaataaatctttgtcatttgaatggcattacaatccagtctcagagccagaatctaaacaattaataatattgtataattgtacagaattgggtaacagtgcaaaagaaagctacaaggcagtcacacataattgagtgacatggataatgattaccatatttagagggtggaagagatgattggatggattagtgctatatggaatgacgtgggataagctagaactttttggaagggtctagacagatgtacaggacatggatagatgaagagaaaggaggaaggaaattctaaggggaaagattgaggtgagcaaggcacgtttgggaggtggtgagtagctgtgttggcctcagggaagggtttgagtgctcacaggaggcaggctctgcagggccaggggaaggagtttggagtttgtcatgtgaaccgctatatctggcagcatgggatctagattctgtaggggtcacctaagctaggatgtgcctataaagtgtatttttaaaacctcatgggttattctttttccccttctttcttcctttctttttaagacagagtctccctcttgtcacccaggctagagtgcagtgtggcacagtcttggctcactgcaatctctgcctcccaagttcaagggattctcccgtctcagcctcccgagtagctgggattacaggtgtgcatcaccacgcctggctaatttttgtgtttttagtagagatggggtttcaccatgttggccaggctggtctcaaactcctgacctcaagtgatccacctgctttggcctccccaaagtgtgggattacaggcatgagccactgtgcccggctctcatgggtcattcttatgcagccatttggaggtcagcaatctctgatttgggggtattttagaattcaggagagaggtgtgaacacctgaataattgattggaaatgtttatactgtttctgataaacccattttcattttcaatcaccgtctactggctgccgtctgtgtgtatactgggagacgcacactgtagcccaacattggctggaagtgtctcctcacacactatgctcctctccacagtgtcctggctgagcgactggagaagtggctgcaactgatgctgatgtggcacccccgacagaggggcacggatcccacgtatgggcccaatggctgcttcaaggccctggatgacatcttaaacttaaaggtgagtgtggagccaagttagccctgaggcaaaagctggggtccccagtggaacatgcagttcttaggacagagcaggggatggggccagctgacctagtgaggaaatttaggctcctgcatcagtctttctgcataagtaaagaaaggacagttgtgctaattgacattggctatgaggtcatagccacagacaggattatgaaagatgcaaatatgcgaaacatggcacatgacctccctccctcaagctaggcccttgctttgtgtggttgggaaatgttgggagtagcagagagaggacctaggcaaatagatgggcatttccttgaagaaatcggttttccagtaacatctgggttgtgttgcagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaaggtgagccctggcttcgtacacaccatcctgtttaccttggctgtgcctcctgggaaactcaacacactttcagatttcaattctgctttgtcatgtagtctgttaatcacacagtgcggatacctggctggtttttaagttggagtatggtgtcctctgtgtggcctgataggaaacacaaatctccttgctggacttgttacttccaaaccctccaagaccggtctcttgcctttattgcaaaaaatgatgctataacactcgaatctctcaagttgcctgcttggccctcttccaagtgtactaaaaaaaaaaaaaaaaaggatgctgcactttcttgagtcaactgaaagtatttatgatggcctctgtgtacagaactgggttaggcacctgtgttaactatagctgtgtaagacatgacctctgctcaaaaagaccttctcagctgacttgtggagctaaagttatcatatgagaaataatcattgcatagggaagtatatagtgaatttctgaacttcccagggaagacagagagtaaaatagaatgtaatacgtttgtaaataaagagtgtgttcagacagtaagtgtggctggaaacgttaaacacttcatggatgcttcctacttgctggctgaagatgatgctcttgctgaacagtggggaaagctgtggaacttcttcattatcagttagaaaagagagggttggatccacaagattcattttgtccttgtccctttgcagttaaatgagggccacacattggacatggatcttgtttttctctttgacaacagtaaaatcacctatgagactcagatctccccacggccccaacctgaaagtgtcagctgtatccgtaagaatttgttatgttttgtttttctaaataatccgttataatatgtgggacaaggcagggaagggagactggactaaggaagggggagccacgtaaaggaaattaatatcgccagtcctcagggcagccttccttatttaggacatgcaaggagtagccaggcaagagagagtacaggaaaccattagttaatttcaacctcctaggacgggcgtggtggctcacacctgtaatcccagcactttgggaggctgaggcaggaggatcacttgagcccaggagttcaagaccagcctgggtaatatagtaagctcgcaagtctactaaaaatttagaaattagccagatgtggtggtgcatgcctgtagtccagctattcaggaggctgaggcagaaggatcacttgagcctgagagttcaaggctgcagtgagtcatgatcacccccactgcatgccagcctgggtgacaagagcgagaccttgtctcaaaaaaaaaaaaaaaattctgttgaaaatatatggccctatatacatatgtgtccaatggttcgtaaagtgttccttcaaatcaacagctacttattgaccactggtacatgctgttggtacaaatacatgtatgtgacagtaaccaggcataacaccctccaaagttacatgatcctatagtaggtacaaaacgtgaaagtgccagtagtgtcgaaggcaggatatggttaattgtaggagagttattgtggttattctttgacaattgcttgtgtctctgtctccagttcaagagcccaagaggaatctcgccttcttccagctgaggaaggtgtggggccaggtctggcacagcatccagaccctgaaggaagattgcaaccggctgcagcagggacagcgagccgccatgtagcgtgccaggctttttttttaaacttaatttatttaaaattccttggtggctttggccacagggaggtggttgaggcagggacccagaagcaaccgttatgagcaacaaaaggaagacactggtttggatggacgggaagcggttgggtgggctggactgacggaggcccctttagacctggcgaggtgagtgtggttggcacagggtgaggagtgtggaactgaagctgggctggccaagctgtggctggtttgggaacccagaggagctcactaccatgtggattagcaaaactcccctgaccgtgctgctggggacttacggactctttcctcattgtgactcgtttgccaacattattggccttttgtgtcttcctttgcctgatgtcaagtttagtgcagaacctcaggcattgctgagggctaggaaattgtccttgggttataagtggctgctataataatagtgatgatgataataattatagcagggacctcccttgacatttgagggggttttgttattgtacaggaaatggaatttggatcccagagatgctccaagactgttccttgtggtccctgcaggatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcagtgagtgtgcactttgcaatgagtttaaagacaccatttttttttctttttctctttctaaggtttcttttgtcctattataattgagttgcttatttctgtttcagttttgtggtgtttttattttgttttgttttgtttttccttctcaattttttttcagcatcagataaactgctgctggcctggagggaaatggagcaggctgtggagctctgtgggcgggtaggagactcattttgggtttcggaacttaccaagggggtgagattttgtgctcccacttttcactttctcatcaaacactgggtcgatctctgtcaaaaatcaggtgttcctcaccatgctttgagcttaactggaccagctgaaaagaggccaagagagtagccagtgaagggagcccctctgtggccagatgcaagagctgcatgaatggacagagatggtccaggtttaaataagaagcaagggttaggttcccttggggaaaagccaagaccatttcctgttaggaagggcattggattgatgatcaacactccctcttgtcgaaggtttttgactaattttgttgggatgctaaatccataggaaataaaaggtctaggcagaaagtctcagggcagcgtaaatcagatgtcaccaaaaaaagttaattatgaaggcaaaggaaatacatgtgacttaatgaacctcacacaaactgaaggttgaagtcaggctccggggctttttcctggacttatcctctgttttcccctgtgtacttgggcaaggatcttcacctgtgtcttagtatcgatttttatgaatcagtactgatggagtatatgtgtgtttaatggtgaatattaaccatagaagggctgagtgctcctccccatcttgggactcataatctgtgaaataaaacagtctgggcctccctgcccgggtagcatcaggatagacagatgaagagaagagaaagtaatgtgtcttgggcatcttctgtatgccaggcaccatgccagaggctttaagtacttcatcttacttgactcctcagatggccctgttagaagcctattttatgcaaaaggaaactgtagctgggggtaagtaacttgccaaggggtcacacagctagaaagcggtggaccctagatgcaggcgcagccattcagaccccacagtccacattcctttgagccagtccattgagggtcctcagggaatgtggcgggtcccctggtctcgctcccccgcagatcttgcatctcagcatgcgcctaccacatcagttgacattagcacagcttttccattaggagaacgaagtgaaactcctggtagaacggatgatggctctgcagaccgacattgtggacttacagaggagccccatgggccggaagcaggggggaacgctggacgacctgtgagtactggctggggggcccctctgtgcccagcacacacagacagccctggagcttcggtgtgtgtgtcaagggcaccctcagtggctgtgcgggaccattctctagagcatgcttccctgtggggtcacttccagcaaatcatcactgagcttcagtttccaaatctgttcagtgacaagaaaaacagtcttaagtcacgaagttgtaaggatgaattcagataatgcatttgagacgcaggccataatctgtaaaggctgtaaaatgcaagcagcctctacccctgtagcagactcccctgatttgttccacccaccctgactcaggcatagctcagagcagaaagtaaaacagagaaggaagaacctgatgaggcttaggagtttggacctggaaactattcgtttgagtctttgtcaggtatttggcattggctccatgaggggcggaggggtctaggcagatcactcctacctgaaggagatcacatgtgctcctggcgtacagatggagggaaccaggcaggccgcttgagggctgtgtcaccgtgagctcagcagtgttccctgattctctcactaggattcttaggacaggagctccaaatgtcagaactttgattctgtattttctctaattaaccctttattctcctctagttcttttatttgtatttgtattatttttttaagagacagggtcttgccctgttgccaatgctggagtgcagtggcacaatcatagctcactgcagcctcgacctcccaggcttatgcagtcctcccatctcagcctcccaagtaaccgggactacaggcgcatgccaccatgctcagctaatttaaaaaaaaaatgtttttggctgggcacagtggatcacatctgtaatcccagcaccttgggatgccaaggcaagaagattgcttgtgagcccagaagttcgagaccagcctgggcaacatggtgaaactctacctctaccaaaaaaatgtaaaaattagccatatttgacctcaagtctagacagaacttctttgtatattttagagaggagcaagcaagggagctgtacaggagactaagggaaaaacctcgaggtaagtggggttctgtgtctgccttgggcttctccttatctcatttatggggcatcactactctctgctggcttccttgaggaactatgctaccctccctctctccagaccagcgaactgagggtgacagtcaggaaatggtacggctgctgcttcaggcaattcagagcttcgagaagaaagtgcgagtgatctatacgcagctcaggtatgagccccgaccttcctgctctggaggaaggactgggagatgcaggtatgaggtcaccttcctccctcctctctgattcgctggacctcatgaagagagtttctgcagctgctgactggatgcacagctgccacaggttctgctttctccagcccaaatgccattagtttgccatgtttattctttgcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtgtgagtgagtgctgtggtcccgggcccttggcctagcagcctcctgtgcctttccacctctgtgcactgccgccatcccacacgggacaccacagagccaccagcagcccactcagctgctgctcgggcttcacgtcgctgttctttgacttggtgtaagcggggaggtcagaggaagggcctgtgctaattgttttcattcatctgtgtattactttcgtgtggctactgtaaagattagcacaaactgaggggctaaaacaacagaaatttgggctaggcatggtgactcatgcctgtaacgccagcaatttggggaggctgaggtgggaggattgcttgagcccaggagttcaagactgcagtgagctgtgatcatgccactgcactccaacctgggcagcagagctgtctctactaaaaacaaaaacaaacgtgttatctgagctctagagcccaggagttgaaagtcccgtgtcagcagggctgagctccctctgagggctcttggggagggactgtccttgcttcttccagctcctggtggttccaggcgttctttggtgtgtgactccagtctctgtctctgtcttcatgggacccctgtgtcccttatctgggtgactcttacaagaacacttgtcattggatttgagtcccacccaagtagtccagggtgatgtcatctcaggttctctaaagacgctttctccaagtacggtcacactcacaggctccaggagttgggatgtgggcatatccttcttagggccaccaattcagcccaccgtcatgcacggcagtgcaacttggttgaccatcgtctgcgtctgcactgccctcagtgcagtaagccacgctttctgtgcacaccgtcttaacgtagctgtgagtccatgggatgccacatggtggggaaatgggaaacaaaacagccaagaactgagacgggcaggcctggccgtgttgtgggagccagagctgttgggactgcaagccccattgtgaaaggctgcagagaaggtgacatggatgaaagagtgatttaggtgtcagtttcccttaagagcaaagggaaggagagagggagatggttgctcatggtggaagcaggagatggtgcattaggagattctcattgtcaaaggcagaggggacaatccacacacagtgcagagaacagaggggctggggtcgcatgccagagcactgagcatgccttgggagcgtgattgacacatcctcctgtaagaagagaggaacgggagaaaacaggatgacgaggtagagaggatctgaagaggagagggaggtgcaggtatgcgcaggtgatagcctgatgtgccatctacatccattgagcatttactgaatgctaactatatgcccagcaagacacacaggtgagaaggcatggcacctgttcccaggagggcctgatccttcaaggggcacagacagaggcatgagtgagagccgttcagggcaggaagggctaggaagcagctccaggaggcatgagctgcagtttctgtgcacagggggagctccagcttgtcttagaggagagggagcaacaagaaggttcacaaggagctgttccagctgaagagtgaggatgttccaggacagagacactgctttatcaaaggcagagagcctggggagtcagtgtgttctgagtggggacaggctggtgtgtgtggggaaggccacaatggaggatgaagctgctgaggtaggcaagggtgagcttacgtgggccacgcttcattttctttttttttcgagacaaagtctcgctctgtcccttaggctgaagtgcagctgctcaatctcagttcactgcaacctccacctcccgggttcaagtgattctcctgcctcagcctcccaagtagctgggactataggctcatgcccccacacctggctaatttttgtatttttagtggagatggggtttcaccatgttggccaggctggtctcgaactggcctcaagagatctaccccccttggcctcccaaagtgctgggattacaggcatgagccaccgcgcctggcctatgtccattttcaaagcacacaggacacatggcagtatctgtcttttcccttgatattaaaggaacttgagtgtagggatatgatcacatctgggatttggggaagtccctctccaggcagctggaggatctgagtccctggccaacctcagcactgagaagggccgctcagcaaggctggagttgagccgccgctgtgcagcacagaacagggtggggcaggagctggggcagggcctggctgggagggagccaggcagtgcaggagccatcccctgccatactttcggtccagggcagaagcacaggaggccaatgccgggcctctccccaggcatggtcagcagggaaggtgcagcaggaggaccaggaacgggaggcttgggtgcttaacatggcttcttgatgtgtgggccttgaggtttcgctggaggggaggatgtggagccaggatggttccacggcctgagggacacgtgaggggatgaaggactgcaggccgaagtgagtgtcaggtgtggggcctggggggctacatgggtgggttggggaccatgcagggcagagatcagcagaggggtgacctgaagattggccggcggtcgtgggctgtgagctgaggaggctcaggtagctggaatgggaacccctgcttgacccttcgggctgggaggggcagtggctgcagccccttgggagtcagggtgtccttgtttcttctcagccaggtcatagaggatgcaagccacaggaattcccatagcctttgtgtgtgtgtctgtcttctacctggaaaacagtaagaatactttcctgttcttttcttgtaaaagttcattaaggggctggatgcagtggatcatgaatcccagaactttgggaggctgaggcagatcacctgaggtcaggagttcgagaccagcctggccaatatggtgaaacaccgtctctactaaaaatacaaaaattagctgggtgtagtggcacacacctgtaatcccagctacttgggaagctgaggcaggagaatcgcttaaaccccggaggtggaggttgcagtgagccaagatcgcacatcgcacttcagcccaggcgacagagcaagactctcaatcataatcaatcagtaaagctgatgaaaataaaaaagcctgcaaattaatgtaggcacccaggtctccttaaatttagaatcctttcctcaaaagtctccgttgatacagaaacacttttgaagccagatgtgaagcaccagttgacccgcaggtgggggtgccaactggtaggctgtagggttagctctggcctctggcagccagccagttgtctcctaagaaaatactgtggcgtgaatgcaaaatgtgattcatcacttggctcctaatttcttttgattttgtcccctagagcaaggtccgtggtcctgtcagtggaagcccggatagcatgaatgcctctcgacttagccagcctgggcagctgatgtctcagccctccacggcctccaacagcttacctgagccagccaagaagaggtaggtcctccttagcagtgccaagtgtgaccatcaagggcacgtcaggagatcggggatggaggcgtttgtcactggtaaatgtctgtctgatggtattaccacctctctggatgtttgttgcatctgctgggtcctgtggggacaaaagtgatacatgtttggctctcatagtcccttgaaacttactaactagtttctttgtccaaggcttggatgactaactgcttaatgagaacattggaaatgctggtcaggcacatgctgttaccctttatccataggaagccacattcccttcagggaggccctgaagccctctgcccccactcaccctaccagtaccttgagttaccgagtcaccaccctcctcccggtgccactgaccttcccattcttcccgtcctctccctcctcttgcctgaaccatcgcagcagaggtgggggcagggctttctgcctcctgcctcctgcctttctgctgccaggccctgtgtggttgaattaatcttcacgaaataccactctgaccaaggtgttccttagtcagtcataaataacagcttctccctccattatagatgctcaggtctgagctttcgtcaagtctcatctgggccagcagtgcatcatcaaattctcaggtcctgctggagacctcacttgagagctcagggttggggcccagcagtctgtgtctagcagccctccgcccgttctccagcacactgcaggccacttctgctcccacgcccatctcttcctgtgttttgttttgtttgacaccttctgtgtgcagggctctatgggttcctgcaggctaatctctaggcatgggaaacaccgatgattacctggggcaggggaggaggttgggagtgactgataattcaaggtttcttctgaggatgacgaaaacattctgaaactagatatggtgatggttgcacagctctgtaaatacgcgaaaacccttgaattgtacactttaaatgggtgagctttatggtatataaattatatctcaatacagtctgctttgaagaatcttgttcttgtccttgggagtttgtagcctcttttggtgtttatgtgaccttggatacttaattttctcttggctgtatggcacgcgcttgtaatcctagcactttgggaggccaaggcaggaggttcgcaggagttcgaggcaagtctcctgggcaacatggtgagactgtctctctctctctctttttttttttttttttttttgagacagactcttgctctgttgcccaggctggagtgcagtggcgcgatcttggctcactgcaacctccacctctcaggttcaagtgattcttctgcctcagcctcccgagtagctgggactacaggtgcatgccaccacaaccggctgattttttgtagttttagtagagatggggtttcaccgtattagccaggatggtctcaatctcctgaccttgtgatccacctgcctcagcctcccaaagtgctgggattacaggcatgagccactgcacccagcctttttttttttttttttgaaatggagtttcgctcttgttgcctaggctggagtgctatggcacgatctcagctcacctcaaactcagcctcctgggttcaagcgattctcctgcctcagccttccgagtagctgggattacaggcatgagccaccaggcctggctaattttgtatttttttttttttttgagacggagtctcgctctgttgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaattttgtatttttattagagacagggtttctccagcctgttggtcaggctgatctcgaactcccgaccttgggtgatccgcccgccttggtctcccaaagtgctgggattacaggcgtgagccaccgcacccggccctttttttttttttttttttttaaataaaaattatttccccaacctctcatgagctcctggagtatagtagctagaccgggagcctgttccattcccttctggggcaggcactgagcctttaggctagctagaggccccatagatgaggcttggcagaaatgtgctctgagctcctgccatcagattgtcacattttgcagagtgagaggagttccagggcagtcttcctttatgtggcttattcccttcagtgatgtcctcaaaggtctagaaaggtggacctgggtatataggatgtctctcgtctccccacagcatagagctgaggttagaaaaagacggatgttttactacatgctgctctttttcactgtggcccagtcctcagaggaaacatgggtttcttattatagaaaagagagagatcagattagatgaaaccaaatcccagaacttgattttcaacagattccaaggaactgtgaatcctgataaattccttggccttttttttgtctacttcaaaaattggaaaacaggtgatttggagaatatctttagattttggcagtttgaaaattaaattcagctatctagtaagtcagaaagcagaaagaggtttttttgcttctgacttttattgagatctgtttgcttttttgcattttggacagtaacgctcatatgtggaaagtgcataacaagatgaatgaaagtattagtcagtgggttggtgttttaagacactcaggatcaaaataattgttacttcatttaaaaagtattatcaaaactctctagcatattttaaaatagcagtgttagctctgataactaataatgaccactttctaataatttgatcattttctttagtgaagaactggtggctgaagcacataacctctgcaccctgctagaaaatgccatacaggacactgtgagggaacaagaccagagtttcacggtaacagcttgtgtgagactcctgcgattccatgtcctttctttctatggcaaaatagaagagaaaatggaaatgcaatctggcattatcctcaacctcagtgtttgtttgtttgcttgtttatttgtgacagggtctctctctctcacccaggctggagtgcagtggcatgatcttggctcactgcaacctccgcttcccgggttcaagtgattctcatgcctcagcctcctgagtagctgggactacaggcgtgcgtcaccacattcagctgattttttcagtgtatatttataattttctagtacacattttttattattcataataatagtgatgtctaacaattattgaaggcttacaactacatgtatgcattatcttatttaatccttggaacacttaattccgatgatgaggaagaaggtagcattgttcccagaagcctgtccccacctgcaccattggtactactgctgagtatttgtgtgttgagtgctgggctgggagcaggaaccagccatggccttgtcctcagggccttggagcttagtggtaggtagtactagttatgagaaaactagccaagttacaggtacattaagacaaagcttccattgttgagagaatcctgcatcatttgcttagatctttacatggcctttacctgctaatcacttgctaacctcccctaactttaagcttttggaagaattacaagggataccactgtgaattgcagcctttgctgatgtagtcgcatgtcctcctccagtctgtggacattctatatctcttgctgctctcctcctcctggcatgataatgttttgatcagttcattgcttacttgcatgtctgtgggaggaagaggaagtctcatcaggccaagtcatgtggtgaggctggaaatccataactgagattagctacccacagtgagcatgggagtgagtgctgtgagccacagtggtactgacgtcgactttctaattcccacagtcacagaatctcaaggactctgagccaattcaaagaaaagatcctgtacagtttgaatatgtaacttagcttaagagtaccctgcagtcacaagatttattaataaaagggtttggctttttaatttgtatttgtttaatttatttgttttatgcagcctgggtcttgctatgttgcccaggctggtcttgaactcctggcctcaagcgatccgctcgcctctgcctcccaaagtgctggaactataggcatgagccaccatacccagccaataaaggggtttcaatatatttctttttattttttattttttgagatggagtcttgctcttttgcccagggtggagtgcaatggcacgatctcagctcactgcaacccctacctcccaggttcaagtgattctcctgcctcagcctcctgagtagctgggactataggagcttgccaccacgcctggctaattttgtatttttagtagaaatggggtttcaccattttggccaggctggtctcgaactcctgacctcatgatctgcccaccttggcctcccaaagtgttgggattataggcatgagccactgtgcctggctgggttttagtatatttctcaattgtcctgatttcctcctgaagaggaaaaataacctgaaatgtgttggtggctgttgtttttttaacatgtctgttgactttcaggccctagactggagctggttacagacggaagaagaagagcacagctgcctggagcaggcctcatgatgtggggggactcgaccccctgacatggggcagcccatagcaggccttgtgcagtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctactactttggtggttgtcctcttttcggcaaagttggagcgagtgccaagctctccatctgtggtcctttctgccaagagcgactcatagtaaccaggatgggagagcagctgccttattctgaatcccaaaaattacttgggggtgattgtcacagaggagggacagaaagggtatctgctgaccaccagcctgcctacccatgcccatgtctccattcctgctcaagcgtgtgtgctgggccggggagtccctgtctctcacagcatctagcagtattattaaatggattcattttaaaaatagctcctatattttgtaacatgtctcaaacactcatactgggttccacaatccactgttagaatacctatggttagggcttctgaactaaaataatggaaaattttaacaatttgtatagtgcctggatcattactagtgccataaccctgcttcttcaacatttcacagaacttctcttttatataaaggcaagagcacaaaatgagttcagatgatcacaaacaggtgagttttgttggagaagaaagttggagtaggagactttcacaagtggtttccatggagatagaatgaagcattctgtggtcaagtaagtttagggagctattcatgtttcacttgctttgtggagattcacactatgcactgggaaagtatctgaaaagtcttataataaagaaacaggcttaactttgtgtaagaacactgtttatcaatgtcatttggctatagaaacattttctcctgctgattgtgtgtgtgaaacatgtattaacattccaatgaactagcatttaataaagcacaattttggaaaccctggtaaatgacagtgggaaataacacccgaaaggcaaggacgggcagattggggagggaaaggatgttgggctaagggctgtgagcttatgttacaggcaactgagccactgaagaattttgacgaagaaaatgccaaccaaagcagtcattttaaaagtttatggctgttcagttacaggacaagttgtgaaaagaaag

SEQ ID NO: 1769 - DNA, 61352 bp, Homo sapiens; identical to SEQ ID NO: 1768

SEQ ID NO: 1770 - DNA, 61352 bp, Homo sapiens; identical to SEQ ID NO: 1768

SEQ ID NO: 1771 - DNA, 61352 bp, Homo sapiens; identical to SEQ ID NO: 1768

SEQ ID NO: 1772 - DNA, 61352 bp, Homo sapiens; identical to SEQ ID NO: 1768

SEQ ID NO: 1773 - DNA, 61352 bp, Homo sapiens; identical to SEQ ID NO: 1768

SEQ ID NO: 1774 - DNA, 22803 bp, Homo sapiens
cctgaacgcccatcaagcccatggcccttgtgatccaggtggggaaactaaggcccagagaagtgaggaccccgcagactatcaatcccagtctcttcccctcactccctgtgaagctctccagcatcatcgaggtcccatcaggtggggaaagatgctgttccaggcgcacactagtctacaaggccagagctttctggaagggggcagtaagtacctcggctccctttctggtaggggtgggagtcctgagaaggcaggaagtggcccacttggtaactctgaggtgccatcagggcccccaggaaggaagctgggtgtgtgggcaagtgtgaggtaagctggccagggaggaggaagggacagaggaaggccacgtgggtccagcctgccccagggtgtcctgcttgcccaggctgtgggtctgccagccacttgcctgctttcagtttctaggtcatgctgagcttgttcccaactcggggctccgggcatttgctcttccttctgtgtttgtgctctcccggccctctttgtgggatctatgcgctttgggggactggggacacagggcccatgtgtatcttctgaaacacacgtcagcctgaactcttgctggtctgcttacttgccgtggttccctggccgcaatagcacataggtcccatgaggagggcagggactggctgctgtggcccagaagtacccaatcgctgtctgctcaatgaacggagaatgggctgctttcctggaacagcagattctaggatcacgtgccctcaagtgccaccctgcctacctcccgcaccgagtgaggcatcaggcgtggaagaagcccgggagccggagctgttccaggtgctgcctgagcacgccacctcccatctcccccccagcaggaagaggaaaaaacaaaccacgaggctcttcagagagaggaccccttgtcccctacccacagtgctggagctggcacttcctatttctgctttgaaagcctcaggttgtcactctcagaacagaggagagcaaaggggaaccctactgatttcaacaaaacaaagttgcccaacccgaagctggccacaggcggaggcagtgaaatgacaaaatcagcttggaaaagcctaaggaccctgggccctcgtttcaaaagctgtcatttgctacacgaaatgctgaggttcaggaaaaggaagacacttgctccaactcacacagcaagcttggatgctctcaatgaggtgtctaataagagctgaaggccaggagtcataagctatcattgtggcctgggttgctctgttgcagtgccttgtgacagcatggggtggggatggagaaagcaacctcagttaccttctcctccagtctgcttcttggactaagggtttaacggtcagagtcctggctgttaaggtttgtggctgatgcaggtatggctctttttatttttatttttttgagatggagtctcactcactccgtcacccaggatggagtgcaatggtgccatctcagctcactgcaacctccacctcctgggttcaagcgattttcctgcctcagcctcccaagtagctgggattacagatgggtgccactacacctaactaatttttgttattttttttttttttttgagatggagtctcactctgtcacccaggctggaatgcagtgttgcgatttctgctcactgcaagctccgcctcccgagttcacgcctttctcctgcctcagcctcctgagtagctggactacaggtgcccacaccaggcctggctaattttttatttagtagagacgggatttcaccatgttagccaggatggtctcaatctcctgacctcatgatccacccgcttcagcctcccaaagtgctgggattacagacgtgagccactgcgcccggcctttttgttttgttttgttttgagacagagtctcgctctgtcgccaggctggagtgcagtggcgcgatctcagctcactgcaacctctgactccctgattcaagcgattctactgcctcagcctactgagtagctgggactacaggcacgcaccaccacgcccagctaatttttgtatttttagtagagatggggtttcaccatgttggccaggatggtctcgatctcttgaccttgtgatctgcccaccttggccccccaaagtgctgggattacagatgtgagccactgcgcccagccaatttttgtattttaagtagagactgggtttcgccatgttggccaggctggtgtcaaactcctgacctcaggcgatccacctgcctcggcctcccaaagtgctgggaatacaggcgtgagccaccgtgcccggccaggtatggctcttctgaggggaccaggctggggctggggctgaggccaagcccaatctactgtgggctccacctggtacctctcctgggtctcaggcttatggggagtcagaggacaatggcccctccttactctgccactggcagagcccttctccctcggctgcctcctcattcccttttggctctccttttctaagttctgatcagaagtacaaaggtgtcaaggagtaggtttgacaaagtgtgacagcgcgttgttctatgtgaacaaagaaccactgagctcagccagcactgaggggcgcacgatgtggaagaactaactagttttgatagagctcctgctcaaggttacaaggtaagttaatggcaaagatggtcatacagtaatgagcagagagattcttgagtgcatccagggttaaaagtgaaaactgagaccacgtgtaatttgagatgaagcccttgttccaccagcccctgcacagtctcactgccccatgggacacaggggagggtgctctagtctcgggcgatggctgtcctaggaccacccctccctcccctcccatggaaatcctcatgctatactattcttttgtctttcctatgagtgcagaatggcggttctacaagctggacaattggggccaggtggggtgaggcagagctccttggtaggctttcgaaattgaggcaaagagacagtgttcaaagaaaagctaagtgtttgtatcgacggaacttgaagtgttagtgaagaggcagagatcaggcctcagatcctgcctttggaactcatttgttaaggcatgaacaggtctgaaaaaactacagaatgaatagcattccctgttttccccaagaagtccatctagacagtccctaaagagcctgcaactccaggattaagggctacattcagcggctaggcacagggttcagaaacgtcctgcagccgggcgtggtggctcatgcctgtcatcccagcactttgggaggccgaggcgggcggatcacttgaggtcaggagtttgagaccagcctggtcaacatggtgaaactccgtctctactaacaatacaaaaattagccgggtgtggtggtgcatgcctgtaatctcagctacttggggggctgaggcaggagaatcgcttgaacccaggaggccgaggttgcagtgagccaagatggcgccactgcaccccatcctgggcgaccagagcaaaactccgtctccaaaaaaaaaaaaaaaaaaaagtcttgcaagtgcatatgcacaccaggtagagccgggatgatcctggcgcactagcaggagcgggaggaggagctcaacttagcagagcctgtggggccctgcaacaattagttggaaaagctgaggcatggagcaggcacttcctggcttttaagattggggcctgggagatactcaccgatgcacccatgatgatgaatatgtgtgtatccgactgatggaaggcatcgccctggaaaagctcttcccgcaggatcccgcacacctgggtccggctcagggccacctgctctgccatgacgctgtctggtggaagaaaggctcgttaacaaggcagaagaacaggagagcattgagaagttagcccctttcttgagagttcctctggggtctcacaccagggtgacacctgattgcccaaatcactccttgtgaacggctgggcattggggagtggttgatgggttagaaactgctggctctgggctccagccactctctcctaggcagccttcattcagggtgtacattacaaaattactcaaagcattggtgtattccgactacagcatcaattctggacaaccgagtaaaatccttgtggggcatggaactgcgtgcccaggaccatctcattcccgactgtagcgggaactccacaatgacctggagcatgggagatggtgcagatgctggagttcagctccagccctccccttgccaagctgggtgaccccggtcggcaagtccccttcgctctcggggtctcaggggctcaagagaggaggtgcggggtataaagggattggttaagaccctctcgattctgctcggttctcaagcacaacaaacagcgtgtattttaccgccgcgcggcgcagcgcgggacagtacgctcctccgcctgcgcggcgcccgcccggccggttacctgcgcttcgtcgtcgtcgccctccgcgctcgcagccccgaagtgtacgaccgtttccgggggctgagccccgccggcccatttaatcggcgggggcgggggcgggcgcctgggctgagcggacccgcctcaggcgaggcgtgcggggcggggcctcggccaccacccctcgtgcgggcggggcggggcgagggcaggtgcgcgcgcatcccaggccagcccctgcctctcgggcacctgcgctggaggccggcccgccggctgcctgccatacccgctgccgctgctctgcatccccaattccggcgggcacgggtgcagctccgcgtagtgctcccgaatccccatcgccggccaggccccgcccctactgtccggtttccccgcctgccccggcggcctcgcgcgctcgcggagggctccacttccgccggcagcgtggccacgcctcctctgggctgtccctcggctcctgggcggggccttctgccgcgccactcccccgggaaccctcgcctgttcgcgggtcaagccggccctattgggcagtctcttcttgattcctcccccggagagggcggggcggccgagcgccccgaggctagacgccgccgtccgagagacgagggggcgtgtaggcggtgacgccctgcaaagtggccggcgtgcttatcattaccgagcttccgcgggcctgcagagcctggcggactcagacttctctccggagcgggatgcggccctaccgcggcctcacacttctcgccggcttcccgagttctcgggggcggggcttgtgtttttacttccggatcccacagctatgacaccggaagccggaagcgtggtagggaagggcgaccgcgaaactgggactttctcggagcgccggggccctaccagcgttcacagtccgccgctcccacccttctcacgtctgacggactctgctgacaggtgtggtccttttccccaaagacagggttccatccgtgggcgttccgccgcctccgaaacttcccccggacgttcaggctcccccctcttttttgggccccagcccgttcctgctccgcgcttctggagcactggccaaggcgggccgattcaggacccaggttacttgggcggcgagctggactgtttctactcctccctcctcctccactgcggggtctgaccctactccttgtgtgaggactcctctagttcagagacatattctgttcaccaaacttgactgcgctctatcgaggtcgttaaattcttcggaaatgcctcacatatagtttggcagctaggtatctgatttcatatgcctgtttgctcgttttgcaagacaacatctgcctatcgtcatactgtttctgtgatctgagaatgaatgggctctcctggcacattagaggaatagcacggaggtcactatagctggagcagagtgagggaggggagcacagttggagaggaagggatggggaacccgatggtacagggccttgtaggccgttgtagggagattggcttttacgcagaaggcaacggggatccatggtagggttctcagtagaggaggaatgtgatcggaattacgtcttacactgatcgttctagcagtggtggggagaacagaccatagtgggcaagggtaaaagaagggtggcgtggtaagaggtaattgcagtaatccagctcagagacagtgctttgagcattttattattggaaatttcaaaaatgtacgaaagtagaaaaatgagtatagtaaatctttttggtttgtttgtttttgagagatggagtctcgctctgtcgcccaggctggagtgcagtggcatgatctcagctcactctaacctcctcctcctgggttcaagcgattctcctgcctcagcttcccaggtagctgggactgcaggcgtgcgccactacgcccagctaatttttgtatttttagtagagacggggtttcactatatgttggccagtctggtcttgaactcctgacctcaggtgatctgcctgcctcagactcccaaagtgctgggattacaggtgtgagccactgcgctcggccagtatagtaaatcttacattcacagctaccaacttcaacaattgaaggtatcaacttctgactaattttgtttatatccctcgcaatcctctcccattattattttatttctttttctttctttctttcttttttttttttttttgagacagaatctcgctctgtcaccaggctggagtgcagtggtgtgatctccacccactgcaacttccgcctcctggattcaagcgattcttctgcctcagccgctgggactacagttgtgcaccaccacgcccagctaatttttgtatttttagtagagatggggtttcatcatgttggccaggatggtcttgatctcttgaccttgtcatccgcccgcctcggcctcccaaagtgctgggattacaggcatgagccaccgcgcccggcctctttttttgagacccagtctcactctgtcgcccagaatggagtgcagtggcacgatcttggctcaccgcaacctccatctcccaggtttgagcgattctcctgcctcagcttcccaaatagctgggattacaggcatgcaccatcactcccagctattttttttttttttgtatttttggtaaatacagggttttgtcatgttggccaggctggtcttgaattcctgacctcaagtgatccacttgccatgacctcccaaagtgctgggattacaggtgtgaaccaccatgcctggccaccactattattttcaataacagcttgagatatcattagcatgtcacacagttcatccatttaaagtgtacaattcaatggtttgttgtatgtatattcacaggacattttcgtcacccctcaaagaaaccccataccctttagctcagcttatcttcccctcagccctaagtggcactccccagcaatctttaatccactttatgtctctgtggatttgcctgttgtagacatcttatataaatagactcatacaatgtttaatcttttgtgacttgtttatttctcagcatattttcaagatttgttcatgttatagcatgtggatgtactagattttgtttattcatagttgatggacatttgggttgtttccactctctggctgctatgagtaatgctgctacaagcattcatgtggacacatgtgttttcatttctctccggtatatacctaggagttttcccattatttggaggtgaattcagacatcatctttaaacatttaagtgtgcctctctctaagacaggactctgaaaaacaaccacaatatcattatgacacctaaaatagttaatgttaattgctcagtgtgatcagatcggttgggggatacattttaacaggatttcttgatggattagatgtgctcttgtgtgtgtgtgtgtgtgtgtgtgtatgtgtgtgtgtgtgtgtgagagagagagagagaatcaaaaaagacttttgacagctggaggatggattcgccatcagctgataacaaagaaggccttgggtagatctgggttttggggactgtcggaggtcttagagaggttcgttttgagaaggctactagataaccaagtagaaatgtcgagtttgataaatgaatgtggagtttagaaaagaggtctaattaagcatcaagattggagttcaaggcatgagactggacagaattcctgtgggagtgaatgaagttacagagaagaagatgtcctaggacagagccctggggcagcccaacatgaaggatgggaacccagtgagagtgcctgggcaggagtagccagcaagatagggaggaaaccaggagaaggggctgttctgaaagccaagggtggagtgcagtggcacaatctcagctcactgcaacgtccgcctcctgggttcaagcgattctcttgcttcggcctcccgagtagctgggactacaggcgcgtgtcaccacactctgctaattttttgtattttttttttttgagatggagtctcgctctgttgcccaggctggagtgcagtggcgcgatcccgggttcacgccattctcctgcctcccgggttcacgccattctcctgcctcagcctcctgggtagctggggctacaggcgcccgctaccatgcctggctaattttttgtatttttagtagagacagggtttcactgtgttagccaggatggtctcaatctcctgacctcatgatccacccgtgtcggcctcccaaagtgctgggattacaggcgtgagccaccgtgaccggcaatttttttttttttttttagtagaggcagggtttcaccgtgttagccaggctggtctcgatctcctgacctcatgattggcccgcctcggcctcccaaagtgctgggattacaggtgtgagccactgcgcccggccagacattttaatctcacagttctggagactagaagtccaaaaccaaagggttagcaagcacacaccctcaaaggctctaagagggcaatcctcccttgcctctcccaagcttctgccccatttattcctgggcttgtggctgcctcactccagtctccgaggcagtcccgacatggcctcctccccttgcgtctccctctggcttctctcttctgtctctcataaagacacgttgttggatttagggcccacccacgtcacccagaatgatctcatcttgagatcctacatctgcaaagacccttttcccgaatcacatatgtttcaggggttagaacatgggcatatcttttcggggggctaccattcagcccactacactggatgaggggccggtaccctccacttctcctgcttggaggtgtgtaggggatcaggattcccagcatactgacatctccctccacaaacagtcttgtcccgactctcccatctctggtgaaattcttctatttccagcctggagctaggccttttcaagtcccacatgggtggtccagcacctccctttggaatgggagtatctgctaccccttagactgaaaacccactttagcatcctgatacactaggtgaattatcagcattctgtttaaaatgtagccccagaactcataggctttttctgctgggtaaggatgtgggtctcctgtgactcccctgctgcctttctctttcagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgaggtgaggaaagagtcaggggatccagccctgctgaggggaaggcgtcttctccccacctgcacctctgcgtttcctgggcctggggtggggatgtgctgccctccctcttggtttcaggaagtagactctgagatgcagattagcggggaggaagtttagcatgctctcaggaccagtactgggaagggaaaggagggacaggggaagaagccagggagggcagagggagaagcacgctgccgggtaggctccaggacagccttgctggatcttacagggagctctggagctggaatgaaccttccaggttggaccaacatgtccaggcctctgtgtccctgcactgagcactcatgaagtgctgtccatcctgggacagggcagagtcggcgctgggaagaggcgtggtctgcccagagagggggtggggcctgtcctggaaatgggcggggcatgccctggtagaggggcgtggtctgtcttgggaaggaaggtgcgtggcccccacaggcaacattcctctggggcaatcccggcgcacacctcagcggaggtgaaggctgacttcccacacccagtggctgggactggggagttctttcctagactgccatccgggcgcccctcaccctcttgctgctcagctccaggtcgtcatgggttcagggctcagctgcacgctcctgcccgcgccctgggcgtgatggcacccccagcccctgccattcttccccctcaccccctctccctgccactgctctgcattgccctgggttagcctggcggggccaggtggcacccgccatatactcttgcctttctgctgcgggggccttctaagcctcgggtcccagagctgcagggaggggcggcatagactccccacatggctcactgggtgtggtggggcctgtagccctttttgtttcatcctttggttcctgctggggactcaggcctaagtgtccaccccatcgtggaggacaacaccccttccttgcaggagtcatccctgagctggcagcttcaattggctctccgtgtcctggctggctggcagctcctgggcgaggtggcatgtgccgtgactactagagatcgctgtcatgggcccactcccccgccttctttgctggactgtggtccgagatgttatgtggggctctgtgctgacaagtcacatagtctgtaggcttcagagagtggctctggctgacaccccgtgggcagagacaagacccatgcctgcgatgtgtctcctcttactgtcaaggcaaatcacctttccttccatggaggaaggggtcagtgcagtcagcttgctgtcagggggctgcttggtctcctcgacggtgaggctgaattggagaggccctgctggagcatggagacccaacatgacctgcctgttccaggacagggtcccccacctcagtgccatcggcacctggggctggagaattctcttgtacgttgtagggtgtggagcagagtccctggcctgtacctgctagatgccagtagcacctgtcctgttgtgacaactaacaatatccccagatatttattgccaaatgacccctgggggatacagttgtccctggtgagacccactgtattgggatcttcagagcactggtgcacagagaggtgacagttagactgggggcttctgctcatccccaggagagtgctctattgagggggacttgagggtgagtgttgcaggccagctgtgcagggaccctggcacagcgtatggcgcccttgcttcccttccaggctgtgtgttcagtgcagcagcttccctcgggctccagggacacaaggaggcctcaaggctgtattgactccccctgctccgcctgacctgagctttgtgggtggcaggtgaaacttggtagctccatgtgtcaggccctgggccaagcccctaagggcccagaagatgtctgtcccccaagatgtacatgcttatgtccatggaggaggctgtacttagaatgttgagggagagattcacgaagaagttgcatgtctctagtgtgtgactccactagtgtgagacatgtccagaagtggccaatctgcagaggcagatgcagatgaggagggtgctgggggagcgactgcttatggggtcccggaactgttctggaattagatagtgcggatggttgcacaacctgatggatacaccgaaaactgctgaattagttaaaatagtgaatttgatgtcatgtgaattttacctcagttcagaacattttttaaaagacaagttgccagccaggtgcagtggctcatgcctgtaatccgagcactttgggaggcccaggcggggggatcacctgaggtcaggagtttgagaccagcttggccaacatggtgaaaccccatctctactacaaaaattagctacagacgtggtggcgggcacctataatcccagctacttgggaggctgaggcagggagaattgcttgaacccaggaggtggaggttgcagtgagctgagatcgcgccactgcactccagcctgggcgacagagcgagagtctgtctcaaaaaaaaagacaagttgcagatgagctgagctttgggcagagcaagcgggattctgatggggggtggatgttgcgctcgtcagcaggcaatagttagttggttgagggttttgatcacggggtagctactgcctgccccattttatccagctctgtagttgctatagagttgctagaaccttggcacatcacttatcagttttgtcacctcagatggcttcttcactacttggggtgtctcctgggtgtggggctctccttcctgtggcctctgctgactgcctggcactggcacacatgctctggtgaggggaggaccagcggtttttcccgtttgttttctgcttcctcgtttaaccctcctcgtcttgtaagatgaatgttcttgtctctgttcactatgcagatgaggactttgaggctcagagacgccactaacttgcctggtccaagccttttgggcctctcaggctgcagccagcaatgctgcagtgaagtttgcctgggaggctgaccctaggagtctgcaggcgtgttaggacccccgatctagaagacagcagagatgtaggccagggaggaccaataccgagcatctgagggcaggcacacctcagactgaccagaatacaaatgaattcgagtcacttacaaacaaagtggcataaggccaggcacagtggcccatgcctataatcccagcactttcggaggccgaggtgggaggattgcttgaggccaacgatgtgagaccagcctgggcaacatagcaagaccttgtctctacaaaaataaaaattcaaaaaagtggcatttaacacatactttttttcttttttttgagacagagttttgctctgtcccccaggctggagtgcaatggtgtgatctcggctcactgcaacctccacctcccaggttcaagtgcttctcctgccttagcctcccaagtagctgggattacaggcgtgtgccaccacaccgggctaatttttgtatttttattagagacggggtttcaccatgttggccaagctggtctggagctcctgacctcaggtgatccacccaccttggcctcccaaagtgctgggattacaggcatgagccacagtgcctggccaacacgtacttttaagtgaagctgatgtgtttggtgttattttcttgcagaaagtgaggggcattagtgtaaaggattttggaagtgtttaaagaaacaaaagggagtgttgagacgccatccacccctgagagaagctgcgtggtattatggcgggtgggggcaccaggatgggtggccccacttctggcctctgacttcctgagcctcaggcccatgtgggcccaggcagggcccggcaggccgggctgcccagctcccctccactgtcccctctgccaccagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcaggtagtcggggcagggccaggttctgaaaacccgcggtgacgccagtgttccacaagggaacccgtggtcggggtcccccaaagcaccctggggctcagtgctgtgccgggagggctcggaactcagaaaagccgtcacactcccagttccggtttattacaaggaaaggacacaggttacggtgagcgaaggctcagggcgcacagggcgggctccaggagagaccaggcgtgagcttcagcggctcctcgcccaggggagttgtgcagacggcacctgtttctttcggcaacagtgtgggacagcgagcacggagtcacaaccgggaagctcaccccagccgtggcggccggggttttcacggggggtgggccgcgtgggcaccgagcgcctgcgtggccaaccctggtcactcggctgtagccaccagaggtccagctgtgtggcccaaggctccccccataaatcgtgtcattagcacagaccgcctggtttcagggtctttgtgtgtgggcttggctgatcgcaggatcctggcgatggtagtcaggaaggggccgtgctccctttgaggggcaaggtggagagaagtgctggagaggagacttgctggcgggtacctggcacttgccacagccaggctccactcccctggggaaaggcgtggatggtgggctgtgcacgccgctccactcagggcttagagcgcctggcttaaggcgttgatttcctgtgtgggaagtggatgagttttctacagctgccgtgaccaagcaccacagactgcggggccgaagccacagaaacgcgtggcctcccgcttctggaggcctggaggctgagctagcggtggtgtcggcagggtgggctccccgccagggccgcgagggagctgccttccaggcctctccacggcgccgggggccgccggctgcacctctccagcctccatctccgtcatcctgtggccttgtccccgcgggcctctgtgcctgtcctcctcttttgacaagaacaccggagatacacaaaggtacacaaaagcgggcctttgttcaagctggcaaaagagatcttcttcagaaacccctgcttgcgggggagagagctgagctccgttcccgccccagcagaggcggcctggccttgcgaagggagaaggagggagtcgggagggggcgagtgcaggctcaggtgaaagatgacggggcagccagcgtccttgccgcgaggccagccgtgtgtgggagctgccggtgcttaccaaggttgggatgcttccgtcccgtggagactgggagactgggccccgcgcctcctgaggtttccgtttccaaggagtggctgcggggccctcgggaaagcccctgggttgtgggtgctacacagatgtctcaaagggacagggtaagccctttgtagtaaatgctgtcagaaagggaggtcaggtgttggccggaacagacagtacatgctctgggcagccctgagcgtttccagacgggaactcactcaaaagggggctggggcgtcccaggggcgcggccttaggctcccagaggccccgcgaggtggtggccgggtgtcttcgggcaggggtttgagtgcagtgtgcctgccgagaggttctgcagttcccagtgtttaacaaaattcagtgtccactcttgatctgcacaaactctcccatcctggcggccccgggtgtggactggggcctgtgtttactttgccctattcgtgtctggcctccttttgtcccaagtctcagagagacggagagagatcccctgctggggctgtagctgcaaggccaccgggttcagccctcgaggcctgcttgccggggcagtgactaagccgttgacaacctcaaggcagctttgtgctccttcgtctctttggggatctctttttgccccatctgtgtgtcaccctgtggcagagggttaaggtgggcagctggggagggttgggtggcccttgggctcatgaggccctagggcacccaggtttgggggtgccgagggcaggaaaaaaggcctcatggcgcgcaggcctcagccgcttgcgggttgccccgggcttgcggatggcaggagtgggccgctggggagaaagcagtgctgacaggaagtggctttttatcctgcagcagatggctgaggacaaggcctctgtgaaagcccaggtgacgtccttgctcggggagctgcaggagagccagagtcgcttggaggctgccactaaggaatgccaggctctggagggtcggtgagtcgggggagccggctccggagaccccttccagggtttccaaaagcaatgaggtgggtttaggggcctccagggtgctccttgatgaggatagaccggggcaggctgcgtaaacacgtcggggcagacgtcgggagaggtctgggccaggcatccgggacctgggtcccagccggctctccgcactctgtgaccctttgatggagtttggattatttccttaggaggcattctgggggccccgagcccacacccacagtgtctagttctctggaaggacttctgggaccggcgcacagtcgccctcgtggctgaggttgatgacagggaaaaaggcacagggcaggagccgccagggcaggagccgtggggggagttggagaagccctgtcccagcctcccgctgccctgcgagcggcacagtgagaagcgcctcccacacgggccgtgttcctgcccagggatgcccgctagagactcagcgccctgggtgtttactgggggcaggtcctgtcagcgccctctgccaggcaggtacctaaatccccgactcccagcagcagagcgggtgctcacgtcaaccacgttcttcctacaaatggcctaggtgcagggaccgacctgaccactagagaaagtgtcactgtggcaagggaacttcaccagccaagggccaaccttgccagccggtggcctcaggcctgctggttactctcttttgcaaaggggtcttggttcttgtgagtgggaccattgggtcaaagggcagggaggtttctgtggttctcattcggtcctgcttctgccctccagacagatggatcagctgccaggggggccccagccatcccagcacagtaagcggtcaaggtgcacttggggcagccagcagggcagaggggaggggagcttgacccaggctctgatgggcagagggaacccgtgcagggtgtgggggcagtatgcaggcaggcgcggaggggagagccaagcagccaggcctgccaggcagagttggggtgactggagaagggccgtgtctgcctgtggccagaggccacccaggacctggacagatgcacccaccattgtccctgcagtgaggctgtggaagggcttggtgtggtgggatgaggccagaccctggaaactggaggttaagggagctgtaggggggcaggtgtgggaactgagcatccgagcaggtcgtctgggactccagcagagctctgggcagcagcagggatggggccgaggcccggtctgcattgagctcagtgcttgcacgcccaggtgggcagtctctcatttttggaacagcagtctctcctgaccccctccactgagactgcttttgctggggcccccagcagtcccccagtggaactccacgggcagttccgagggctcctctcacctggccccagcactgcgggatgcaggcgaccccatccttttctcggaccacccccttcccctgacttccaggtctccttgccatctgtacttggtcacctgctgggcccctgcattgaagcaaacacgtcttaagcaaagctcctcacctgctgctcccacctggccccctgcagttgtcctcgtgtctgttgacggtgcctccaccctgccgcctggcatcagctcgcagtcacagggtgttcagagccgacccccaccccccgcccacgccctgcgcatagcccctgccgtccccccgttcgtcctccctgagtctgctctttccccgtgccagggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagtgagtcagcgggggcggggccgcaccgcagggtctgtggttctacacttgatcttagccgaaaggctgagaagtgtcgggtccatggttctttctgccttctgaggactccttcagattctgcctgtggctgtgggcccattctgtcccttagccttgctaacggtagaggcgaccatgatgacacccggtttgtctttgatacagtcatgccatctgctctccagaccacgtttcactgcgtgtccacacgtggccttttttgtagtttttttttcctagccactaggtcatcaggggacttgtcctttaaaaccccttctaggccaggtgctgtggctcacgcctgtaatcccaacactttgggaggccaaagtgggtagatggcttaagcccgggagttccaagaccagcctgggcaacagaaagacaacaaaaatacccccaaacccccccgtctaccagcatccaatctgggacctcaggttcctgtccttggcgtgccttttcagtctcctttaatctagaacagttcccctgcctttctgagctgtttgtgaagttcacagttttgaacagtgcagggtagttccattgtattattactattattttcaagacagggtcttgctctaccgtccaggctggagtgcagtggcataatctcggcttactgtaccttccgcctcttggtctcaagcgatcctcccaggtagctgggactataggcgcaggccagcacacctggctaatttttgcatttttggtagaggtggcgttttcctatgttgcccgggctggtcttgaactcctgagctcaagcgatcctcctgccttggcttctcaaagtgttgggattatgggcgtgagccaccgcgtctggccgcgattttattataaacattaaaaatactagcttttaggaaaacgatattaactgcctggtgaccagcccaccaaagcctgctttagagttgacggcctcaggagtcctcacacagccttggaagaccccattccaggcctgtgatgcgagggagggaaggaagggggtagagttggaagcaggcagcaccgtggctggactggcatgaggtggtttctccagcaaaagctccctttcctcaggaggaagctggcccagttgcaggtggcctatcaccagctcttccaagaatacgacaaccacatcaagagcagcgtggtgggcagtgagcggaagcgagtgagtgcgaccactggggctctagggctggccttgcctcttcctctccccgtggccctgaaccttgagaatgggtagacctgccttagacttgccttagacctgtgtcaggctgcagctgcgacagctcagggaagctgtggggagatggcaaccccaggatgttgctctcaggagtgtcagcaggccatcttaatggggggctgggccagagccttggggtgctccctctgtggggctggggacgtcttgtctccatggacattccctcttgccagccatcgccatctggcacctggctcagcttcccccaagccaaggtaagcccgacagcatttccaccccagtgttggctgggagccttttcctagtttgtcctcatcagacctaagctggggtgcagtttgctagtgatcacattttagcaggacaccgtcaatcgtaagtgtacccagaggagatttataaggacaaagcctgaagccaggtcacatggggaagagttagctacaaaactggccacttaatctctggaggggggcgttggtggggtgtgtctgtgtgtgtctcagggggctggagatgcctgcgtgggaggagtgcacctctgaccaggtggcagagtggaaggactgagggctctcagctgagctgtgcacatggcgggcacaggaccggctggctgtgagtgggtgtggcctgtggcctgtgaagggtgggaggagggctgtggagctggggattctgggaagggaatgtcggcccagctgggaggttgtaccagatgacctcagcggcctcttcagtcctgaaaaaaacctcagcatctcctctgtcgttttgggccgtgacaggacgcagccatctccctgtgcacgctgagatcctgcaatgggccctcaaatcaggggctggcatcacccagcctggtcagccagggccactctttcatccttctcagttcttctcagccagcctcgccctgggctgacgaggctccgtcagctccccttgcccgtccttagggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggtgagggccctcctctctgacccaccctggcactgggacctggagagtctctttggcgtctttttttttttttttgcttttgctttttgagattgagttttgctcttgttgcccaggctggagtgccactagtggcacgatcttggctcactgcaacctctgcctcccgggttcaaacaattctcttgcctcagcctcctgagtagctgggattacaggcgcctgccgccatgcccgtctaatttttgtatttttagtagagacagggtttcaccatgttggcccagctggtctcgaacttctggcctcaggtgatctgcccaccgcagtctctcaaagttctgggattacaggcgtgagccaccgcacccggcctctttggcatcattttgtagtggcctttcgtaagcttctgagccacttgtgctgctccttagacctctcggtgagcttggcattactcgccgacgtatctgtttcctctgcgccgctgggggctctgggaggacagcagtgggttctgctttgttcctgtggtgcctggcgcagtgcctggtgggtggctggcttgtggcgggcacatccctttctgttggatttgccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggtgggcctctgagagcgtgcccgtgtgagcagtgggtgcgacactggggggtcgccagtggtgaccccgcagtgggtgcgacactggggggttgccagtggtgaccacaggagacggatggctcctggtgttctgggttagggctcactgtggtccctctcctctcacctgagcttccaagagctgctttgacactagtccagccaaggagctttacagaaatgcgtggcttgactggacggtttctgttttcaaaggatcgaggacatgaggaagcggcatgtcgaggtctcccaggcccccttgccccccgcccctggtgagtgagcgagaactgggcctgcgggaggaggtgggtggggagggcaggtgctgcgccgcgggaggtcacagttcgaccttcctgttgctctctggagacttgacggcgggagctcgtgtaggccaccccatcggtagcccacccccttccccgaggctaagggaggcatgccgtggtagcggcggctcctggtcttacatgagtggcctgtgagaccaggcctgccattgacagtcctgccaagtctccgtccccctccatcctccccttccctctgactcttctcttttcccagcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcatta

SEQ ID NO: 1775 - DNA, 17700 bp, Homo sapiens
gattcctcccccggagagggcggggcggccgagcgccccgaggctagacgccgccgtccgagagacgagggggcgtgtaggcggtgacgccctgcaaagtggccggcgtgcttatcattaccgagcttccgcgggcctgcagagcctggcggactcagacttctctccggagcgggatgcggccctaccgcggcctcacacttctcgccggcttcccgagttctcgggggcggggcttgtgtttttacttccggatcccacagctatgacaccggaagccggaagcgtggtagggaagggcgaccgcgaaactgggactttctcggagcgccggggccctaccagcgttcacagtccgccgctcccacccttctcacgtctgacggactctgctgacaggtgtggtccttttccccaaagacagggttccatccgtgggcgttccgccgcctccgaaacttcccccggacgttcaggctcccccctcttttttgggccccagcccgttcctgctccgcgcttctggagcactggccaaggcgggccgattcaggacccaggttacttgggcggcgagctggactgtttctactcctccctcctcctccactgcggggtctgaccctactccttgtgtgaggactcctctagttcagagacatattctgttcaccaaacttgactgcgctctatcgaggtcgttaaattcttcggaaatgcctcacatatagtttggcagctaggtatctgatttcatatgcctgtttgctcgttttgcaagacaacatctgcctatcgtcatactgtttctgtgatctgagaatgaatgggctctcctggcacattagaggaatagcacggaggtcactatagctggagcagagtgagggaggggagcacagttggagaggaagggatggggaacccgatggtacagggccttgtaggccgttgtagggagattggcttttacgcagaaggcaacggggatccatggtagggttctcagtagaggaggaatgtgatcggaattacgtcttacactgatcgttctagcagtggtggggagaacagaccatagtgggcaagggtaaaagaagggtggcgtggtaagaggtaattgcagtaatccagctcagagacagtgctttgagcattttattattggaaatttcaaaaatgtacgaaagtagaaaaatgagtatagtaaatctttttggtttgtttgtttttgagagatggagtctcgctctgtcgcccaggctggagtgcagtggcatgatctcagctcactctaacctcctcctcctgggttcaagcgattctcctgcctcagcttcccaggtagctgggactgcaggcgtgcgccactacgcccagctaatttttgtatttttagtagagacggggtttcactatatgttggccagtctggtcttgaactcctgacctcaggtgatctgcctgcctcagactcccaaagtgctgggattacaggtgtgagccactgcgctcggccagtatagtaaatcttacattcacagctaccaacttcaacaattgaaggtatcaacttctgactaattttgtttatatccctcgcaatcctctcccattattattttatttctttttctttctttctttcttttttttttttttttgagacagaatctcgctctgtcaccaggctggagtgcagtggtgtgatctccacccactgcaacttccgcctcctggattcaagcgattcttctgcctcagccgctgggactacagttgtgcaccaccacgcccagctaatttttgtatttttagtagagatggggtttcatcatgttggccaggatggtcttgatctcttgaccttgtcatccgcccgcctcggcctcccaaagtgctgggattacaggcatgagccaccgcgcccggcctctttttttgagacccagtctcactctgtcgcccagaatggagtgcagtggcacgatcttggctcaccgcaacctccatctcccaggtttgagcgattctcctgcctcagcttcccaaatagctgggattacaggcatgcaccatcactcccagctattttttttttttttgtatttttggtaaatacagggttttgtcatgttggccaggctggtcttgaattcctgacctcaagtgatccacttgccatgacctcccaaagtgctgggattacaggtgtgaaccaccatgcctggccaccactattattttcaataacagcttgagatatcattagcatgtcacacagttcatccatttaaagtgtacaattcaatggtttgttgtatgtatattcacaggacattttcgtcacccctcaaagaaaccccataccctttagctcagcttatcttcccctcagccctaagtggcactccccagcaatctttaatccactttatgtctctgtggatttgcctgttgtagacatcttatataaatagactcatacaatgtttaatcttttgtgacttgtttatttctcagcatattttcaagatttgttcatgttatagcatgtggatgtactagattttgtttattcatagttgatggacatttgggttgtttccactctctggctgctatgagtaatgctgctacaagcattcatgtggacacatgtgttttcatttctctccggtatatacctaggagttttcccattatttggaggtgaattcagacatcatctttaaacatttaagtgtgcctctctctaagacaggactctgaaaaacaaccacaatatcattatgacacctaaaatagttaatgttaattgctcagtgtgatcagatcggttgggggatacattttaacaggatttcttgatggattagatgtgctcttgtgtgtgtgtgtgtgtgtgtgtgtatgtgtgtgtgtgtgtgtgagagagagagagagaatcaaaaaagacttttgacagctggaggatggattcgccatcagctgataacaaagaaggccttgggtagatctgggttttggggactgtcggaggtcttagagaggttcgttttgagaaggctactagataaccaagtagaaatgtcgagtttgataaatgaatgtggagtttagaaaagaggtctaattaagcatcaagattggagttcaaggcatgagactggacagaattcctgtgggagtgaatgaagttacagagaagaagatgtcctaggacagagccctggggcagcccaacatgaaggatgggaacccagtgagagtgcctgggcaggagtagccagcaagatagggaggaaaccaggagaaggggctgttctgaaagccaagggtggagtgcagtggcacaatctcagctcactgcaacgtccgcctcctgggttcaagcgattctcttgcttcggcctcccgagtagctgggactacaggcgcgtgtcaccacactctgctaattttttgtattttttttttttgagatggagtctcgctctgttgcccaggctggagtgcagtggcgcgatcccgggttcacgccattctcctgcctcccgggttcacgccattctcctgcctcagcctcctgggtagctggggctacaggcgcccgctaccatgcctggctaattttttgtatttttagtagagacagggtttcactgtgttagccaggatggtctcaatctcctgacctcatgatccacccgtgtcggcctcccaaagtgctgggattacaggcgtgagccaccgtgaccggcaatttttttttttttttttagtagaggcagggtttcaccgtgttagccaggctggtctcgatctcctgacctcatgattggcccgcctcggcctcccaaagtgctgggattacaggtgtgagccactgcgcccggccagacattttaatctcacagttctggagactagaagtccaaaaccaaagggttagcaagcacacaccctcaaaggctctaagagggcaatcctcccttgcctctcccaagcttctgccccatttattcctgggcttgtggctgcctcactccagtctccgaggcagtcccgacatggcctcctccccttgcgtctccctctggcttctctcttctgtctctcataaagacacgttgttggatttagggcccacccacgtcacccagaatgatctcatcttgagatcctacatctgcaaagacccttttcccgaatcacatatgtttcaggggttagaacatgggcatatcttttcggggggctaccattcagcccactacactggatgaggggccggtaccctccacttctcctgcttggaggtgtgtaggggatcaggattcccagcatactgacatctccctccacaaacagtcttgtcccgactctcccatctctggtgaaattcttctatttccagcctggagctaggccttttcaagtcccacatgggtggtccagcacctccctttggaatgggagtatctgctaccccttagactgaaaacccactttagcatcctgatacactaggtgaattatcagcattctgtttaaaatgtagccccagaactcataggctttttctgctgggtaaggatgtgggtctcctgtgactcccctgctgcctttctctttcagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgaggtgaggaaagagtcaggggatccagccctgctgaggggaaggcgtcttctccccacctgcacctctgcgtttcctgggcctggggtggggatgtgctgccctccctcttggtttcaggaagtagactctgagatgcagattagcggggaggaagtttagcatgctctcaggaccagtactgggaagggaaaggagggacaggggaagaagccagggagggcagagggagaagcacgctgccgggtaggctccaggacagccttgctggatcttacagggagctctggagctggaatgaaccttccaggttggaccaacatgtccaggcctctgtgtccctgcactgagcactcatgaagtgctgtccatcctgggacagggcagagtcggcgctgggaagaggcgtggtctgcccagagagggggtggggcctgtcctggaaatgggcggggcatgccctggtagaggggcgtggtctgtcttgggaaggaaggtgcgtggcccccacaggcaacattcctctggggcaatcccggcgcacacctcagcggaggtgaaggctgacttcccacacccagtggctgggactggggagttctttcctagactgccatccgggcgcccctcaccctcttgctgctcagctccaggtcgtcatgggttcagggctcagctgcacgctcctgcccgcgccctgggcgtgatggcacccccagcccctgccattcttccccctcaccccctctccctgccactgctctgcattgccctgggttagcctggcggggccaggtggcacccgccatatactcttgcctttctgctgcgggggccttctaagcctcgggtcccagagctgcagggaggggcggcatagactccccacatggctcactgggtgtggtggggcctgtagccctttttgtttcatcctttggttcctgctggggactcaggcctaagtgtccaccccatcgtggaggacaacaccccttccttgcaggagtcatccctgagctggcagcttcaattggctctccgtgtcctggctggctggcagctcctgggcgaggtggcatgtgccgtgactactagagatcgctgtcatgggcccactcccccgccttctttgctggactgtggtccgagatgttatgtggggctctgtgctgacaagtcacatagtctgtaggcttcagagagtggctctggctgacaccccgtgggcagagacaagacccatgcctgcgatgtgtctcctcttactgtcaaggcaaatcacctttccttccatggaggaaggggtcagtgcagtcagcttgctgtcagggggctgcttggtctcctcgacggtgaggctgaattggagaggccctgctggagcatggagacccaacatgacctgcctgttccaggacagggtcccccacctcagtgccatcggcacctggggctggagaattctcttgtacgttgtagggtgtggagcagagtccctggcctgtacctgctagatgccagtagcacctgtcctgttgtgacaactaacaatatccccagatatttattgccaaatgacccctgggggatacagttgtccctggtgagacccactgtattgggatcttcagagcactggtgcacagagaggtgacagttagactgggggcttctgctcatccccaggagagtgctctattgagggggacttgagggtgagtgttgcaggccagctgtgcagggaccctggcacagcgtatggcgcccttgcttcccttccaggctgtgtgttcagtgcagcagcttccctcgggctccagggacacaaggaggcctcaaggctgtattgactccccctgctccgcctgacctgagctttgtgggtggcaggtgaaacttggtagctccatgtgtcaggccctgggccaagcccctaagggcccagaagatgtctgtcccccaagatgtacatgcttatgtccatggaggaggctgtacttagaatgttgagggagagattcacgaagaagttgcatgtctctagtgtgtgactccactagtgtgagacatgtccagaagtggccaatctgcagaggcagatgcagatgaggagggtgctgggggagcgactgcttatggggtcccggaactgttctggaattagatagtgcggatggttgcacaacctgatggatacaccgaaaactgctgaattagttaaaatagtgaatttgatgtcatgtgaattttacctcagttcagaacattttttaaaagacaagttgccagccaggtgcagtggctcatgcctgtaatccgagcactttgggaggcccaggcggggggatcacctgaggtcaggagtttgagaccagcttggccaacatggtgaaaccccatctctactacaaaaattagctacagacgtggtggcgggcacctataatcccagctacttgggaggctgaggcagggagaattgcttgaacccaggaggtggaggttgcagtgagctgagatcgcgccactgcactccagcctgggcgacagagcgagagtctgtctcaaaaaaaaagacaagttgcagatgagctgagctttgggcagagcaagcgggattctgatggggggtggatgttgcgctcgtcagcaggcaatagttagttggttgagggttttgatcacggggtagctactgcctgccccattttatccagctctgtagttgctatagagttgctagaaccttggcacatcacttatcagttttgtcacctcagatggcttcttcactacttggggtgtctcctgggtgtggggctctccttcctgtggcctctgctgactgcctggcactggcacacatgctctggtgaggggaggaccagcggtttttcccgtttgttttctgcttcctcgtttaaccctcctcgtcttgtaagatgaatgttcttgtctctgttcactatgcagatgaggactttgaggctcagagacgccactaacttgcctggtccaagccttttgggcctctcaggctgcagccagcaatgctgcagtgaagtttgcctgggaggctgaccctaggagtctgcaggcgtgttaggacccccgatctagaagacagcagagatgtaggccagggaggaccaataccgagcatctgagggcaggcacacctcagactgaccagaatacaaatgaattcgagtcacttacaaacaaagtggcataaggccaggcacagtggcccatgcctataatcccagcactttcggaggccgaggtgggaggattgcttgaggccaacgatgtgagaccagcctgggcaacatagcaagaccttgtctctacaaaaataaaaattcaaaaaagtggcatttaacacatactttttttcttttttttgagacagagttttgctctgtcccccaggctggagtgcaatggtgtgatctcggctcactgcaacctccacctcccaggttcaagtgcttctcctgccttagcctcccaagtagctgggattacaggcgtgtgccaccacaccgggctaatttttgtatttttattagagacggggtttcaccatgttggccaagctggtctggagctcctgacctcaggtgatccacccaccttggcctcccaaagtgctgggattacaggcatgagccacagtgcctggccaacacgtacttttaagtgaagctgatgtgtttggtgttattttcttgcagaaagtgaggggcattagtgtaaaggattttggaagtgtttaaagaaacaaaagggagtgttgagacgccatccacccctgagagaagctgcgtggtattatggcgggtgggggcaccaggatgggtggccccacttctggcctctgacttcctgagcctcaggcccatgtgggcccaggcagggcccggcaggccgggctgcccagctcccctccactgtcccctctgccaccagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcaggtagtcggggcagggccaggttctgaaaacccgcggtgacgccagtgttccacaagggaacccgtggtcggggtcccccaaagcaccctggggctcagtgctgtgccgggagggctcggaactcagaaaagccgtcacactcccagttccggtttattacaaggaaaggacacaggttacggtgagcgaaggctcagggcgcacagggcgggctccaggagagaccaggcgtgagcttcagcggctcctcgcccaggggagttgtgcagacggcacctgtttctttcggcaacagtgtgggacagcgagcacggagtcacaaccgggaagctcaccccagccgtggcggccggggttttcacggggggtgggccgcgtgggcaccgagcgcctgcgtggccaaccctggtcactcggctgtagccaccagaggtccagctgtgtggcccaaggctccccccataaatcgtgtcattagcacagaccgcctggtttcagggtctttgtgtgtgggcttggctgatcgcaggatcctggcgatggtagtcaggaaggggccgtgctccctttgaggggcaaggtggagagaagtgctggagaggagacttgctggcgggtacctggcacttgccacagccaggctccactcccctggggaaaggcgtggatggtgggctgtgcacgccgctccactcagggcttagagcgcctggcttaaggcgttgatttcctgtgtgggaagtggatgagttttctacagctgccgtgaccaagcaccacagactgcggggccgaagccacagaaacgcgtggcctcccgcttctggaggcctggaggctgagctagcggtggtgtcggcagggtgggctccccgccagggccgcgagggagctgccttccaggcctctccacggcgccgggggccgccggctgcacctctccagcctccatctccgtcatcctgtggccttgtccccgcgggcctctgtgcctgtcctcctcttttgacaagaacaccggagatacacaaaggtacacaaaagcgggcctttgttcaagctggcaaaagagatcttcttcagaaacccctgcttgcgggggagagagctgagctccgttcccgccccagcagaggcggcctggccttgcgaagggagaaggagggagtcgggagggggcgagtgcaggctcaggtgaaagatgacggggcagccagcgtccttgccgcgaggccagccgtgtgtgggagctgccggtgcttaccaaggttgggatgcttccgtcccgtggagactgggagactgggccccgcgcctcctgaggtttccgtttccaaggagtggctgcggggccctcgggaaagcccctgggttgtgggtgctacacagatgtctcaaagggacagggtaagccctttgtagtaaatgctgtcagaaagggaggtcaggtgttggccggaacagacagtacatgctctgggcagccctgagcgtttccagacgggaactcactcaaaagggggctggggcgtcccaggggcgcggccttaggctcccagaggccccgcgaggtggtggccgggtgtcttcgggcaggggtttgagtgcagtgtgcctgccgagaggttctgcagttcccagtgtttaacaaaattcagtgtccactcttgatctgcacaaactctcccatcctggcggccccgggtgtggactggggcctgtgtttactttgccctattcgtgtctggcctccttttgtcccaagtctcagagagacggagagagatcccctgctggggctgtagctgcaaggccaccgggttcagccctcgaggcctgcttgccggggcagtgactaagccgttgacaacctcaaggcagctttgtgctccttcgtctctttggggatctctttttgccccatctgtgtgtcaccctgtggcagagggttaaggtgggcagctggggagggttgggtggcccttgggctcatgaggccctagggcacccaggtttgggggtgccgagggcaggaaaaaaggcctcatggcgcgcaggcctcagccgcttgcgggttgccccgggcttgcggatggcaggagtgggccgctggggagaaagcagtgctgacaggaagtggctttttatcctgcagcagatggctgaggacaaggcctctgtgaaagcccaggtgacgtccttgctcggggagctgcaggagagccagagtcgcttggaggctgccactaaggaatgccaggctctggagggtcggtgagtcgggggagccggctccggagaccccttccagggtttccaaaagcaatgaggtgggtttaggggcctccagggtgctccttgatgaggatagaccggggcaggctgcgtaaacacgtcggggcagacgtcgggagaggtctgggccaggcatccgggacctgggtcccagccggctctccgcactctgtgaccctttgatggagtttggattatttccttaggaggcattctgggggccccgagcccacacccacagtgtctagttctctggaaggacttctgggaccggcgcacagtcgccctcgtggctgaggttgatgacagggaaaaaggcacagggcaggagccgccagggcaggagccgtggggggagttggagaagccctgtcccagcctcccgctgccctgcgagcggcacagtgagaagcgcctcccacacgggccgtgttcctgcccagggatgcccgctagagactcagcgccctgggtgtttactgggggcaggtcctgtcagcgccctctgccaggcaggtacctaaatccccgactcccagcagcagagcgggtgctcacgtcaaccacgttcttcctacaaatggcctaggtgcagggaccgacctgaccactagagaaagtgtcactgtggcaagggaacttcaccagccaagggccaaccttgccagccggtggcctcaggcctgctggttactctcttttgcaaaggggtcttggttcttgtgagtgggaccattgggtcaaagggcagggaggtttctgtggttctcattcggtcctgcttctgccctccagacagatggatcagctgccaggggggccccagccatcccagcacagtaagcggtcaaggtgcacttggggcagccagcagggcagaggggaggggagcttgacccaggctctgatgggcagagggaacccgtgcagggtgtgggggcagtatgcaggcaggcgcggaggggagagccaagcagccaggcctgccaggcagagttggggtgactggagaagggccgtgtctgcctgtggccagaggccacccaggacctggacagatgcacccaccattgtccctgcagtgaggctgtggaagggcttggtgtggtgggatgaggccagaccctggaaactggaggttaagggagctgtaggggggcaggtgtgggaactgagcatccgagcaggtcgtctgggactccagcagagctctgggcagcagcagggatggggccgaggcccggtctgcattgagctcagtgcttgcacgcccaggtgggcagtctctcatttttggaacagcagtctctcctgaccccctccactgagactgcttttgctggggcccccagcagtcccccagtggaactccacgggcagttccgagggctcctctcacctggccccagcactgcgggatgcaggcgaccccatccttttctcggaccacccccttcccctgacttccaggtctccttgccatctgtacttggtcacctgctgggcccctgcattgaagcaaacacgtcttaagcaaagctcctcacctgctgctcccacctggccccctgcagttgtcctcgtgtctgttgacggtgcctccaccctgccgcctggcatcagctcgcagtcacagggtgttcagagccgacccccaccccccgcccacgccctgcgcatagcccctgccgtccccccgttcgtcctccctgagtctgctctttccccgtgccagggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagtgagtcagcgggggcggggccgcaccgcagggtctgtggttctacacttgatcttagccgaaaggctgagaagtgtcgggtccatggttctttctgccttctgaggactccttcagattctgcctgtggctgtgggcccattctgtcccttagccttgctaacggtagaggcgaccatgatgacacccggtttgtctttgatacagtcatgccatctgctctccagaccacgtttcactgcgtgtccacacgtggccttttttgtagtttttttttcctagccactaggtcatcaggggacttgtcctttaaaaccccttctaggccaggtgctgtggctcacgcctgtaatcccaacactttgggaggccaaagtgggtagatggcttaagcccgggagttccaagaccagcctgggcaacagaaagacaacaaaaatacccccaaacccccccgtctaccagcatccaatctgggacctcaggttcctgtccttggcgtgccttttcagtctcctttaatctagaacagttcccctgcctttctgagctgtttgtgaagttcacagttttgaacagtgcagggtagttccattgtattattactattattttcaagacagggtcttgctctaccgtccaggctggagtgcagtggcataatctcggcttactgtaccttccgcctcttggtctcaagcgatcctcccaggtagctgggactataggcgcaggccagcacacctggctaatttttgcatttttggtagaggtggcgttttcctatgttgcccgggctggtcttgaactcctgagctcaagcgatcctcctgccttggcttctcaaagtgttgggattatgggcgtgagccaccgcgtctggccgcgattttattataaacattaaaaatactagcttttaggaaaacgatattaactgcctggtgaccagcccaccaaagcctgctttagagttgacggcctcaggagtcctcacacagccttggaagaccccattccaggcctgtgatgcgagggagggaaggaagggggtagagttggaagcaggcagcaccgtggctggactggcatgaggtggtttctccagcaaaagctccctttcctcaggaggaagctggcccagttgcaggtggcctatcaccagctcttccaagaatacgacaaccacatcaagagcagcgtggtgggcagtgagcggaagcgagtgagtgcgaccactggggctctagggctggccttgcctcttcctctccccgtggccctgaaccttgagaatgggtagacctgccttagacttgccttagacctgtgtcaggctgcagctgcgacagctcagggaagctgtggggagatggcaaccccaggatgttgctctcaggagtgtcagcaggccatcttaatggggggctgggccagagccttggggtgctccctctgtggggctggggacgtcttgtctccatggacattccctcttgccagccatcgccatctggcacctggctcagcttcccccaagccaaggtaagcccgacagcatttccaccccagtgttggctgggagccttttcctagtttgtcctcatcagacctaagctggggtgcagtttgctagtgatcacattttagcaggacaccgtcaatcgtaagtgtacccagaggagatttataaggacaaagcctgaagccaggtcacatggggaagagttagctacaaaactggccacttaatctctggaggggggcgttggtggggtgtgtctgtgtgtgtctcagggggctggagatgcctgcgtgggaggagtgcacctctgaccaggtggcagagtggaaggactgagggctctcagctgagctgtgcacatggcgggcacaggaccggctggctgtgagtgggtgtggcctgtggcctgtgaagggtgggaggagggctgtggagctggggattctgggaagggaatgtcggcccagctgggaggttgtaccagatgacctcagcggcctcttcagtcctgaaaaaaacctcagcatctcctctgtcgttttgggccgtgacaggacgcagccatctccctgtgcacgctgagatcctgcaatgggccctcaaatcaggggctggcatcacccagcctggtcagccagggccactctttcatccttctcagttcttctcagccagcctcgccctgggctgacgaggctccgtcagctccccttgcccgtccttagggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggtgagggccctcctctctgacccaccctggcactgggacctggagagtctctttggcgtctttttttttttttttgcttttgctttttgagattgagttttgctcttgttgcccaggctggagtgccactagtggcacgatcttggctcactgcaacctctgcctcccgggttcaaacaattctcttgcctcagcctcctgagtagctgggattacaggcgcctgccgccatgcccgtctaatttttgtatttttagtagagacagggtttcaccatgttggcccagctggtctcgaacttctggcctcaggtgatctgcccaccgcagtctctcaaagttctgggattacaggcgtgagccaccgcacccggcctctttggcatcattttgtagtggcctttcgtaagcttctgagccacttgtgctgctccttagacctctcggtgagcttggcattactcgccgacgtatctgtttcctctgcgccgctgggggctctgggaggacagcagtgggttctgctttgttcctgtggtgcctggcgcagtgcctggtgggtggctggcttgtggcgggcacatccctttctgttggatttgccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggtgggcctctgagagcgtgcccgtgtgagcagtgggtgcgacactggggggtcgccagtggtgaccccgcagtgggtgcgacactggggggttgccagtggtgaccacaggagacggatggctcctggtgttctgggttagggctcactgtggtccctctcctctcacctgagcttccaagagctgctttgacactagtccagccaaggagctttacagaaatgcgtggcttgactggacggtttctgttttcaaaggatcgaggacatgaggaagcggcatgtcgaggtctcccaggcccccttgccccccgcccctggtgagtgagcgagaactgggcctgcgggaggaggtgggtggggagggcaggtgctgcgccgcgggaggtcacagttcgaccttcctgttgctctctggagacttgacggcgggagctcgtgtaggccaccccatcggtagcccacccccttccccgaggctaagggaggcatgccgtggtagcggcggctcctggtcttacatgagtggcctgtgagaccaggcctgccattgacagtcctgccaagtctccgtccccctccatcctccccttccctctgactcttctcttttcccagcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcatta

SEQ ID NO: 1776 - DNA, 17700 bp, Homo sapiens; identical to SEQ ID NO: 1775

SEQ ID NO: 1777 - DNA, 17200 bp, Homo sapiens
agcccgttcctgctccgcgcttctggagcactggccaaggcgggccgattcaggacccaggttacttgggcggcgagctggactgtttctactcctccctcctcctccactgcggggtctgaccctactccttgtgtgaggactcctctagttcagagacatattctgttcaccaaacttgactgcgctctatcgaggtcgttaaattcttcggaaatgcctcacatatagtttggcagctaggtatctgatttcatatgcctgtttgctcgttttgcaagacaacatctgcctatcgtcatactgtttctgtgatctgagaatgaatgggctctcctggcacattagaggaatagcacggaggtcactatagctggagcagagtgagggaggggagcacagttggagaggaagggatggggaacccgatggtacagggccttgtaggccgttgtagggagattggcttttacgcagaaggcaacggggatccatggtagggttctcagtagaggaggaatgtgatcggaattacgtcttacactgatcgttctagcagtggtggggagaacagaccatagtgggcaagggtaaaagaagggtggcgtggtaagaggtaattgcagtaatccagctcagagacagtgctttgagcattttattattggaaatttcaaaaatgtacgaaagtagaaaaatgagtatagtaaatctttttggtttgtttgtttttgagagatggagtctcgctctgtcgcccaggctggagtgcagtggcatgatctcagctcactctaacctcctcctcctgggttcaagcgattctcctgcctcagcttcccaggtagctgggactgcaggcgtgcgccactacgcccagctaatttttgtatttttagtagagacggggtttcactatatgttggccagtctggtcttgaactcctgacctcaggtgatctgcctgcctcagactcccaaagtgctgggattacaggtgtgagccactgcgctcggccagtatagtaaatcttacattcacagctaccaacttcaacaattgaaggtatcaacttctgactaattttgtttatatccctcgcaatcctctcccattattattttatttctttttctttctttctttcttttttttttttttttgagacagaatctcgctctgtcaccaggctggagtgcagtggtgtgatctccacccactgcaacttccgcctcctggattcaagcgattcttctgcctcagccgctgggactacagttgtgcaccaccacgcccagctaatttttgtatttttagtagagatggggtttcatcatgttggccaggatggtcttgatctcttgaccttgtcatccgcccgcctcggcctcccaaagtgctgggattacaggcatgagccaccgcgcccggcctctttttttgagacccagtctcactctgtcgcccagaatggagtgcagtggcacgatcttggctcaccgcaacctccatctcccaggtttgagcgattctcctgcctcagcttcccaaatagctgggattacaggcatgcaccatcactcccagctattttttttttttttgtatttttggtaaatacagggttttgtcatgttggccaggctggtcttgaattcctgacctcaagtgatccacttgccatgacctcccaaagtgctgggattacaggtgtgaaccaccatgcctggccaccactattattttcaataacagcttgagatatcattagcatgtcacacagttcatccatttaaagtgtacaattcaatggtttgttgtatgtatattcacaggacattttcgtcacccctcaaagaaaccccataccctttagctcagcttatcttcccctcagccctaagtggcactccccagcaatctttaatccactttatgtctctgtggatttgcctgttgtagacatcttatataaatagactcatacaatgtttaatcttttgtgacttgtttatttctcagcatattttcaagatttgttcatgttatagcatgtggatgtactagattttgtttattcatagttgatggacatttgggttgtttccactctctggctgctatgagtaatgctgctacaagcattcatgtggacacatgtgttttcatttctctccggtatatacctaggagttttcccattatttggaggtgaattcagacatcatctttaaacatttaagtgtgcctctctctaagacaggactctgaaaaacaaccacaatatcattatgacacctaaaatagttaatgttaattgctcagtgtgatcagatcggttgggggatacattttaacaggatttcttgatggattagatgtgctcttgtgtgtgtgtgtgtgtgtgtgtgtatgtgtgtgtgtgtgtgtgagagagagagagagaatcaaaaaagacttttgacagctggaggatggattcgccatcagctgataacaaagaaggccttgggtagatctgggttttggggactgtcggaggtcttagagaggttcgttttgagaaggctactagataaccaagtagaaatgtcgagtttgataaatgaatgtggagtttagaaaagaggtctaattaagcatcaagattggagttcaaggcatgagactggacagaattcctgtgggagtgaatgaagttacagagaagaagatgtcctaggacagagccctggggcagcccaacatgaaggatgggaacccagtgagagtgcctgggcaggagtagccagcaagatagggaggaaaccaggagaaggggctgttctgaaagccaagggtggagtgcagtggcacaatctcagctcactgcaacgtccgcctcctgggttcaagcgattctcttgcttcggcctcccgagtagctgggactacaggcgcgtgtcaccacactctgctaattttttgtattttttttttttgagatggagtctcgctctgttgcccaggctggagtgcagtggcgcgatcccgggttcacgccattctcctgcctcccgggttcacgccattctcctgcctcagcctcctgggtagctggggctacaggcgcccgctaccatgcctggctaattttttgtatttttagtagagacagggtttcactgtgttagccaggatggtctcaatctcctgacctcatgatccacccgtgtcggcctcccaaagtgctgggattacaggcgtgagccaccgtgaccggcaatttttttttttttttttagtagaggcagggtttcaccgtgttagccaggctggtctcgatctcctgacctcatgattggcccgcctcggcctcccaaagtgctgggattacaggtgtgagccactgcgcccggccagacattttaatctcacagttctggagactagaagtccaaaaccaaagggttagcaagcacacaccctcaaaggctctaagagggcaatcctcccttgcctctcccaagcttctgccccatttattcctgggcttgtggctgcctcactccagtctccgaggcagtcccgacatggcctcctccccttgcgtctccctctggcttctctcttctgtctctcataaagacacgttgttggatttagggcccacccacgtcacccagaatgatctcatcttgagatcctacatctgcaaagacccttttcccgaatcacatatgtttcaggggttagaacatgggcatatcttttcggggggctaccattcagcccactacactggatgaggggccggtaccctccacttctcctgcttggaggtgtgtaggggatcaggattcccagcatactgacatctccctccacaaacagtcttgtcccgactctcccatctctggtgaaattcttctatttccagcctggagctaggccttttcaagtcccacatgggtggtccagcacctccctttggaatgggagtatctgctaccccttagactgaaaacccactttagcatcctgatacactaggtgaattatcagcattctgtttaaaatgtagccccagaactcataggctttttctgctgggtaaggatgtgggtctcctgtgactcccctgctgcctttctctttcagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgaggtgaggaaagagtcaggggatccagccctgctgaggggaaggcgtcttctccccacctgcacctctgcgtttcctgggcctggggtggggatgtgctgccctccctcttggtttcaggaagtagactctgagatgcagattagcggggaggaagtttagcatgctctcaggaccagtactgggaagggaaaggagggacaggggaagaagccagggagggcagagggagaagcacgctgccgggtaggctccaggacagccttgctggatcttacagggagctctggagctggaatgaaccttccaggttggaccaacatgtccaggcctctgtgtccctgcactgagcactcatgaagtgctgtccatcctgggacagggcagagtcggcgctgggaagaggcgtggtctgcccagagagggggtggggcctgtcctggaaatgggcggggcatgccctggtagaggggcgtggtctgtcttgggaaggaaggtgcgtggcccccacaggcaacattcctctggggcaatcccggcgcacacctcagcggaggtgaaggctgacttcccacacccagtggctgggactggggagttctttcctagactgccatccgggcgcccctcaccctcttgctgctcagctccaggtcgtcatgggttcagggctcagctgcacgctcctgcccgcgccctgggcgtgatggcacccccagcccctgccattcttccccctcaccccctctccctgccactgctctgcattgccctgggttagcctggcggggccaggtggcacccgccatatactcttgcctttctgctgcgggggccttctaagcctcgggtcccagagctgcagggaggggcggcatagactccccacatggctcactgggtgtggtggggcctgtagccctttttgtttcatcctttggttcctgctggggactcaggcctaagtgtccaccccatcgtggaggacaacaccccttccttgcaggagtcatccctgagctggcagcttcaattggctctccgtgtcctggctggctggcagctcctgggcgaggtggcatgtgccgtgactactagagatcgctgtcatgggcccactcccccgccttctttgctggactgtggtccgagatgttatgtggggctctgtgctgacaagtcacatagtctgtaggcttcagagagtggctctggctgacaccccgtgggcagagacaagacccatgcctgcgatgtgtctcctcttactgtcaaggcaaatcacctttccttccatggaggaaggggtcagtgcagtcagcttgctgtcagggggctgcttggtctcctcgacggtgaggctgaattggagaggccctgctggagcatggagacccaacatgacctgcctgttccaggacagggtcccccacctcagtgccatcggcacctggggctggagaattctcttgtacgttgtagggtgtggagcagagtccctggcctgtacctgctagatgccagtagcacctgtcctgttgtgacaactaacaatatccccagatatttattgccaaatgacccctgggggatacagttgtccctggtgagacccactgtattgggatcttcagagcactggtgcacagagaggtgacagttagactgggggcttctgctcatccccaggagagtgctctattgagggggacttgagggtgagtgttgcaggccagctgtgcagggaccctggcacagcgtatggcgcccttgcttcccttccaggctgtgtgttcagtgcagcagcttccctcgggctccagggacacaaggaggcctcaaggctgtattgactccccctgctccgcctgacctgagctttgtgggtggcaggtgaaacttggtagctccatgtgtcaggccctgggccaagcccctaagggcccagaagatgtctgtcccccaagatgtacatgcttatgtccatggaggaggctgtacttagaatgttgagggagagattcacgaagaagttgcatgtctctagtgtgtgactccactagtgtgagacatgtccagaagtggccaatctgcagaggcagatgcagatgaggagggtgctgggggagcgactgcttatggggtcccggaactgttctggaattagatagtgcggatggttgcacaacctgatggatacaccgaaaactgctgaattagttaaaatagtgaatttgatgtcatgtgaattttacctcagttcagaacattttttaaaagacaagttgccagccaggtgcagtggctcatgcctgtaatccgagcactttgggaggcccaggcggggggatcacctgaggtcaggagtttgagaccagcttggccaacatggtgaaaccccatctctactacaaaaattagctacagacgtggtggcgggcacctataatcccagctacttgggaggctgaggcagggagaattgcttgaacccaggaggtggaggttgcagtgagctgagatcgcgccactgcactccagcctgggcgacagagcgagagtctgtctcaaaaaaaaagacaagttgcagatgagctgagctttgggcagagcaagcgggattctgatggggggtggatgttgcgctcgtcagcaggcaatagttagttggttgagggttttgatcacggggtagctactgcctgccccattttatccagctctgtagttgctatagagttgctagaaccttggcacatcacttatcagttttgtcacctcagatggcttcttcactacttggggtgtctcctgggtgtggggctctccttcctgtggcctctgctgactgcctggcactggcacacatgctctggtgaggggaggaccagcggtttttcccgtttgttttctgcttcctcgtttaaccctcctcgtcttgtaagatgaatgttcttgtctctgttcactatgcagatgaggactttgaggctcagagacgccactaacttgcctggtccaagccttttgggcctctcaggctgcagccagcaatgctgcagtgaagtttgcctgggaggctgaccctaggagtctgcaggcgtgttaggacccccgatctagaagacagcagagatgtaggccagggaggaccaataccgagcatctgagggcaggcacacctcagactgaccagaatacaaatgaattcgagtcacttacaaacaaagtggcataaggccaggcacagtggcccatgcctataatcccagcactttcggaggccgaggtgggaggattgcttgaggccaacgatgtgagaccagcctgggcaacatagcaagaccttgtctctacaaaaataaaaattcaaaaaagtggcatttaacacatactttttttcttttttttgagacagagttttgctctgtcccccaggctggagtgcaatggtgtgatctcggctcactgcaacctccacctcccaggttcaagtgcttctcctgccttagcctcccaagtagctgggattacaggcgtgtgccaccacaccgggctaatttttgtatttttattagagacggggtttcaccatgttggccaagctggtctggagctcctgacctcaggtgatccacccaccttggcctcccaaagtgctgggattacaggcatgagccacagtgcctggccaacacgtacttttaagtgaagctgatgtgtttggtgttattttcttgcagaaagtgaggggcattagtgtaaaggattttggaagtgtttaaagaaacaaaagggagtgttgagacgccatccacccctgagagaagctgcgtggtattatggcgggtgggggcaccaggatgggtggccccacttctggcctctgacttcctgagcctcaggcccatgtgggcccaggcagggcccggcaggccgggctgcccagctcccctccactgtcccctctgccaccagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcaggtagtcggggcagggccaggttctgaaaacccgcggtgacgccagtgttccacaagggaacccgtggtcggggtcccccaaagcaccctggggctcagtgctgtgccgggagggctcggaactcagaaaagccgtcacactcccagttccggtttattacaaggaaaggacacaggttacggtgagcgaaggctcagggcgcacagggcgggctccaggagagaccaggcgtgagcttcagcggctcctcgcccaggggagttgtgcagacggcacctgtttctttcggcaacagtgtgggacagcgagcacggagtcacaaccgggaagctcaccccagccgtggcggccggggttttcacggggggtgggccgcgtgggcaccgagcgcctgcgtggccaaccctggtcactcggctgtagccaccagaggtccagctgtgtggcccaaggctccccccataaatcgtgtcattagcacagaccgcctggtttcagggtctttgtgtgtgggcttggctgatcgcaggatcctggcgatggtagtcaggaaggggccgtgctccctttgaggggcaaggtggagagaagtgctggagaggagacttgctggcgggtacctggcacttgccacagccaggctccactcccctggggaaaggcgtggatggtgggctgtgcacgccgctccactcagggcttagagcgcctggcttaaggcgttgatttcctgtgtgggaagtggatgagttttctacagctgccgtgaccaagcaccacagactgcggggccgaagccacagaaacgcgtggcctcccgcttctggaggcctggaggctgagctagcggtggtgtcggcagggtgggctccccgccagggccgcgagggagctgccttccaggcctctccacggcgccgggggccgccggctgcacctctccagcctccatctccgtcatcctgtggccttgtccccgcgggcctctgtgcctgtcctcctcttttgacaagaacaccggagatacacaaaggtacacaaaagcgggcctttgttcaagctggcaaaagagatcttcttcagaaacccctgcttgcgggggagagagctgagctccgttcccgccccagcagaggcggcctggccttgcgaagggagaaggagggagtcgggagggggcgagtgcaggctcaggtgaaagatgacggggcagccagcgtccttgccgcgaggccagccgtgtgtgggagctgccggtgcttaccaaggttgggatgcttccgtcccgtggagactgggagactgggccccgcgcctcctgaggtttccgtttccaaggagtggctgcggggccctcgggaaagcccctgggttgtgggtgctacacagatgtctcaaagggacagggtaagccctttgtagtaaatgctgtcagaaagggaggtcaggtgttggccggaacagacagtacatgctctgggcagccctgagcgtttccagacgggaactcactcaaaagggggctggggcgtcccaggggcgcggccttaggctcccagaggccccgcgaggtggtggccgggtgtcttcgggcaggggtttgagtgcagtgtgcctgccgagaggttctgcagttcccagtgtttaacaaaattcagtgtccactcttgatctgcacaaactctcccatcctggcggccccgggtgtggactggggcctgtgtttactttgccctattcgtgtctggcctccttttgtcccaagtctcagagagacggagagagatcccctgctggggctgtagctgcaaggccaccgggttcagccctcgaggcctgcttgccggggcagtgactaagccgttgacaacctcaaggcagctttgtgctccttcgtctctttggggatctctttttgccccatctgtgtgtcaccctgtggcagagggttaaggtgggcagctggggagggttgggtggcccttgggctcatgaggccctagggcacccaggtttgggggtgccgagggcaggaaaaaaggcctcatggcgcgcaggcctcagccgcttgcgggttgccccgggcttgcggatggcaggagtgggccgctggggagaaagcagtgctgacaggaagtggctttttatcctgcagcagatggctgaggacaaggcctctgtgaaagcccaggtgacgtccttgctcggggagctgcaggagagccagagtcgcttggaggctgccactaaggaatgccaggctctggagggtcggtgagtcgggggagccggctccggagaccccttccagggtttccaaaagcaatgaggtgggtttaggggcctccagggtgctccttgatgaggatagaccggggcaggctgcgtaaacacgtcggggcagacgtcgggagaggtctgggccaggcatccgggacctgggtcccagccggctctccgcactctgtgaccctttgatggagtttggattatttccttaggaggcattctgggggccccgagcccacacccacagtgtctagttctctggaaggacttctgggaccggcgcacagtcgccctcgtggctgaggttgatgacagggaaaaaggcacagggcaggagccgccagggcaggagccgtggggggagttggagaagccctgtcccagcctcccgctgccctgcgagcggcacagtgagaagcgcctcccacacgggccgtgttcctgcccagggatgcccgctagagactcagcgccctgggtgtttactgggggcaggtcctgtcagcgccctctgccaggcaggtacctaaatccccgactcccagcagcagagcgggtgctcacgtcaaccacgttcttcctacaaatggcctaggtgcagggaccgacctgaccactagagaaagtgtcactgtggcaagggaacttcaccagccaagggccaaccttgccagccggtggcctcaggcctgctggttactctcttttgcaaaggggtcttggttcttgtgagtgggaccattgggtcaaagggcagggaggtttctgtggttctcattcggtcctgcttctgccctccagacagatggatcagctgccaggggggccccagccatcccagcacagtaagcggtcaaggtgcacttggggcagccagcagggcagaggggaggggagcttgacccaggctctgatgggcagagggaacccgtgcagggtgtgggggcagtatgcaggcaggcgcggaggggagagccaagcagccaggcctgccaggcagagttggggtgactggagaagggccgtgtctgcctgtggccagaggccacccaggacctggacagatgcacccaccattgtccctgcagtgaggctgtggaagggcttggtgtggtgggatgaggccagaccctggaaactggaggttaagggagctgtaggggggcaggtgtgggaactgagcatccgagcaggtcgtctgggactccagcagagctctgggcagcagcagggatggggccgaggcccggtctgcattgagctcagtgcttgcacgcccaggtgggcagtctctcatttttggaacagcagtctctcctgaccccctccactgagactgcttttgctggggcccccagcagtcccccagtggaactccacgggcagttccgagggctcctctcacctggccccagcactgcgggatgcaggcgaccccatccttttctcggaccacccccttcccctgacttccaggtctccttgccatctgtacttggtcacctgctgggcccctgcattgaagcaaacacgtcttaagcaaagctcctcacctgctgctcccacctggccccctgcagttgtcctcgtgtctgttgacggtgcctccaccctgccgcctggcatcagctcgcagtcacagggtgttcagagccgacccccaccccccgcccacgccctgcgcatagcccctgccgtccccccgttcgtcctccctgagtctgctctttccccgtgccagggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagtgagtcagcgggggcggggccgcaccgcagggtctgtggttctacacttgatcttagccgaaaggctgagaagtgtcgggtccatggttctttctgccttctgaggactccttcagattctgcctgtggctgtgggcccattctgtcccttagccttgctaacggtagaggcgaccatgatgacacccggtttgtctttgatacagtcatgccatctgctctccagaccacgtttcactgcgtgtccacacgtggccttttttgtagtttttttttcctagccactaggtcatcaggggacttgtcctttaaaaccccttctaggccaggtgctgtggctcacgcctgtaatcccaacactttgggaggccaaagtgggtagatggcttaagcccgggagttccaagaccagcctgggcaacagaaagacaacaaaaatacccccaaacccccccgtctaccagcatccaatctgggacctcaggttcctgtccttggcgtgccttttcagtctcctttaatctagaacagttcccctgcctttctgagctgtttgtgaagttcacagttttgaacagtgcagggtagttccattgtattattactattattttcaagacagggtcttgctctaccgtccaggctggagtgcagtggcataatctcggcttactgtaccttccgcctcttggtctcaagcgatcctcccaggtagctgggactataggcgcaggccagcacacctggctaatttttgcatttttggtagaggtggcgttttcctatgttgcccgggctggtcttgaactcctgagctcaagcgatcctcctgccttggcttctcaaagtgttgggattatgggcgtgagccaccgcgtctggccgcgattttattataaacattaaaaatactagcttttaggaaaacgatattaactgcctggtgaccagcccaccaaagcctgctttagagttgacggcctcaggagtcctcacacagccttggaagaccccattccaggcctgtgatgcgagggagggaaggaagggggtagagttggaagcaggcagcaccgtggctggactggcatgaggtggtttctccagcaaaagctccctttcctcaggaggaagctggcccagttgcaggtggcctatcaccagctcttccaagaatacgacaaccacatcaagagcagcgtggtgggcagtgagcggaagcgagtgagtgcgaccactggggctctagggctggccttgcctcttcctctccccgtggccctgaaccttgagaatgggtagacctgccttagacttgccttagacctgtgtcaggctgcagctgcgacagctcagggaagctgtggggagatggcaaccccaggatgttgctctcaggagtgtcagcaggccatcttaatggggggctgggccagagccttggggtgctccctctgtggggctggggacgtcttgtctccatggacattccctcttgccagccatcgccatctggcacctggctcagcttcccccaagccaaggtaagcccgacagcatttccaccccagtgttggctgggagccttttcctagtttgtcctcatcagacctaagctggggtgcagtttgctagtgatcacattttagcaggacaccgtcaatcgtaagtgtacccagaggagatttataaggacaaagcctgaagccaggtcacatggggaagagttagctacaaaactggccacttaatctctggaggggggcgttggtggggtgtgtctgtgtgtgtctcagggggctggagatgcctgcgtgggaggagtgcacctctgaccaggtggcagagtggaaggactgagggctctcagctgagctgtgcacatggcgggcacaggaccggctggctgtgagtgggtgtggcctgtggcctgtgaagggtgggaggagggctgtggagctggggattctgggaagggaatgtcggcccagctgggaggttgtaccagatgacctcagcggcctcttcagtcctgaaaaaaacctcagcatctcctctgtcgttttgggccgtgacaggacgcagccatctccctgtgcacgctgagatcctgcaatgggccctcaaatcaggggctggcatcacccagcctggtcagccagggccactctttcatccttctcagttcttctcagccagcctcgccctgggctgacgaggctccgtcagctccccttgcccgtccttagggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggtgagggccctcctctctgacccaccctggcactgggacctggagagtctctttggcgtctttttttttttttttgcttttgctttttgagattgagttttgctcttgttgcccaggctggagtgccactagtggcacgatcttggctcactgcaacctctgcctcccgggttcaaacaattctcttgcctcagcctcctgagtagctgggattacaggcgcctgccgccatgcccgtctaatttttgtatttttagtagagacagggtttcaccatgttggcccagctggtctcgaacttctggcctcaggtgatctgcccaccgcagtctctcaaagttctgggattacaggcgtgagccaccgcacccggcctctttggcatcattttgtagtggcctttcgtaagcttctgagccacttgtgctgctccttagacctctcggtgagcttggcattactcgccgacgtatctgtttcctctgcgccgctgggggctctgggaggacagcagtgggttctgctttgttcctgtggtgcctggcgcagtgcctggtgggtggctggcttgtggcgggcacatccctttctgttggatttgccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggtgggcctctgagagcgtgcccgtgtgagcagtgggtgcgacactggggggtcgccagtggtgaccccgcagtgggtgcgacactggggggttgccagtggtgaccacaggagacggatggctcctggtgttctgggttagggctcactgtggtccctctcctctcacctgagcttccaagagctgctttgacactagtccagccaaggagctttacagaaatgcgtggcttgactggacggtttctgttttcaaaggatcgaggacatgaggaagcggcatgtcgaggtctcccaggcccccttgccccccgcccctggtgagtgagcgagaactgggcctgcgggaggaggtgggtggggagggcaggtgctgcgccgcgggaggtcacagttcgaccttcctgttgctctctggagacttgacggcgggagctcgtgtaggccaccccatcggtagcccacccccttccccgaggctaagggaggcatgccgtggtagcggcggctcctggtcttacatgagtggcctgtgagaccaggcctgccattgacagtcctgccaagtctccgtccccctccatcctccccttccctctgactcttctcttttcccagcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcatta

SEQ ID NO: 1778 - DNA, 125369 bp, Homo sapiens
  misc_feature (23203)..(63202): n is a, c, g, or t
cgcggcgcatcccagcctgggcgggacgctcggccgcggcgaggcgggcaagcctggcagggcagagggagccccggctccgaggttgctcttcgcacccgaggatcagtcttggccccaaagcgcgacgcacaaatccacgtgagtgttttcaaattgaatttcaataggaaaacttggggtaactggtgaatttaaaaaaaaaaaaacacagtaaagaaaagcggtaaggttggtagaccctggtgtcgctcaggtccgcctctcttttctgaggacagtgagagagttcacttctgtcaagcgtctgttgctctgcactgtgccagcaggtgcaggaccaggccgacatgggacacttctgagcagccccgctgtcaccaggagaggagttctagctcccaaccatatttaaatttatgtagacctacatatacccacggaagtcagcctttataaagtcgtgtgtaaagagttttccttatatttgagccgggagctttctttttatactataaatatgatgagatcgagtctgaacttaatttctgcaagagaggaattatcccggctttgaaaagttagtccttttgctgaccgcaggtttgacgctcaagtcaccaaaccttctcaggaaaacccttagtaatattaaggcatcaggttacttgcggttatatttgaaatgtattttaaatatttgtcaagcatcgctgctgatgcctaaggaacctcgtgagggcttgtttttccttctaatttggaggcatctaatgaccgaaaaccgtagcgattccatagggtctgaccaggcacagctttcaaatgcagcttccctctctctagggactgcagcccacccagactgaatttcaatgcggtgcgctttgcttaggttacccactcacaatttcccactgcgccgcaggcagtatatttcagctttgagataccttgttttaaaattccagacaaaatggtgttgaggaaatgtctccttactagtcccatcaacttctgttaaaagaggaaaatttatggaatttgaaaatactgcgtatgatatttaaactttcatagacattcaaatgcttttaaggccaggttcaatttggttatgagtcgaggggtgggggggacccacatagaaatgtcctgggtcctcttgagtttatttctttgtttgaagatgtttgttcaatgagttttattgtactcatcttttatatggaattttaaaaagtaacaatttcagtattatttatattagaatgtgtcagaattatttccgtgacaaatcagatcatttgggctatggcttaaaatgtacacgaggcaaatattcatgacaagaagattcaccttcttacgctggcatcttgtaaaatgcagaacaagttaaagaaataatgtgtacacatacaaataatgatgtcacattaaaaatactacactattcttgcttgatggaatgtatctgatttccaatttcaccatgaacatatttcatacattttttacatgaaaaaaaacgtgactcttaagtctcacagtcaatcagagctggtgaccagaacattttattgaactaaatggtcatgttttcttccccttttgtttcacggtgagagttgaaggaaggagtttagaaactctccagtacttgtttaattcatcagtgttctaattagagtggtacctcttggaaaactacacacccccctaatgcagaaacatcatagcaataatcacccactctcagggtctccaggagaccacaagggctgcagataaaagtctggatgtgttaggtttgaccctttcgaagagttttacacaggctcctaaagagaagatcagctgtggccgtttgtagccatttcctttgtcgaaaaactaagatcgcagtgaatgtattagccaagaggtctaaagccctgttgtactgcaggccactgtcttccttgtttgactagagacttggagtttgagaacagtggttctttggtttggatacattttttgttcttgatttggatgtgtgtgtttcatgcgtggttaatatagcatattttcaatataaatgtcaaaaattttgaaataggaaagaactctctatatattaatgtacttatacacacacttcaagattatgcatttattaacagatacatgaaataaattccatgtgcatatgcacatatgcacacagagcgtgcacacacacagcatgcacacagcgtggagtgagaggcatggggcagtgtggaagagttttaacatcaaacagacctgaaatgagtattaaaggccccctttatttttaaacttttactaaaacaagatggatttccctatgttatataatggtgaattttaggcataaataacgttttttgagtgttgcataattgtacgtattaatgtaatgtaactgtggttaacgaagaattcatcaaggatatcactgttttgtggcattttttttttcctcctctaatctttggacttgtgaaataatttcactatgaaataaatgttggttcttgtcatattctaagggagattgatgtaagtggctccactccagcttacagaaggtaaaccacgacctttttgcgttctctgaaaacgcttgtcttccgatgcctctgtttctaagactgacaagcactctgggggcactgtgacgcctgcttctagcggcagagttgctgcagctcctgtcctggctgtgaacattgttctctctctggtgtctctatgttcataactacagagacttcagctctattccatttcatatttgtgctgaataatcattccattttatgggagaaaacacaagatgtaaaagcaacaagtgacccatcctttgaagcttacaagaagagaaacattaatctatttcacgtcttgaaaacagatcagttttattttgctcaaaaagggcacatgtacatttttgatctaggtcttagaaacgtagagtttcagaggatcagcattatacacactgtcacacacacacacacttaaaattcagatgaggaacaagataggaatgaggttttgttagggacgcagagcacctaaaaccaaaggatatcgacagtaacaaagctgtttttactgtagtgctgactgaacactcatgctggtgtcttcatgtggaccatggctttcttgtatttctttgcagtttaataaatgacttcatatctcaggttacctttccacatctcctggaatatatgtttatgtccttaaagtttcagtgtcgtcactttagtagctttagtttgagtttttaaatgtttggtaatattccaacaaatattttttaagacattatgaaaccttatgaagtgccatatattacaagtgagataaaacagcaagcaaaagaaggtttgcagaaggtttttaagtggcgaagtgcgggcctgcccattttggtgtctccttggtggttactcctgagaagggcctggaggaagagcaactgaggcctaatctacaggcaactgccaaattgtttcagttgacgtttttccctctcatgtttgactataataaataggtagttgccagtggagccttcagccaaccacctggtaataaactgttaaaaatggtgcaaaccctaggtcacaggtgtgggggccatttgtcttgcctgttaacaggcctggccttaattcttttctcccatggccatttctgcctttggggaactcacaattcctgttgactaaaagagcacccttttccaccacaagcctgacaaatcagacgtccacataatttctgaactcgttttggttaggacaggaagcacaggctcccttcctgtctgtgttttcctaagagaaaacggtcttccctccttttttgcatatttggcaagtggttccacctttctctgcaccctggtggagtgtgaaggcagcagaggaaccttttggaggaggaagaggacacagaggccctgtagccaggcaccaagatccctcccaggtggctgggtctgaggggaactccgagcagccctaggtcctcaaagtctggatttgtgtggaaaaggcagctctcacttggccttggcgaggcctcggttggttggtgagtgccacacggtttctttgtgtgcttgcatggattggaatagccattgtgttcttccgtcttccctgctggtgtttccacagtgggtggcctgagcccagagcagctccccatatccctgtgcaggccacctgtctcgggtgatggagagcatcattatgctccgtctgaacgctctgctttcggatggccccatgctccacctcctgatagctcgtggcgcggggccacggcttaacgaatggctgaaaatgggtcctaattagtggaaaagtgctttcttcatattttctcactcgagtgtgcagtgattcatttttcttctgcaatcagctcactgctaaagtaaatctgactctcttcccgccattgcacaccaaaagttaactctaatgggtaggaggttaggtttgttgagagagcaatgcagtaaaaagaggggatccaatgtggtcttgtctgtctggtcttcctttcttcgttttttcctcccttgtcttctctgtcattcccttccctccatttgccttgcctttcctgtccttcccttcccttccttcccctctttctttctataattggtggggggtttgcacagactgccaaaacactaagaactgtgtaaagtgtttttgaatggccttacacatattgaagtagatttttatgctccatttttgagatcacacactaaaatctatacctttaaagcattttctgttagtttgaaactatttgaaaatgaacaatgtggtttagattagagtcctgttctgaagctaggagttccactatgaatattgatttatcagtttttgacaaatttttgttgttataccagattttcactggcaaacctagagcaaataaaattccacataagatacttccctagacctaatgggaaaaatgtttaatttagagtctttaggagaaatgagaatgaggaattgaccttttgtaagcttacttctgaggcactctgaagtgtgttccagtgcttttaatggaaactagagagagccagcaaccccctagtgtgagccccacttttaaccggaaaaagtgaccttttcctcctcctttgtgctgagttttgcgtagggcagaaaattaagctgatattcaaagagattcactgcaaaaacatattgataaatcgtatattctatttcattaaattaaaaccatactgctaattatctcaggttgttaaacataaggcaattaattatcattttaaaagttggtaggaagttgtgagtacttttgcagtatgagtgttttcccgctttagtatgaggttgtgtatgtttgcttgaatttacagaattttcactttaagagcagacaatgttttgttaaagaaatgaaatttgctaaaaaggagcatgtaaagtgaaacattaaaaataaataatttcaacttacttaagagctgcagaaaaatctgattgctgtgtttaaaatgaattttcccacatttcgctctcttatggacaggagcattttctgtcaggttataaataaagacatgcccattttttgtacccccacaaatgaggaagttgtaagctctctgaggttttactgatgagccccctccccctgggtttgcatgaagagatcataggccacaaataaaggactacaaaatggggtctaaactatcctggtggggcctgatacccacgtttcgcatggaccttacgatgtgatgaatggttttggcatgagtgtcttaagaatgcttccagattcaggttacaggacagccagcgctgagctccctattgcagaacaaagtaggaatctagaactttcttgctaacaggatccagctaaaacaccaagttagattcttaaatgatgttcttttctgtcattatttgattgttgtcagtagcagtaattgttaccaagccattgatgcttctattcttccctttgcccttctgagacacagctcattttgacttcagtggaacccctcgaaggtggggtgatgagcaaggtgaattttcaaagtaaagctactaagagaccaaactacaatttaaggaacctgatttttgaatcaaattccatatactgtgggtatagttcaacatagattaatttcttatagttattatgaaaaaaatctcatcttgatgatagctgataattttgtgggtgtcgtaaacaaaacagaggtcagaattcagtcccttggggaaaatttccaattagtaggaaaccaagtggcctaccttagtttgaagacacccatcaggatgtctgcaccttttcatcctctctggaggaaagactaaatacccattattgtatataggtcaggccaaagcagccttttatattgcaaggaataagaggtaaatagatatatgtgcaacaatgaatcccctaatgtgtttactctagaacacatgttctttctgtatttatatgtagattttgtagatcttgtcttaccacctgctaatggtagatactgtatctaaataagttgaggaaaatttatagtacctaggaatgtgtcctcagtgggccaatcaatcaatcatgacttcaggttatttttaataaatatacacgtatgggttcataaacaatgggatgttcttgtgaagatctaaataattttacttctttgggactaaataaaatatagcttttgccaaataaactcacacaagcacttattttaatagaagtcaaatggctttgcagaaacttcagttttacaggtgcattgtttgaaatgttacgggtatacaagtggatttctctattatgtacagtgttaagtttgagtttcaaaatgtccacctgaaatgatttacttgtacgttaagataatttaactgctaagaaggcaagataaagcattctttgtgacaccatatggccttgctgagggaaaaacttactgttataagtttgtgtttatctctctttttaaaaaaaaatgaagaaaaaaacgtttaaaataatgggaacacagcagttcctggggtcctctgtctctttatcttattatagtaaattaccaaaaaaataatgacctggggcatgtctgtgtggacccttcttttggaggcagtttctgtgttttgtaaagctgtaggttctattttcattgcacttcatattgctgcacagctcctgaccatgcatgaaggtcctctgaaatcggtaagagggcagaagaaaatgattctaaacttagatttttttaacttaagtgatgaagtgtgaaacgccatttatatttgaggaagctacctaggaagtggctcatgtcgatggcccaaatcagaagagggcctgtaaaagcttctatcaattttgactgtgtatgcttctaccatggcggctcaataaacagcagtattagtttaagagtggatggtacagtagtatagacgggaagcctctcctctccgtgtgaaccgtgcacccctatgagagggtagagacaatacaatatgcctgtaacgtcaggacagacagtcatggccagcttgaactccagccctgggcttcttgcagcaacaaacgtgaacacagaggactgtctccaactccactttctctatttttaaaacaactttttgaatacagtatctgccatcttttcttatacctcactttgaaacaggtggctccactgtggcatttaaaatgttctgtttcttttccctctgtatcaaatacctctttaccaagaaaacattcaaacagcatagtttttaactgtattttgaaaggtttccttagttccctttgacccttcctcttttgcatatcagttcctggccataaaaataaaaaatgctaggacagaattgcacatctgagctgatttgccctcaaaaagtttcacagtggaacaaaccgcaggaggagttttctgtggctcagttaaatgtcgggggagggtggtgtgaaagccaaattggattcctgctttcctgtttaaatcttgtttttcattgttatttgcaccagcaatactctgtggaataatcatgaaaatgtgtagattggcagctaatttttgaaaaatgaaaagaatcagaaatgaaataagagtgctcggaagtttttatgttctctcaacctgttttgtcaaattgttacgaaaacctataaggtctctttgactagatacaaagactttgcatattgccttagctttctcttgaagcatttccttttttaaaatacagtgtaattcacagtgatatgatagatttgcaaaagtaaaatctaccagtctgaagatgaaaggacttgtctcttagcaggaataatgggttttattaaagaggtctgtgacctaaggcattttaaataaattacaggcttggtccctgtctctcccatgtatctactcccttcaatataagcatcattgagtatttaaggaaataaccccaaatgtaactctagtgtagcttcacttgtcagggaggaaaaagtaaatagcatacatttggccaaataaccagaactttactgtagaagttttatgatgaaatttgcctttagtgcagagtattacaaagatcatgtttagtttctagcagtatataagtagcatccatccttatctgtcatgcatttggagtgcgcgacccctgcactgggctgcaacattctgatgggcaagagtgctagagagaaagaggcatcaccatcagactgcacgggttcaagtgtcagctctgtggttgattagctgtgtgacctggggaaagctatttctcttagccttggttctctcatctataaaatggagataatgatgcagatgccttgggtttaattgggagagttaaagacacatttacatatttagcaagtaggtgttgaattctagctctacattggacactatgccaggtgctcaaataaacaagtggacaagacagacaacacccatggtcttatgaggcttaaccatttgcctcttcaatgccagaaacttagtaggttgattagataaagccagtgagtaccagtatccttttctttgcagccttttcctggcacactaaaaatactcagtacatatgaaatatcactggacaaagaatcccccttagagtaccaatggagaaggaaggcatttgcttaaaagcaaaccaacagaaagacattgtaaggcagttgtttaagtctcagagacctataatttttttcttttttcttttttttcatctcgctctgtcgcccaggctggagtgcagtggcacaatctcagctcactgcaagctccaccttccgggttcatgccattcttctgcctcagcctcccaagtagcagagactacaggtgcccgccaccacacctggctaattttttgtatttttagtggagacggggtttcgccgtgttagccaggatggtcttgatctcctgacctcatgatccgcctgcctcggcctcccaaagtgctgggattactggcatgagccaccacgcccggcaactacaattgttcttaaagcttgtagaattactgtgtgctaccaacagacaggctaattttgagtgaccctcagtactttgtacagttaatttggcacgctgtgtacttagtggctttttaacagctataaatttgggctgctagaaaagtagtaaagttgtgattcttgacaggcatctatctgcattttcatttttacttcatttgtctagactcagcttgtcagaattatggaagagactccttgtgtcagggcaagcactgtgaagagaggtattcactgtcagaaaagagaggggagctggaggcagctcagaggcctgagacccgcctccacaggagccccagcaggttcggtggagctctggccacactctcctttgggatgctgaagtcagaatgagttcacttcccagccagtcttgccaaggctcctcacctggaagcagcaactgcccagggctgttggatgtttctccccaggggacagccaggtcccagtcccacctcggtgtggaaggaggaaaggcagggtccaggaagctgtttcaggacaggcccaaggtcccccagggatgcctttcagggtcagcggaggctgtaaatcagcagggcccacacggcctggaagaggcccctgtgctgtcggcttgcccggcttgcccggctcctagtccggcttctgctcctcctttgtaaagttatggatatgctaatagtttccaactgagactaggaaagtaagtcctacttgacactgtttggtcagaaagagggagagaaaggagaaggacagagagagactgagagagagacagtctcagacaaagggagacggagggagggagggagagacagagaaagagatgggaggtaggtgtgggaggagggagagatgcagaaggcagaggaaagacagacagagatttagacctcccaagtcagtgagcagtccagagttggagtggagggtgcctggtggcttgtgactgcagactccactccccgctcctagaggcacagccatggacagcttctgtcacgttggccctgcacttatctctgcatctatttccccttgtgcaagattcagaactgcatgctccaaaaaaacaataaaagcattcatgttcataagaattgcacaggtaaaaggtagtttgctgatattgttgtattttttactatcgcttcttttagctcttgcctgaaattgtttgggtttcccaggcaaagtagaaaactgcggtacgtttctgtgaaataattattccttctggcatctccctttacagacctactgatcttgatttttcatttaggtgaaagtttgtgaaaacatgccattagcttgctttgtgattaactccttttactgaatgtgagctccttttaaattgaggccatatcaagcttaaattccatattttacccggcactctgcatttcttccatgtgggagaggaggggctcagtaagtgctttgtaaaatacacagccgaagtgatgcacgtgctaacaaaggagtgtgacaggacttaagtgcccttctagacacttcaggctcccctttgtaagctgtcttggaagaggccacatttcctttccctcaaacagtttctcattgtttgattattcttttagcctttctctggaagcaaagccacttttacgagaaagtcactgctttttcatctcaagagatgcaagtttggagtttggggaagttttcaggtgcccgtcaagtcatcctttatgatgtcagacgagtcaggccacagaattcacagggctcagtgcagaccgaaaacttgaggcctcttgttcagaaattattaaaaattttggtgaacatcaccccaagcaaagagatcccctaagcaccagcccccaagcaactgcactcataagcccatgaagccccctgctgtcagaaacaatgtggttgaaattgtgtatgcacttggaagtgagatggattgcaaaacacaggtctccatgctggggcaggagtggtgatagggcatggagtggaaatgtccagcaggcccacgtgcgaaaatgcagagctctctggctcttgcagacttggctgctgacaatagacgcgctccaggaaggtgctcgctgtggtgtgatctgctgcccacccctagctccctccaggagactggtgcggggactgtttgcaaatgactgcaaaagtaagaaggttcccacagagcagagcttgatttggggaccagccgagggcagtttgtcaggattccggcttgaaactgttctcacatctcaccgcctgaaaggacgagtgtgtccagaggacttagcattgatcacctctgtctccatgcagcaaactcagaggctcagcccgcattccactggaagggcgtttgccagtggtgttggttggaagagccttgactttgccttaggaaacatctttttttaagaattgaaaataacttgagtatgcaacagtagggcatttgttatataaattagttgactagtgtgtagccagtaaaatgatgatggtggtgtgtatttgttaaataaaaagatatgtgtggtattaaattaaaaaatattttaaaacaacatatttgtaatctgtttagtgtcctctttttgtaaaaagtacagaaataaatatacagaaaaaatagtagtcctaagtggtagaaattatgagcattttcttgcctttaaaaaaagttgtaaaagattgtatcatttatgtagcaaaaagttttaagtcagcattctaaaaatttcgtgttgttatagttgctgtgacaagatttaacttctgtatgcttcaccaatcaatacagaggtatttaagacccggtgtgtgataggccgcgctaaaatactatacacatcttcagaaaactagagaactaacttctaacttcctatattagtgtggcacggctgttacaaagatttttctcatttgagtctatcttgcttctttatcattgttttgacagtttcagaagaatcgtggcttttccccttttttacagtaaaggtacctgagactcttgacgtattgctttttggaaatgcttgtgctggtcacatgcttgcatctgggctagtgtgtctggcttccgtgtgctggtggatgcttactctgttttctgaaatactttttctgtacagtggccactagctgtactcctaagccacacacctaccttgaaaattcatgtcacttttagaaatagataaaagcccctcccatccagaaaaagtgactatcatgtatatcctcatcatgactaatactgatattcctgaaattgaaaatacatattccatatgtaccataaaaggtattaaagatatatggagtgatagatatattatatataacacttctaccctcacagttttcagcctaattgagagggtaagatccctgaatcatccatcagtttttcaggtctctgctgaaagcaggccacagctcagatccacacatctgaaccagagacagaggtggccaaaaataaaaagggggacagggggacaacctggtttagagtcaacaaatagactgcattttctggttagtgaaggagctctcctgaaagtcatataccagagcataaatgagcagatttccttgaggtcaccttctgctggccatagctttcttatctgtggagctgccagctgtcatccactttggggcacctgagactgccgagcggcaggccaggacccaagtgcgaaacacagaacacctttttgtttctactccactgatgctggggttctctccctggtgtttgtggctcgtagtacactctgtggaacattcactatggtcatcgaagggcagcatcttcccagttgtttctttcttttcttttttttttttaatttaaaccgatctgagaagccagccatctgtcagcaaaacaggaaggctcgggctctctcctgggctcgttttgctgccgtagtgagcgtcacttctccccgtgtaagagtgctggtgaaggctgaggcaagggcccagaaagattgagggacaaagacaggagcgcccgcattgcccatctgccaggctggaggtgtattcattattgatggaggtagtgcagttgctgctcagatatgcagccctgcctgggtaaatgagacattcttcagcaaattgcttcgttttttgattgctgattgtacgcgtgtcaccaagctgactcaaggttcatcgatgcatgctcagtaaattagaaagaacataactatggatcagccaagagaatgaattctgtgcctacaatgacccagggccatttaattttctgcttaattttgttgcagtcagtttgcattttgggttattatgcagtaggaaattaacaataaataacaaatttggtcctcctgtgcttgtaatgatatttttataaatctttgtaatgctgtttttaaaaggatcaaggtctgtgccagtctgatactccagcaagtatgtgaggaggaaaatgcattattcttgctagataaccttgttgttaaatagcataggggttctttatctctctctctttctcatatcttattagtatttttgctttaaactaaaatcccttcctctctttctcagataacctgaggaccatggatgctgatgagggtcaagacatgtcccaagtttcaggtgagaccttatgagatagctgtgtgggaagttcatgagaaaagcttccctggggccggaagtcacagtgcttggtatgctcatgggggaggaataggggctattctgcaaaagaaaagaccatgatggaatttgcctgagtgtttccttcacctgttacaaattatctcactttgagctgaacagaaagcctccaagatgaaattagttttactgttaaacttcaggaaaaaaaaacgggaagagttaaatacatttttgtactgttggaaggaaaaatggctgattggtttaaaacccaaacacatgccaatgatggtacttaaagagagagagagagagaagcttgaaaaacataattgttgggcacagtcatgactgtttgttcattaagcatggacacaacattgctcccctttgccatatatcttttcaagccgtattggatatagctcttctcatccaggagacccaggaagtggagaagtctgtagtaggaaaagcctaagggtaggtcacagactgtgaccatttggcagcactgagggtggacggcgagccagtccaacaaaaccgcacagttccccagtgcatggacataggaagacagctttctatctggccctgtatccagaggcgtcagccccagtagcagctttcatggactttggggttttcggtatttcatatttttgagcctcacagactcacagccagccccagaggctgacttatatttgagaaagttctcagtggcaccttgccttggctgagcgccctcgtgttttgaagtttctatgggattctacaagttggtgctcctgatgaagaccaggacctatgtgtggctgctcccctgcttggtggtttccctggggaaggtgcaggagaggatcttctgagttccatggaactggagatagatctgccaatcacaggcttccttctccaccactcctcagccgctctattcatgtttcagattttggacttaaactctcccaggtgcaaagaacaaacaaaaggctagcttatttttcttttagagtgaggcttcgtatttattacaatataattgccacattctttgtgtaattctcacatttatatcttaaatataattctcatgaatgagaattatataattctctttttgtatatcattgaatattttcacttaatttttaatttttttaatcgtcacaaaataattgtgtacatagacacaaaataattgggtacatagtgatgttgtgatatatacaatgtatagtaatcggatcaggtaaatcagcatattcatcatctcaaacatttatcgtttctttgtattaggaacattcgacatcttccttctagctatttgaaactatatattattgttgactacagtcatcctgcaatggtgtagaacactagaacttattcttcctacctagctgtaattttgtctcctttaacaaatctctccctatcttccactcccccgacctttccagcctctattagcctctgtcctactttctacttataatgatgacagcagcatttgttagtttccacatgtgagtgagaacatgtggctttttaacttttagaatgtggtattcaggcacttcatggtacagttggtaaaagtgaaaatgtgtccaaaagtttgtgattatctatataaacaaaaatggtataaatccaaatatcaattttgcattgaagaacttaccttagaggtatattctcacaagtgcacagagcatttaagcatttgttcactgcagcattgttatcagtattttaaaactatggtacatccatgtacttccacatacagctcttaaaaataaggaggatatgaatgaactagtatgaaaagaagtccaaatacatgtgaaagtgagaatagcatggttctggatggtatgcaaagtatgatctcgttcttttaaaagaaaataaattacatacacatacatattttctatatgcttgcccataacgtttaggaaaattcttgggtgatatttattaacctggacttcctcttggaagactgatggtagaaggaaggggacgagttagggaagaggaggagaaggaaaactttgcttttcatcttctaccttttagcattatttgaatttattttccttaagcgtttactttgtttcgtaaacaaaaaagcacaaaaacaaaaaacgagttaaatgggaaaaaaagcagtttagctctttatagcctctcatttggcttcgccagcctctcactgcagcctcagagagctggtctgggaaacactggtagatgaggactgtaatcctcactcatggaagaggatctcattcactgggtttgctgactgtgactagaagtgattagggtgtcaaaaaacccaagcatgttaaaaatttccagaggccaaaaagatgctttcattgttctgctcttcttttccttgtcgctttcactttgggtagcttctaaattggtattttgcatggtgcatttaaagaaaatgagacccctttggccaatgcaggagtctacactctgatattctagagtcaaagctgaatgctgacacctaggaattcatctctagaatgtttatataaggaatagcccctcagtattccgatctcgtatcttagtaacgaaactaacaaaagcctgattctcctctggtagttttcttgtctttaccataatacaaaataagtaatttgttctgcaccctgactgttcaaaggatagggtagctgggggcggggacaagaatggagaccttattacataagacttcctgaaaaaggaaactctgtttttgtttgaaatgatttggtctgaaatttagtttgtgtacacttaccaaagggattcctatttctaaaatactcatactgcttttgattcctgttaacctttgagcactctacgtaatgatgagagcacttaaagagtcatgtcacttttagtaaagaatcaaagaatactttttctacttcttcgagtttgatctctgcttctccagttaaaaccagtatttgtttttttcatttctaaagttggaagaaatgacagttagttatggcataaggatgtacatttaaccaaataggagttgacattcttggtaagaaatcttaccaagattatgttatagattataagaaatcttatcaagaatatgttcctaaatcatcctcttttcccataaaatattaaagtatcagcaatttcataggattcaacctaatgtatgcgaaatgctagataaacagataaatacttaatatctggctttttttcaaagcactgggttatttgttccttgagatttatcctaaatgtgggctataccctggtttacagtgtctcacagatgtgtagtagtagacactccataagtgtttactgacttgaatccacagggtactgagaaaatgctactgatagacttggaggagagcatatctaaagcaagctaccctttcctttagggcacgtctcactaattctttgggtaaagcgtatttttcttccttttgtgtttttggcagtctttccaaaaatacgtgttatacctatgcattattttttggtttggtttctaaagaaagagtcagccggtgggaaagtgaaggatgtgggaactgagagatctgcatcagcatcccacctctacctcccacgatgggacctgagacagttatttttgcctcctggaccactatagtatcatctgtaacaggagggacttgagccagttgatctctaaggttcctctggcacctgtgaccctaaatagatattggatattggtttaatgctatttgtagtgtgtttttttggggatatggaaaccagaagtttgtttccataaacataaacataaactgtatatatctaaaggatatggaaacctttagatatatataatctgcttacgtaaagaaggtttgtatatattgcagtgtcaatgggaatattttatcaagttaagcatagtaaatcacattgattaaatgctttgtatttaccaaacattacccaaagtgttttctcctttcaacctcacaaggacccacagaagaaaatacagttatcatttccaacctgcagggagctgagacacagagaatttaagcaactgaccggaagtccaacagggagtcagagattgctctggggtgtgatccccacttggaccctagagtggaagcttctccactactttatagagttgagattctatattttgagcttgtatttacccagagaattatatcctcttgggcaattgtgtataataaaacctcatgcatttaggagaggcgggatgacagaactttgttgagtgaattataatctacttgagaaattatttgcttacattttataagctaattataccatatctcatccagttttcccagaacacttctcataggtaatgctttatttgaaacataggccataggtaagttaagtgtaaatgtgtatttttataatttaaccagaagtttatttcatttttctaaataagtgaaattgtattgcatcttctaaattattctatttaaacacttgatgtcttgctgtctccgtctctgtgtgtttgcatgtcattgtacatgttcttaggaaaagtgtgggagcttgacgcaatatataccttatgtttctatgtgcatatagtttaccaaataataccataagtttacttagcatattagaatccatgcacattatttttattttatcttcaccgcaaccctgtgggatagaccaaaatcatgcttttcagcctcctttttccacttgaggaaaggagtcttaaaaaagggaccagtctcatgttcccattcgtcttacaactaattggtcaagccagaaagccagaactatgtcctgggtcactaactcctagtcactgtgtgttagtatttgagatgcctgttggcttgatttagtcatttattttttagtgttttataatccttgcatacttttacattttaaatggttaaccaggcaaattggtttaaaatcagtgcataaaaatactgtgcctatcatgatgggtttcatgaagtgataacttttcatcatggagatcctcagctgtcacagaagatgaggggccctgggtacagaggctcacgtgagggatgaaagtctcagcagcccggacttacactttggggcttttaggcaaatcagacaacctcttaagaactatcactgagttcaggcaaggcgagcttgaattaacacagggcccttggtgggcatgtgaatatatctcacttcactaccatccagttctgactctttacgagatgcccctgtacataccaagactgattttttattctcccttctccccatgtggtttcttctgcatagagagttcctattgatcagtctgacccatggtattttagaattgcgatccctactgtttcattattcctttttctcccccatgttgaaaaaaataaatgtcctgagatgcaagatcagggacactggagcactgacatttagttcagtgcaggaactgaaggcagatgtaattcttaagaagcgtacctgttattatgaaccatcctcaacaaattgtagtggatcttgttttctcatagatacagcagttaaattttttaataaaagtaactaagagttatttggatgtattttagcatgcactgagcggaaagtacgacatttcttcattgggtaagtcctgattctttatgatcctcacttggttccagggccccatgcatctaagggtgtctcagagcatcctgcagtgctccagcatgatcgcagggaaaagctataggaggaaaagagtcaataaagtttagtttctcaacctcccacctccaccccataataatgacagctggttaatcatgagacacgtgcacaccccacacgccctgtacatgtttactcattgggatagcatgtcaggccagaaggctccatggtcatttctatgaaggtactttagcaggtcttcaagaaggcaagtggcctgggtccctgcctccccaaattgcaagctccctgctttatgtaggagacctatgtgtatattacagttctgtgtaagattattttgttattcttacccccacacccaccccccaaccccccgctgccaccaaaaaaaaaaaaaaaaattcctctgacaaccttcataaagtcctgggagtttgaacaccattgctctaggaagtcatcttatacaaaaataagagttgtgaggtggttcatatacctcctgcgttctcctatttggagtttttccccatttatgaaagaggtgaaaacgctaagatatttagcaattgttactttaaacattttctatttataggccgggcgcagtggctcatgcctgtaatcccagcgcttgggaggccaaggcaggcagatcacgaggtcaggagatcgagaccatcttggctaacacggtgaaaccctgtctctactaaaaaaatacaaaaatttagttgggcatggtgggggatacctgtggtcccagctactcgggaggctgagacaggagaatggcttgaacctgggaggccgagcttgcagtgagccaagatcgcgccactgcactccagcctgggtgacagagcaagactctgtctcgaaaaaaaaaaaaaattctatttacagcagtgaaaatagtagcgacttaatgcacattgccaaggctttagcataacatgaacactttcactcaatgtctctctggccttttgtttttccttgggaaattcttataatcctgctccgtctttaactattcattttgtattggctatccaaatatacccaataatgctctttctgaaaatatgccaattgtggtaattacagctaagctggaatattaaattgtgatgtctgttttccagagaatgaagtagtattccccagagcataggcttggtgcctgtgcaggttctattttaaatattccaggaagggttgttttatatactgaggatgattttactggtcttgccagtcgtctgaaatgctggtattactcttgtggaaggtttattcaaacaaacaaggacatttcacacaatacctagtcatgtttttcagacattttaatgtttggttcatcatttgcacacactctcaaaaatctaggtttgtctatgtgttcatatcattttgcctgttgccagctcagtcagcaggcacactctcccaggctgttgctgttttgttagacttcttcaggaccttcatctaaaatggtcttccacacgtagctatactgcataagttcacatcatctgtttcttgcatgtgggttgtgtctcaactcaagtttaagttagatttggaagggcggaaactataggagttgcagcttcagtggagaaaagagcatttcctactagttatggcttcccaaggaaggttagattcctcagagtaggagtgattccccaatgctagaacctttggtcaaatataattctaatccagtcaaaataaatacaggtattctgtaaaacccgatttcattttgtaaatcctactttgtatagtataagcaatttttgtatttgtgtggattatattttattttcctatttcaaagagaagaatttgtattagcagactccctttgcatgcggagaggggatcattttcccagtaggcatggggttcccttccattccttgtccagtcttcttttccccactaagttaagtcaaactaagcagctggtaagatattccctggttcttgcaaagaaagtgagcagatggcagaatgtatagctctaagcagaatacctggtgtggtatcctcaaacacaaattgacaggagggtgtggtgtggcaagctcattgtgggggtaaattggaataagcttacagggggaagagttgacaaaagataggaagaaccttaaaaatatagatgccttttatgcagtgataaaatgtctagatatttatactgtggtgattattaggaatatgtgcaaagattggctattaggatgttcattacagtgttgtttaataattataaaaggacagaaagcaatgtggactcaaaaataggaaaagaatttaaataaatcctagtgtacccgttatacatgaaattatggaaatatgaccctgagcatggaaatatgtacatgagaatgtctaaaagctagttcattttgaaaaacaaaataatgtcacctcatattatttatagtatataaagatgattttaagagtggcagtgtctgggattataggtgattgtatttcttcccttttgcacatctatgttctctcatttgtattgtgtggggagaagtgactttttttataaaaagaaaaaggtatatgcatcccagcagagaagcactggctccacccagtacctgcctcctcatgccaccctctcaagccaaaagccgggggaagcccaggcaccttgaccatgaccgcccgagactcacacttcttctttctcatcagggaaggaaagcccccctgtaagcgatactccagatgagggcgatgagcccatgccgatccccgaggacctctccaccacctcgggaggacagcaaagctccaagagtgacagagtcgtgggtaagtgggtcaccagcggcctctgtgcctgtgaaacctttatctctttgtatttttccaagacagtgatgaagggatgcaagtcattttatccattgtgttccctcaactggcatattaaagaaatatggcacaaagatcagcaggatgggggtcctctggtgtgtgggaggatggacactcacaggccagcatggccgtgagagccacacaccccgcaaaatgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagctttgattgggccgttactgtcttttgacctttcttgtttgcttgcccttttgtttctttcctcctttttccttccttcctgtctttcttcttccttccttcctttcttcctttttctttttaattttcctcctttctctttctcctttctttccttccttctttcctctttttttctttcctccctccctccctttctttcttccttcctttctttcttccctccttccctccccaccctccctcccttcccctcgtctcccttcccctcgtctcccttcccctcccctccctccctcccttcctcctttttctttccctttcctccttccttccttcctctcttcttttctccatccctttcttccttttaacatttgatcatgggtaccatttcatcaagattctgttacttaggtccaaggactagtgaccaaattgtttttcccaggagtaaacttttctacaagacatagagaaatgactgccagtgccatcaggcacaccatcctgtgtgataggtaacctaaaataatggtacagcggggagtaactggaagagtcacaactacacaaatctcttgcattttcctgatcattaaatgaattagggatttcctggtttgagatttgtggacaaggagaactacttctttgtacaagaggcttgtgccaggagaagacacgctgtggttacaatgttactgtctctagctatggtcatttcatgtctttaactgagtgtacctagagtgtaatacagtgcagcagtgatgggctgaaggcctaatgcaccagcacacatgcctggaagacctaacgttgagaatccgcatttttttcatcactcacatttattttgcatctccctgttttgattaccttcagagacccaagcacttgcttttgtatatttgagtctgggttttattttccttttagaaatagtccaaaatccttttagagcctagacctttgaataaagtgctaacttaacctgaggaatgctgtttttttgttcacaaataaggcttaattgtgaagtcgtgagaattgctttctgagctgacttataaatttacccacctctttttccccaaacccccaaaaaatcctccagaaggtgagcccagcttgttgtaaaagattttgaagcagaagtcctgggtttaagcttcagttctctgccttaccagaatcgggatgtgtggggcaggcctacctcctctttcttcatctgcaaaatacattgaatgaaatcatattttttcctaagtatatgacatgtaaagtggtatttcaaaaactcattaatctgcatgaccaggtcagaaaagacacaccttttgccttgtgtctagtgtgtgactgtcctcacatgtagatgacccaggccacatccgctgatgttgtcttcctttacttctttgtcccttccaatgactcctttatgaagtcaatcagcagtgtttctaagccaggttccttctcttcacacatccccaacccacagggcaagtcatccacattttgcctctctattttttgtgctttgggaaacacattttacaacttccaaactatttgcctaagttcatctgagcacatctagaattattccactcctctgcatcagtgctaaaagtacaatcatgtataagctgttatactcccgttattttgtacctcatgtgcaggtagattgcaagttccttgcaggcaggtactacatctacttgaattgcttcacgatcacataacacaatgcagtgttaaaagtagaaaagtaattgacatcttgactaacagaaacactaaattcagtgtattgtgatgatacctttttaagagataggctatagaaatagaaaatcatcttagttggaattgaaagtcaagaagcaacattttaagtaagagatgaaaatacttaaaagggaaaggagcagtgcttacacagatgaggggaaaaaataaaatgtatcatctaaaaatttaaatcaaatatattaggttggtgcaaaagtaactgcgatttttgccattaaaagtaatagcaaaaaccacggttacttttgcaccaacctaatagatgggaaaaataagaggaatgaatattttaagctttgctatataattaaaatattcttagaagtctggagtctgtgaaggtcacaccctctggtcttctcccagcccatagggtataaataatctgaattgacggcatccagggatctcagaaattattagtacatcccacagtgaattaccaccttactaaaatattcatgggtatatactatggatttgttttatcctatttagtcttaaaaactataaagaaatctgcaggcttattaacatattactcagaatcatattgtctccaaagcacaaactgaatcagttacaagatattggactagagatcatggcaaatcagaggtacataagacctagttccgttgtggagctaaacaaactgcagagacctaaagggaagccttgcaccacactctaggtttggagctcaggttttgagtggtgtcagcactccagaacacatgggatccccgggaggtggaaattgagccgtctttggagaatcagctaatgagacagatgcatgttaaatgtctgttgtggcccaggcactctgctaggcagaggggtgaaccagaagaatgagattcatggggccaaagaatttgccttctggtgtaagaaaagatggaggcagcttggcagaaagaaaaaaaaggtaaaagatagaaatgaaatacagaataatctatctcctcatcccacaagcaattctgcctggtttgtggctcacgcctgtaatcccagcactttgggaggccgaggcaggaggatcacttgaggtcaggagttcgagactagcctggaccacaaggtgaaacctcatctctactaaaaatgcaaaaaaatttagggccgggtgcagtggcagttctgcctggtttgaacatctggttcagttaaaatacttcatgaaaatatttagcttgatgcactgaaatccatcactgcttttgtgggatgcactgactgcagtctgactgttctcctagtggaaaggggagcaatagcttctgtctgcatgtgcatgaaacagatggaaatttagaagagattctagtgcagacaacttcatcccacccccgctgcccacagagctagccatgtgcacggtgtgtttgaacaatgttatgttgctgctgtgcacagagatccccagtctcataaaacatactggatggaaggctgtcgagagatcatcaggccccagtgcataagttcttcctaagcatccttaacaggtgatcacctcgcctattgagaaccctcaggaggcagcccacttacggaagcactgattgttacaaaagccctgaactaaatctgcttgtctctaaagccagccctgcagatgtctgcagtgtaactactttctcttctctcaagcagttcagcccttcaaatcattgacaacagctctacaaagccctctaaatagcccgttctcctggctaaagtgtgttggtttcctcagcatatgatgaaataaacaccatgatgcctttgccttgctttttcttgctggtctcactcttccctggcattcttcaatgtgcccaagtccttcctagaacattgcacccaaagggccttcctggtctttccagggaatgcagaatgaaaaagaaatcccatcccctgcctcgaaaggagctcttctgtgtgtaagtgtaccttccccctcagggcataatgggaaacagtttgccaaagctaactgtgtaatttcacatgactcactgccgttagtctgagaaagcatggcatattaaactcattttccatgcttcccaactttatttactattccatttctgaggggcagagagctgagcaggaataacaccttccttgctcctcctaatggggcacatgtgcacatataaaattgtgttcgatctttgcagccacgacccatgttaactgtcaactgagaactcatgagtcagtttctcaggaacagccctgaagacattatctcctgcatcttgtatttgtgcctttgatatttggagggaagggtaggatctggcaattatcgttatctcatttggttcagtgtatttcatttcagcctgttaagatcttttggaaatactgtatgtgctagttacagggacagtgataaataagacagcattcctgtccttgagatgctatttccacagctccatgagatgcctagttaaaaacagagccttttttggaaacagcctactaatctgttaaaataataatggaaaaagataaagttagcatacctgagctgcaagggctgcctcctggtctgatctctgataaggatcagatcctagagcctctgagatccctgtcctccctgtctgcacaagcactcgcagaaggagaaacagtttacggtggttcatcatgactttgaaccaagcttaaagtcaaagtcatactctttaaaccattggaaaccaagtttttgcgagttgcctaaagtgggcaaaaatcccacaatgcacctgagcacaagcaggaaaacatgccattgtctccccaggagccctccttgacttctactttactttatccattgacactagtcttataagtagctttgtctgtccaatttttaattgaatttcgtttttattttcgtgagtggaaatatcactttgaaagaaatcagtcctctcctgaaatccagaattcctggagctcagtttacatgtttgacgcgtgtcacatgattccacaagtcactcaagggcaggaggattaccatcgatacggaaagatttcttagaaagcttaagtgaaagggaaaccagggagaaagtgtgcttcgtgagaataggtatgcggacggctctttgtgacgctctgtgcaaccctcgtgtttgcattgaaccaagctgtgctgcagatggacacccatcccatttccccgactcataccagggaggcccactttgcaaggtacacagaggggaccacagagcagggggccatgcaggggaccaagggacattttagtgtaaccaaagtgtgaagtatgccctttatttcaaaagaataaagaaaatcacaggttttcccgctgatatgccagggacatttccaagagaattccttttttgagagaaatctcctttgatatcccatcagtcagccatactgcataattgttagatagtgaaagaaattcattttttaagtttgtcagaaaaataaattctttgaagtcttaaattgttgcctccggacatgacatatctggctcttccagaatccatgttagtcctagctgaggaagaaggagaaggagaggggcgtttgttgattattgattttgtaagatgccccacacgttggctattagcagaattctcacttctaaaaggaaaatgagtgtgagctatgttcaatgagaaacagttatttttgggacattctttgaggtaaaacacctccttaagatgctgcttccttattgctatgggaccaagattagagcaagaacatagtggttttcagaccctggacatcatccacagccgcagcagaggccctgcccacttgaacaatgagacaggccaccattttgtttcgagaatgagcaaagtgaaccaccatgccagatattgttaagtcagcaactcttctgaagatggacatagtaaaaaataaacaaacaaggcagcacttgagatggtcatggcagagcaatctcaacaagcgatttgttattttgcacagtgatgtacccactcattgaataaaatgcaccagaaccatgcactacagatgctaaggagagttgtccttcaacaaaggagataggccccactggccgtggggcagtttatgttatttggtccttgtcatgggcaggcatggccctttctatgcttcacagatgaggaaggtccctggcacaggtccagtctccagcatggcctagaggtggcaggtgctacttagcatcgccagcctcctgcttggtcatggggtcagccagtttataacacgaacggaggttaatgaactgatcttcccatcgcacaactggtatgaacccacatcttctgattataaatcttttgctctttaactcttagtcattaccactgtctagtgtaggcctgtgtgttcatggcctttgttgccaccaaaagatcaactattagctgaataacatactgagacatgttggtgttgtgttctaaatagcactagtaaactgttagggaaatctgactatatagctactatccagtctagtttttcttgcgaagtgtttgttgagtgtgtaatgaggagtaaggaaggtgaataagaaatggcctgagtctttataaaataagcaaggagagaaaacagttttgatgagaagcgcatggaatttttagaagataggacgtgtattatgtacctataagaatgggtaggattttagaagagatggatggggaaaaggaacagggagtgggaacaaaacgtggaccaaggaagagcaggtttagccatggaagcctcaccgccggctttggtttatcgtgggccaaggggacagaccctgtggggagggctggcagcagggaggtcttccagaagtctatcctgcaggcagtaacagccacccagtctataagctgagtgggcatgggggtgatggggaatgggtggggagttattggggtaacttaccccaaaatgatagctagctggaaccatttattctattgcattttatcaataaatcttataggaagtaccatcctagtgaaaaccctgtcacattgagggcattcatgcttatgttttaaaacatgttattgggtctatgaaaaataaggctgaaacctatgagcaccctccatgcaaagtttcagtcaagactttggaaacaagacagtgtcttactcactttataaattcattcagaaagccgtaggtttgaaaattccaaacttagatgtaagaagctctgagaaacacatgaaatcacccccacatcagtagagatgtctcagcagacatgggaagaggggcagcagggtgtagggaggtggggcagccccggggtgggccttgcaggctgggcttgaatcccatggccaccaccgtccgctgggaggcctggagccggctgcccactctctgaccagcacatgttgatgctgtatccttgaagggaccgtggtctgacatcctgtgatgcagacctgaatccagcacccacagggtctgcacattccctctttgaggtggagcccagctccagaggctggtccctgactctgtttctcaagaagcctgtacagatgttcccctcaccactgtttccagtcacctttggctttcacggtgcagatgctaagtttgattttcagagcccatctgggaatttagtgaactgaacaggtagcatttctgaacccacccataacccatgccctccccactgattttgaaagagagtttgctgcaggtgactttgcagctgggtagagaatcttggggcaggattccgaggcaggcagatgagtgaggataaattgggttctgacggcacgttacaccagtggactctaacgacgacctcacctcgtgcacagataattctgccttgtgcttaaccgttagaaatgtgtcactgaagtgtgaacatattatgctgttagatttcccatcatttctgttctttcattccctctcatttgcattggttactcataaatgtagatctttggtatgatttgtacaactgccgggtgtcaatctgtgaaagaaatagcagagcaagctgggctctggtagcgctttatccctgcgtgctggcttgcccgggttgactcagaggcagtctcacattcagctgcgctggggccaaggacccagggagccaagtgtgtttctgttttctgtatttagcaatttaagacctgcgtttaaatactagctatgcattctagcaaaagaggtttatattttaacacagtaactcttaattgtttaattcagttcgtgtgttacctctcggaataaaatagtggaagccaattaactatagacttcattagtttggatttaagatcaccaaaacatttaccacatctcaattgttcattacatgctctctcttttttaatgcagtttttataatatggggagtgggggtgtggatttaaccattatatttttatgatattgggagtagatttaaccattatgtaaattggattttttaattttaaaaagtcacttatcttgatgtaaaatcatgtcttagtaaccttgataaactaagttttgcatgattacaccttaaggttaaaacatatttcatttcatcatttcccagaaggggcactgaattcacccatttcctgtttttcatctcagaatgttctgtgtttcctccatatctactttcccggcagcaggaccctggaagcagtcacaccaacctcatttaccccacctgagatttgtgcgctttgaacatagttgcaatcaaatcaacaatatctttgctcagaaatggatatgtgaagtaaaatgtgctgccctgttcatgtatgaaatcattcagctagctggccagtgagcccttcattgcaacaaagatttttctagagcccctgcactatctggggctatgtcaggcctcacactcctgctcacacgtttggaggctaccttggccagtattaccttaatccagcatttaggggaaggagcatttcaagactaaattttctaaactgctcaagcctacctcattttatttcttgtgtattttaacacttttggatgaggactcttcctagaacctactaacaattcccccccgcccccatgccaagattctttaaagactttcttgaaaacgcttcagtcttttcttcttagctcaaaagtactatcctaaatactagctctggcattacagggagttaatttgtgggcacacacagtaaattataaaccccttaagcagagaagattgtattatcagtttattagttttcttattcattccttcagcacacatttctgttgcctccaatgcagcagagaaattgacttctacagtttccacaacagtccagatttcaactgtgtagtgctctttcagccagaaagtacacttgtgtttccctggccataggtcctgaacctcacttctgaaaagtcattgtgcatagagagctaatagctgtaccctaaatgatcctggctttgaattctcttatctgcttggatagtattatctgtctcttcctctgcattctaatttgctacttctaatctgctgggaattacaataagaaagaaccatttaatcatttttacaactgtgcctaaagagagtgtgtgtaagtgccgagagagtgtatgagggacttgcccatgagtaaatgcatgaattttaggtcaagggttttttgcttctcttttggttgattacctcagagatcagttttactttctttctcattcttgacctatcatcactagctgatatggatgatgtgtacaacttctgagtaagaataatgtcaatgggacgggatgggattggctggtgattctgttgatcttaaagtttatatattttaagtttagtgtttcagaatgagaccaaagcggtgacattttcaacctcttcggtctctcttcagttttttcattttaagtttttgttgtgcttctatcacttaaaggaagcctccaagttgaaatcaaatactaatgacatttttatctaatgtataaatgtgtttttattatttattaggaaatttattttacttggccctcagccatgacatatcatggcataatcactatcctaaatttgtatatcttatccttgcataaggtaagactttctatgaattacacatatttgtattttcctctcttacatattttaagaatttttttatactttgttttctgcaaatgaaatattgctcataagccaggtgatggctgtccacgcctcttttcccctgcttacccttgcttagatcttatggtagaatcttttcatagaagacacagaaagacatgaaagaaagagctggagaagcctgaggggctgcccagtgagtggtctgctaggatgctgtgccacagcccaggcacaggaggcagggagagcaatggggcccttcccttccaccaacattcagcagaatttgcagctccatgtttccaaagcttccagggcacttgcatttagagagagagagcaagcaagctgcctttcctcttcctcagttctgccagccacactcttgccatgatgagcagtttcagccaaaagctccttcccctgccctaacacctcctgcaaggcctgaggtctggaagccacctgcgcctgctggcccctcctttcttgtttctgcaatggatgttgtggccctgtgagggagaagagaaaaagaagttgccctcctccctctatcctcacctcctgccatgctgtcacccttataagagagaagggctaaccatccaggctaatcctccagtgatgcaggagaggacatcctggccggaagagtcagagcttccaggtgagctcaggtgggtcagcccccgaggctgtgaagagcccaggggccagtagatgccacttttgctccaggaagaatcttcaactgtgtcctttttattcaaggggctctcttttcagcgaatctctagatgtactagtcacaaacactcgcatttattaaaatgtatccatgatcccacaatccttttacatatttctctccaggagtatcacatttctgagggccctgtgcctgttttctgcaggaagttgctgttgtcccgggtccccctgcccccagcacctctgttacaagaagcagacccttcatgccacactgggacccagggaggccccaagccaggatgctgggatcttagtaaaggttggaatgatgtcagaacatagaggaggcagaattccccccatagcatcatcctggagggcgctgatttgtgtgctctgccaggttcatctgtgactcaggatttaaaagccccaggtgtggtgtcccttctgtgcctgcaaggtgcgtctttagcagttctccctggtgtggaaggatcagtggttcttgcagcctaggcaccctccacagcaagcccaacacaggtgctgtgagcagctggttcatgaacggtgatcctggggagaagaggaggatgaaaatggaaaaccagtgcaaaggtgtgtcatccagttggttactgctgtgggtgcccgggcttccatcccaccagagcccccactagccagggcagcctggcggaggtgagcatcattctgctttctggctgcacctgtgtggacagagcccgttccaaagcctcccaggcacagggcagacatcaagcaaggggcagagctggggcgagggctctgggtgcccccgttattgaacacaggcctgaagggagcctaagaggtggctggcaggagatactacaaggcagaaagacagggcagcagtctttgtactgtacgtttttgttttttaagagagaacaaaaagtcaaggttgagagatgagaaatactcttgccaaaaagagaacaccaaaatcctggagtcacgggtcttccattaccctctctagcatttctgcttgtcttttccctagtattggtgaagaatttttaaagtaaccaacccataccgttggttacaggccctgtggtcaccaggctgtctccccatgatggggatggagagtggttagtgcagaaacttagacctcccctccagcttgttgaatgccctgaagtttatctagaagggaagatactcaagcgtaggatttcagtgatgcatttggacagcatcagtactatgcttcagcgtcaaaaacgtcactttgggtaggaacaatacataatgcgtggcaatgccttttgtgacacctgttcaggagattcccataggaagcttctgaggcagagtcctcaggtgaggagggggacaggcctgggtcttgggggaaggtggagatgaccagcctcatgcctctctccccagtggcctcagtctccatcaggcaaatcttgagaagcctcctccattctgcaggcaaatgactgagatgtgtgagctctgcttcccaacaggcggaaattcacatggggaagggcacctgtgaatggccttctagaactatcaggaagttctggatttagtaccctgtgagagcagatggtcctgggtgcactcggatgatcctgcctagccagctggattgcagagtggtcatcattatcagtgagctattgaggggttgagagcagtcagtgtcatgtataaggatgggttggggtaccggccaacgcccgccttgaggcctggccgccggatgggaggcgagagcacaagagagtcctggctaggtgtgccccgctctgcagggccacaccatccactggaaaccctgtgcccactgggctgcgtgctaagaggctgtggccaatgctcttgtccaaattttactgaatctgcagtctctcttaattcactccaaagtttaatgtgttagcttgcgaataaataaataaataaataaataaataaataaatggaaagaaacagtcctcagaaagtcccagtcaaattttaattccaacagatattcagcagtttcctctaagaacaatgagagttctggggctagccagtgtttctcttggaaaataaggaagagggaaagcggtgcattcatttaaaaacctgccctagggaggcagcgttccctgtgaactccgaggccacagtgagcagagcaggctggaggcctcccggctgtcctgcccctcctgccacatgcctgtgaaaatgctagataaggactttttctcagcaacttccacgctccttcagtggggatgtctttgactcagagctctgccactggttatctccacgaacagaaaatgccacagatgggttaattcactgtgttgttctcattttccctcagtttcaggcttttctctccttgcctgttttcctcgcttaaaaaatgatgtgggggtccctaaacgcatctaccccgatagatttatgttttcttttccattagtccactttgcgtctcagccctaaaattaagtttttgattataatgtaaggaagttttaccatattttaactctggctttttaaatacaaaagaaaaataacagaatggccttctagaactatcaggaacttctggatctagtaccctgtggggacagatggtctggagccagcgcacttggatgatctctctcagccatctggaccatagagtgaacttgttactgtccctccaaggctgacaactatgagctcatactcttctagcagtttaatttagacccaagaaaggctgtgtgtgtgtgaatttgtgagagtgtgtgagtgtgtctttgtgcctgtgtttctgtgtgtgtctgtgtgtacatgtgtgtctgtggggtgtgtctgtgtgtgcacggctgtgtgtctgtgcgtgtgcatggctttgtctgtgtgtgtgcgcacgcactctgctaagctactcaatgcaattccttactcttacttccctttctgtcacttctccataattctttgtatttcggttgggctggtatctcgcggcggcttcctcttttcctgcattcctatatttcattatttgctcttgttcctcttctagggcttttacaatatagccaggaggatgtggaaacccagttacaagatgacacacaagcacagtgtcacaatcgctgtgcttgggccctacctcctggagaccagggtgggacggtgtctctggatatggagggaagggcggaagatcacggggtggcagaaggcccgactgtccggtcttctggaagctggggtctcgtggtcgctgggctggtggtgctctaaaacctagagtaaccgagagcaggatgactgcacccctgactgccgactcaccgggcttcggagggccatgggtgtgtgattccacttgtgatcctcctacttccccagcccaccctggtggtctcccacttctctctctctgcctgtggagtgttataaccgactccttcttctaggcatctccatcccaaccccagaccagttcccttaaaccacctcccaccacaggacccccacaagcagggacctctcacagttcctgttgcctggggacttcatctcagcttccaaggcctctggaaccaggccctgcatcctgggcatgactgtccccatgattctctgagccagccaccaccccaccacccccccaccgccaagtccactgctgaccctgctgtagccccccacctccacttgttgagattccctcttcctgcttctcattttgaatgtcacccttctgtgacttctcacaacccccctgccacccctccctccagttggcatggcttagtcttcctaagaacatgtgctgcttcccagtacccagggctgctgtgcaccgtggcacgtgagtttcggtgcatcttcctcctgctgtttataaattgcaacatccctggacagatcttggattttccctctataatttctctggagactccctcggggtttgcacacacatctgtggaatgcccaagttggagatggtcctccctgatgtgtagtgtgggctattcagagggcctcatttcataaactcattaacagctaggacgcgaagacttggagaagttagctcaggacacacggagtgggagggaggcaacgagttaagaaatgggctttggagtgcctcgaatttggcctccacttttcttttctactgtcttacctggtcttaggcaggtcgggtgaccatctggagtcggagtttctctcatttgtaaagcgggggtgatatttttctcacagggctgcttcaagggttaacaaagttaatgtctaggaaggacatagcatagcaccttcacctggttgcaagcccctggagtcacatggcaacagctgtggaaccaggtaaatgacttgacttacatgttacacgctcttagttgttcgatttgtaaatgggaagagtgtgtgacccaaattagtcgtttccagatatttcctggtaaatggttgttgaatcataaaactagaaagatgggaaagaaagggaggaaccccccttacttcgaagaagtgttgttgatgtgaaggacaggactttttgagacactctcatcctaagaaacagctgatatctactaggaaaaaacatgacatttgaagtttcttcctaagagatgtgaggttttgacagaagtgccaggaagccagaggtgtgtgagtagtgggccaatctcgcgtgaaggctgtgggacggggcaggagaggggcagccagcatttcctgagcgccagctaatggcggggacctggcacctttgctctgtgactctccagctgtatggtgacatgaggctggcgttttctttggtttcatacgtgaggaagctgaggcttggtgatgtcctgtgcatggctcggactccagagctactcagaggcagaggccgtctgtaaacaccttcaggtggttggaggcagggtgctgcagccaatgctgatcactcacaagccaaggctttattgtaagggctaaataaaataacatatgcctagcatttatacagcacggggctttttaggaaatagtgagacgaccatggagaggtggaggaagagagaagggaaagaagaaaaagaaaaaaaaagccttaaagagtttcttaagagaactatatattacaaagtccttggagttttttttccctggttagacataagtttacatgaaacgttaaacggcttaaagtagccacatctccttccttatgtcttctcacagccacttgtgagtttcttatcaagatacagaattatggccaagtgcggtagctcacacgtgtaatcccagcactttgagagactgaggtggaaggatcatgtgtgctcaggagtttcagaccaacctaggcaatatggtaaaaccctgtctctacaaaaaaatacaaaaattagctgggcatggtggcatattccaatagttccaggcactcgggaggctgagacaggaggattgcttgagcccaagaggtcaagactgcagtgagctgtgatcgagccactgcactacagcctgggccacagagcaagatcctgtctcaaaaaataaaataaaataaaataaattctgcaacaagtcacaattccttgctcagaaatctctacaggtgtgcttctttgttaagaaatggaggaaacatgaatttcatcctgacttctgagtcttgtagagaccagatctgactcctgcagccttctgcccacagagctggcaggcgggggaatgtgcgcagagtgaggaggagctgatctgacattccgaacagtggagactgctgcctatttggccgcaccactgtccttctgcatggaaaagtcacagtaaataatggactctctacctgtgagtcgattttactgagctgcctttttaaatatatgtgtagaaagggcgatctctgtgtgtcatttgcacatgtacatacacatgtacacacgtgcacacgtggtcactcatgtacacatgtgtgtgcaccagtgcaccagaccagatgcacccacccaattccacgctcctcagccccttgctttcctctgcagacagccagttcagctacagttatgccagattgcctgcactctgatctttaccatcaccagactctcagcttgagctcatgcctgagaaatccactttctgggaggaaggcagaagaaactgccaaggcaggactgaagacttgacctccacctgtagtggggtcaggtcaccagaggctggctgactccccaggatttctcagcagagtattacacaaataccccttccttaaagattagcaaccacttaaagacacaaagtgtgcaggactgtacccatggccgagagcggcgggattaagagggcaactgagttgttcttcccatccctcctcctctgtgctgagtcaccttctgcttggaattctgacagggacccgttgggcttctggaagggagggacagcagaggatccaccctctgtgtgtcctgggggagattacttatctctggcctccctgaagcagggcctgggcttctggaatctttgaggctgacaccctgccagccctggggatgagagggaatggccgtgtctgtctgcagagcctgaggaggagctgagcacagcctccagagttctcttcagttgatcgcttaggtggacaaaggccacagaaatggatttaaactcctcagccctttctttgcatgtttgttctcatttgaagtcagaagtgatatgtcctacacctcaagaacgtgtgaaatgcacatacaataaccccatttcaggaagccaagtccagcttaacagtcaaaacatttccttcagtctttagtccttcactttgccgaactcccttttacaccggcagcaacagtttaacctgttgcttctgtaagagtgtgctactgggaaaaccacatctaaaacacgtgtgcagttacatcagctagagcacatgctaaacagttgatcaaaggctcttgccttgtggcccacgctgcagacactctgacgactgccgagctccgcagccccatgtcgtcccttccgcactgcctgctgtgcctctcctctccatgtggcagggaacacagccagtcatcaccatgtggctctgcccggcgctgccccagcatgtcctgacagggcctagatatggaaaggtggctctccatgcacacaccccaagcccctcctgcccgccgtgtgacccacactcttatgggcagcccagttattttgtagcatttcccttccttatcattttggcccagtgatccagcacaaatctcccttattagaataaaatttggaatgacaaaattaaatttcatttttcacttatattgaggacctcacactcttcacccctgccacgatccctgacaagagccttcctatctaatcattgttcctccagccctcttagttttcttcagcctttcttgattgcctgaatgtccctttcccttctccttttaaagcatgaaccaagctttcttaccccgttctcattatcatttttgcattttcttctttgcatatgattctccttaaattataaaacttgggggtaatttctagaggtgccatcatagtgcttctgtctactcagtgtctttagaatcagcaaatatcatttttacaaaaaagtagtatttcttccaaaaaagagtaagcaagaaggttacaacactgggaaaatatccctaagcctgttcttcaacctgttgaatgttttcccctaaattgttatatggagatcctggacccggaagttggctgacatgaaacaggcctagcagggcagctgaggaaatgctccaacctcaggatccaggaagattgcacatggcaccaaaacaatcatttaaaagctaatcctggccaggcacagtggctcacgcctgtaatcccagcactttgggaggccgaggtgggctgatcacaaggtcaagagatcgagaccatcctgaccaacatggtgaaaccccatctctaccaaaagtacaaatattagctgggcatggtggtgcgcgcctgtagtcccagctacccgggaggctgaggcaggagaatcacttgaacccgggaggaggaggttgcagtgagccaagatcatgccactgcactccagcctggtgacagagcaagactccatctcaaaaaagaaaaaaaaagctaatcccataaaagaaccatcattttgaacctgctgtttcctttcttgtactctttagaagtacccatttctccctttctaagccataggtgtattaattggagctttttctatcttaattagttcactgtgaacaattaaaattgtgttaataaaacaaaaacaaaaataggactggtgcctagttgtactacatgaagagagaaagggccagacattggtttttcctaatcttctgtcaagttctccaaatcatctgctctggaaggtagctccaacagctgggatttgaagtaaagcatagtgactttggccatcactgacatgtcccatttgaagcaaccaaaactgtccctcgacctgacactcatccctgaaacaccatgagggtaagtgaggcgcttcggaaggtccactcaaccccattgccagatagagtaagtgtctgccaggggcatttggagctgaagggaagactgtacagactcacggtttgcaggcactgaaggcgttttcctgccttctttttcaccttcagtggacttgcaaagcactagccctattgtttttcccatctgggaaacatggtgaatgttggttggttgtagctaatcctatgggtcttgaggtctttgttgacaagaaggtagatgttatctttatctgcgtgtggctttctactaaaacatgagctacagggctctcttttttgttttaaagcatttttccataaggttcacccttactattgcttatctgaataatattacctgctgagaagtttattcattgctcaccagttgtagggagattttgacacaggactggaggatttttttctcatcgtaacagtgcagacccatggaaagcttggaagcagttgtgaccggataagagcaggttgaggatgataatcttagggcaatgagcaggttgattgagaggggtgcctgaaagcaaggtccccatgatgcaagcaaacaaactcacatgccagacggtggacaggaaacacaggcaggatgtggtgcaggctgggctgccttggctgggcaaaggcaggggcttcatggccatgctgggatgtgacgtggttggaaaacaataagaatggagacctctccaaagacctcagacataatttggccatgagaggcaagggtagaggcgagccccctgtgggttggaatgtatggaatccagatgaagcaccatcaacatgcatgggctacataggagagctgggtctgggggaaaagatgggatttgggtttgggtgtgcatgttccaggcatggagggaagaatgggcagaatgacgaggatcaagccctggtggagcccccagaccagggccctgggcatatttccacttgccttcttctgcaaacttttgtgtgcctgttgggtggaaggtactatgctggggccatccaggatccggagcagtgtaagacatcatggcctgcatggtgtgacccttgacatctgaaaagaacgagctggtggagtgggaaggagacaagtggcagcagagttgacatcatcaggactgactgcaggacaggcggtgaaacgagccactgaggagttacccagtgccctggggagcttagatgtgagacttacaccacccagcactccccagctctgtgtccctgggtcccactgaacttgattgtattttagttgcctcttttctaagaccggagcaacaataccttccttgagtgtgcatgtgcagtccatagatggcagccagtgttctcttcccatgagaagactctgagcctcctcactagagggtggtctaaaaacaaatggatccatccacagaaggtctgaaaggttttcatagaatcttgacttggtagcacttcaggatctaactcgtgctttccagaagtgtggcctgtggtgttctgtctggagtatttggtcctcccatccacctccaccttgctgtcctgtcctgtgactctcactagctcagtcaccgggtcaggaagccctgccatgaaatgctagatttggaggcattgccaaggtaccacaaaccatactcaaacaaggtcataatagactagtgatctcactgtggctaacaggttcatgtgatttaaagaatgacagcattttttctaaattttataaattttataaatttctcctaaatacaaatctgaatgtgtttacctttagacagattttcccagaaaattgtcagtgttctcgaatttgaaagtagatcagatctcctccctctagttttgaaaatctcaagtaggtttagcctctccccagagtgacaacggcacaagaagtttataattttatgcacagctaaatgcaaactgaaaagtgtggtttgtgggtatttcatttttcccataatgttcatcaatttggcaattcaaataggattcagaatccaaggtgttcgcagcattttatatgaaaatgtgcctgagagtttggggaatagaaattcttaccaaataagttaaatttgctcttgataagaatatattttgtaaaatgtagaaaactgagaaaaaaagtttgacacctgttttatctgcatccttttattaaacagtggcctgaatttactaaaggacagagaacagggttgagaggtaatcactgaataatagcttcgctaatcccacagtgactgcttcttatgacaagcaagagggtcaacttagaggcaggactgtcttcaggggcaaaagcaagtcagcacctacaaacctctccaagagagtgagaaaaagcaggttgtatggctcattttgcagcttgccagaagcaatgtgggaatattgtcagactgcacagacctggggccagctggctcctagagtgcgaggagctctcagtgactgctgtgcatactcacctgctctgtgactttgttcagtccctaccctggatgtgtggtgaagggtgccaggcttagctgctggaccagtgaggtccctgagggggcagggctaagaggtgtagcagtcgcacttgaccagtcattgattcactggttgggaatttgttcattgaggggacaccattactccccatgcctcacgtgcaggtgagtgtgtgtatatttgcattaacacacaaacacacttatgtgtgtccctgtatgtgcagctgcagtaccttacacatcttccagtgcctctcaagcatcataaaaacagcttccacaaaacctctactacccacctggcatccacagagctcccagtgattggctcccaaaagatactgaactttggcatggaacagagtgagtttccacatttgctgttgtacataattacctgtccagctagaatagtacacacttcttttactgagcccagaagtttatgtgcctgaacacggatggtacaggaacaagggtgagcgcttatcaattcagcattactctggagacatgaaacaaactaataggtacagctatattttgttttttaaacaattttgtgaaccacatatttgggacaaaaatcaacaagtaaatttgaattacactaggcaaaggactgattcttttgaaacgtgattgacattcaacgtctaactttccaaaagaagacatacatgtggcccacaatcatatgaaataaagttcatcatcattgatcattagagaaatgcaaatcaaaaccacaatgagataccatctcacaccagtcagaatggttattaataaaaagtcaaagaatgacagttgctggtgaggttgtagagaaaaaggaacgcttatacactgttgaggggattgtaaattagttcaaccatgtggaagacagtgtggcaattcctcaaagacctatataccatttgacccagcaatcccattactgcatatatacccaaaggaatatgagtcattctaccgtaagacacatgcacgcatttgtttgttgcagcactattcacgatagcaaaaacatggaatcaacctacatgcccatcaatgatagactggataaagaaaatgtggtacatataccccatggaatactatgcagccataagaaaaagaatgagatcatgccctttgcaggaacatggatggagctggaggccattatccttagcaaactaacccaggaacagaaaaccaagtgcagatgttctcacttttaagtgtgagctgaatgaggagaatacatgggcacatagaggggcctatcagagggtggagggtgggagaaggaagagtatcagaaaaaataacaggtagtagatttaataccggatgacaaaacaatctgtataacaaacccccatgacatgagtttacctatataacaaacccgcacatgtactcctgaacttaaaagttaaattaaaaaaaaattaatgtctaataatatattacagtattcttcatattcaatggcaatgtgtgaagtgggaagtgtcttgacagaattcggtgtttcaaggcttacactttgatgcccaagactgcacaaggctacattttctactggtgagacaaattccagacgcattgcattcagatctaatctcttagctccttaatcttcagggtactggtaaacatgaagacctccccagtgctgtagtcatcatgatatgtacagcaggtggctgagctctggatgtagactgcagggatatattaggaagttaattctcaaggcaagtcatcttcaagcaccatatcagcatgatcagcaatataagtagtatctcagtgctttgttgtttagtcagagttttgtactctatcacccattgtaatgttcctatttgcaaaaggtaatacataccctttaaaacatctttgctttttctcccattatcgagatgctagcagcttcataaagcagaataactaagggcaaacagattatataaagggttggagctcaatgaagacaacaagaacagcaaaggttattgtaaaactggctgcttgcaggccaacaagcacatccatatggaggcaatcagtttatgctacctctgtctgtttgatgggattcataatattgactttatccattagatttggactaccagggaataaaataagcagatggagagtaaggatttgctaggaaataattcagccagtcactttgaaagctgttcaagaaacagctttcaaagtgtctctcaaactatgtttgcccattatcccaataatttatttcccaataatttcatgggaaaagaaggaagttctgtggtcagataaatctggaaaacactggtttaagcaaagttcagtaggtctgcttccctgcaggtcacctcagagtctttactctgctaacctaggaactcatccaacaagtttaatttaacagctacactgtgtacgtcactttaacagtcactgagctgtgactcttgggggaaagattgtgcgtgtgtgtgtgtgtgtgtacacatgtgtgcacatgtgcagaatctaccaaatcttaagagaaaggaacatgctgggaaactgtcctgtgaaagagaatagaaacctgaagatttgaggcagtgatagcatttatgaaagcagcagataaggactaatcaccaaaaggggtagctcttttgttggttggggaaaacaggaatttttcccccacccaatgtgctgcattttctaattttctatgaacacttcctaagaaaaagctgaatgaagaacatttgcgatgcaatcagctcattaagaaacacgcacttttgtggagatacgtgctgtcccaggagatgctctgcgaggagccgagtgtttggactggagctgctgaatggtttctcacagttctagaatgtttggggctgcaccctctaagatgttgaacccatcagtaattgctccaaaccactttatgggatataatgctgtgagttgacacctgaggggattgtggtcctgttcatgagtaattacttttctgttgcctatagaagggccagcaatagcagatgagtagctgaacagtggttttgagtaataaaacgttcttttttaaaaaaaagtaatgctttctgttaaactctgactatactctctcctggtatcacaacccagctttctttttgccttctttattgcagttacatatggggctgatgactttagggatttccatgcaataattcccaaatctttctctcgtaagtatatgccttgcttctggaaaacaaaagcatgccttcatctcctatcatgtaaatatcgtacgtgcatgttccttcatcaacccccgagatacattaaatattcactgttctattcgttagacacctaccatatcatttttgggtatttataccataaagtgcaaaacgaaggtctaggcagttgtgcggtgtcctgggagcatggcagtggagtaacagtaagggttggagtcacagtagcactgatgggattgttacttcgcagatgctgctggacagctttgagattactcctgtaatcctttttattgagtgtgaggataaaatggccatattttctgtcaccaacaaagaactgaacatggtttcaagataatttttacaattttgtgggacaggagaaggagatatgctcttcatctgtggttctggagtattaatttcagaactgagaagagaaaattgcaggcctccaggccgttattctgtggtgcatcgctgctggagccaacgtactgttcctgcttggtgcccgcaggaccttctctgatctgagctgttaaaccaaaaacagatgtgaatttcatttttcttttttagatattgagctgataaatgataaatatatttgggtaacatcctcaaatgagtactttaaagaacagagagtgcttttgaaaatgtatagagagctgaatatttaaagccatacaagttgataatccccttaggacctgtattagtaaatcctctaatactataaagcaacatcagaaaacaggtcgcatttgttaacactgtgacaattataattataggctctaatttgaacagtgccagtaacagttaaagacaggtgtctgacatcctggttatcaaaaactatctggtgtctaaggaatttaacagtatcaaagtacatctttttgctcacaaactagattggctacttttccagcctatagaagttacagaaatctttcttttactgatattcctttgattccactttaaagcaatagcttgatacctactttttgagatgtatatgtatgtacttgtaaatgcttatatatgtgtatttgtttacacgtgagcttatatgaacatataaaacattatggtattggacagagaaatgatattgatttgaagaatcatattgttgaagtattttgagaagtcaaatgcacttgagagtaagctaatgcatcctaaaacatgtttctgtgaagtctgaggaaggtgtcagccagagcatatgttgaagcagacccttcagtgaagccttcagtctgtaagaatcgctgcatgtgaagatgtgttaatgttatgatagttacagtttttataaaagagatgatatacacttggatatgctttctgtctatatttatgcaaatgtgtccataaggtattggtgtctctctttctctcccactctccccagtgttggaattgtgactatcttctcacacaagcggctacttggtcttgatgccttcccccgcaaaacagcaaccaaactgttctgggccaatatcaccaccttgtggtcatgatgaagaattgccccctttgccctcaacacctcttttcttcttgaaaattaaaaacaacccctttcaccccctctactgtccttattccagtttgtgtccgtagttgctggaggaaagaaaatgcctattgctcttttttttattctctttatctgtttactcttctgcctttcttttctctccctgacttcattccatttaaaggccttaaattgcaaataacgaaaaaagtattttctaataatataccctagtgggacgaaaacaaccttctacattttaaatgatattaagttataataaatggttccatgaactttaaaacgcttaaaagttttataaatctcttttagaggcaacacaaaaatatctatatatatatcttctcttcacctcaaattttcatttaattaccgtgattcaagatatatcttaaatatttccatttcatttgatttttacttgctagtcaccagtgttgcaagaatatttctgtaccatttttcaagtaaaatattgagcatttcaagcttacatggcctaaactcacactagagtgactacttcggactatcttttcaatggaaaaatgcgttctgagtaccaaacatttactttttcagtaaatatgaagacacattctaaaaaggaaagggaaatgaagaggaagcttaattcattggtcaggtggggactaacagtgtacattatacctatgcattaaaaaatgtttaattatccatgagcacatacagtgcctggcacagattcaggcctcttggctcctcttggcatctgagttccttggattctccagattcttcaatccaaacttgtctatctaccaaagtccaccttccatacaggggtgtggggtctctcttagtactgttgggtgccaataacatagaagccctccaagataggtcaatgagattttaatttttcccaactttaaatagcatctgggaaggaaagcagcttttgactaggagtttgaaaacatccactcttcatatttattgtcacatttattgagtaataaaattgggctcttgtccattatctctcagtcaatgaaagagcccacggtgggcatgagccagagtgttccggagaaagagaggaccagtctccatttcatgttctatatttaatcagttcaattcagcaccttactgagtttgacatttttctaagtaatggggtggggggttacaaaatatttataactatctttcctatcttcagggagatgtaccatttcactgaagcaataccacagctaagcagttccagctccgagtaacagaggaaggagtgagcgatttaggaactcacagaagggcacggccaggcaactcgggccctggcaaatgttccatagagacagcatccatggggttgaaccaagcacaatgcctgcaaatcgggcaggcgggttcatggaattgattctagggcaggtatgatcagcaccatttaaggagtggcagttgttaagaaactgaagggatttctcatatggcattttcaacagaattcagcaggagccttgcatatcccttgggatgggttccggggtattatggagctgccaggaggtgctcagcttcagtaagtgccagtcattccttcccaacctcctccttcattagtggaagtatcagctggtgtcattgccttcttcaggaggatggatttcaaaatgaagggccaacaaaactcacattctcgcagagcctccgtcacaactgcatgtgttcactgccatcaacaggccaacacccacttgttcttttcttctaggtaaaggaaaaggtctgtgggacaaaggccctgaactcctcactccttgaatgggaggcatattggtggaggctgtcacacaactacaggtggcaggaacctgccatcagggttcccatcagcctccagggcttgcttctctgccctgtgtgtggacaccttccatcactggaaacccctctctcagaagaaccacttcttgccctcatctcccacttgcctctcctcggcaccttctccaccctcaggggccaagctgaggaagtgtgcatcctgtgccaccaaccttgctcgcaggaattagtttcagtccccagtgactgactcttccaaacctgcaccagcctatgctgcccttttgaaaggaggcgtgcgtacagcctggctggtacagaagattccagatttcagtgactacaggacgctgtcaccccttctgtttttcttttttctgtccacatctctgattgagcataccttcagggaaaaccccagaaacctttttcacacttacatgggaagccaagacactctcatcctgggcttgtgtttttaaaatctatattttaatttcacaggtccttacatttatgactaatagatttcagattttgagatacaatctgtagttgcaacttatgaagatagtttcaagccctgatttctgtcatctatgaaaacagtaagcaagttgcttgtattctcctcctagctggataagagacccccgttttcatggacagcctccttgggtggacagaagtctcctgatcttgtctatgtaaccagcacccactttgcatttttccgcaaagaaaagaggagcttaaccccatttacgggaaatccacgcactgcttgaatcttacgcgccccgtggtgacggtgttgcccactctgttcccttcccaccaaatcctgccagcacctggcagtcatccagtccttgtcttagacttcaccaacctttcccgtcataacatggcttagaagttgtccgaatagtgctagaagctttcagccctggaatgctcagcatctgccatctaacttccatttaaaacgttttgagcatttgctgatacaggttcctctgtcctttccccattattttcagttccttggccttgcccatagtgatctgtggatattgtctgcatactcttttttagaaacctagagcatcgcagtgtccttaattttcctcttcaaactctatatattcctgagctgatcatccctactgctgttcctacagaactgtgtgactaatcttctatatatgtccctacatctagccatctaggtggagatctaggtacctatctccctaaaattgtacttggtatccacattgacctcaggacagtatgtgataggctcttgtgccttttcgactaggagtttgaaaacatccactcttcatatttattgtcacatttgttgaataataaaattgggctcttgtccattatgtctcagtcagtgaaagagcccagggtgggcctgagccagagtgtttgtgtccctagttctcttttggttctgttacagctctcagtgacagtgtcattgaggctaacaaggacagagtactgctttcagccaccatttgtccaatgagtggctgatctccaggcctctggctttgagaacatctgtgatatctaaggcagcatccattgtgggctttcccccatgcttctgtttccttcctgtcacatagctttgcctcctcctgcaagcagcctgctgtagcagaaccggtgttcctgaagccagaaacccaaaggtcgtgtccaatgcttccctgctgttctgctccccacctgcaagcgcccacacactgatcaacagcacacgccatagagcatgccaaagaatcccagaaatactcattcttaatgatccagaagaacaagtgatagcttctggcaagttctaataggccatatgtgcccatgggaaagcaagagtcaattctctctagctggttgcctctgaatttatgaagtcaagccgcgtaggggaacatgccaagaggattatcccaatgcctgttctgcgtggtgtcctttttctagcctcggaagcactaggcctacaccttcgctatagccctcgtcttagcgcctgtatttgaaaaacttgccacaccaatcttaatttgctccattgtgttctaatctcattttaaaaaccacaaggtaaatgattaaaaataatcttagattaaggagtacacagatctttgcagcctcattgtgtttccagagcgggctagtgtagacactggtgaacaaggagggcctagagaattagctttctcccagaaagatgcacagcctctacctgagagtaccaattccagagaactcaatggtcattaagcaccattgcctcgacagccagccagcctcacttgcctgcctatctcctttattttccaagtatcttgtccctggcagtggggagaggttagcaggaggctgctcagatgctctcggtctctgatcttcaggatctgaaggggagagcatttgaagaatccccattgctggatttctcaggacaatcctgcataatgccaggatctgatggaggagacaggcagctctgttaatcctctggtgcatcctcacttctgtggtctccaagtccaccatgtcccagttaattcatttcattattcatctgtaagtcatttccctaaagagctaataagaaaacactggcagtacaatcagccctccatatccatgggttcagcctctggaaattcaacccactgtggcttgaaaatacagtattcaagagacatggaacctgtggatatagaaggcagatttttcgtatccataggttctatagggccattttagggacttgcacatctacagaccttcaggagtctcagaactgatgcactgcagataccaagagatgactgtaagtggttaggaatttggatgctggggccaggctgcctgcagttaccttccagctctgccacttgccagctatgtgaccttagcaagttgttcaacctctctgtgccttggcttcttcaactgtaaaataggataatgatagcacttcccttatggagtccttgtgaaggttaaatggcagagtacaattaatgtgctgtgtgcccagcgtgtggtattggggttaggtgaaagactgtactgggatcactgggggtgagcctccatgtgccatgccccaaccactatcctcagctaacttcttgtctgtcagtgttaggctggtgctataataatttccattttcatggatgaggaaatcaaggcacagagaagttacatgacttgcctaagatctcagtgcttttaaatagtgcagctaagattccagaccaggtatttttatttcagtgtctggactgtagatctctaaatcgagaggaactccctgaataaaataagcttggagtgctgttaactaagttggttatttaagacagttgttctcagtcctcagtgtacattagaatcttctggagggtatgttaaaacagactgctgggcccaccgagagttcctgagcctgcaactctgggttgagcctgagagtctgtgcttctagtaagttctcaggtgatgcttatgctgcttctcccaaattttgagaaccattgattgaaaatgttgatcaaaaattatgtggtctaggctgagcacagtggctcacaactgtaatctcaacactttgggaggccaagtcaggtggatcactgagctcaggagttcgagagcagcctggtcaacatgacaagacccatctctacaaaaaacaccaaaaaaaaatggctggatgtggtggtgcacacctgtagtcacaactactggggaggctgaggtgggaggatcacttgagcccgggagacagagcaagaccctgtctcaaaaaagaaacatttagtcttgattgtcatctatctcattgatcattttacttggcaaaatttacctacttactcttattagtctgtaaaaatggttattaaaatggtggctttcagtgtaactacaaattctcttagtcattatagtgttggattcaccaatgtatcatcagtcagtgtttctgaagtgtgtaaatgaaataactcctactttctttaggaagaaaaatattcaaatgacataattaccttgtgatgtgtgacttaaaggtaacagtaatgcagagtcaatagtggtcattgtattcaagacactaaaagttcacctcccaccccccccccccacccaccacccaacaaacacacaagcttctttccctttggaaaaaaaagctcttccagatacctacattcataaactatcccaattaacccttcagcaagtggaagaagtgtaagaaaggatacctcttctttagaacacagggtttgtttttatgttatttaagataaacaggaattcaaatggtcatgtaccaaagcaacacaaagaacttccggaaatctgaaagggaactgtggtcagaactctgagcatttttatgtttactgagttttgtcccaaagtttattaatgtttacatgccacaaggaaaggtagcatcacaataagagacgtttttcaggcttgataaccacttattaggtattttgccaaacaagttcacacatcctagagagctggattgtgtgacccagaacccaccctctagggcaaggtgcccatctgatgggtagggtgtaggagtaggcctcagaccactcctgacgtgaacctgcttaaagtgagggcccaattctaaagtgggaactatgtaaatacctttctagtgcattttcagataatcgccactgggcctatggatggagagggctggcagatctccctgtaaccccaggtgcatcccgaggcctgccaccgaagcccactcaaggctgaatgcacggcgagctcaggctgctctccccttggtatttgctaagaacttctgtttagtagctctccacacctatttgattgtctttttgctgctgtgttgttttgttgagttttttttttgcaatgacactgagtggcctcctgtattgtttctttcagccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggtaaggcctggctcagtttttcctttagtggcctggagaaggtgcatggggtttgaaggaggaaagcatcctgtcttccttgtgttctgagcatgtttctaattgactggtagctcagttgttgcaagcgattggttccaagtggtaccgagtcatagagtccttgttctggtacagccttgtaaaggacttctcaacacgtaccaattccaccctataaataaaacaagggaaaagtgaacagcatcacatgagaggcttggcgagggctgctattatagtaacacatactaagtagtctcagctgagccctcagggtacgtgtgctgagtggtcaccctccacaaaacaaaaaatcctgatacaccaaaacttactcctcaaagtttccactgagaaaccatgagtaaaatgtgtgtttaaattgtatccaaactaacagggtttgatgtttagaaacaataatcaatgatggaatagcagcaaaatcgagttttcagaaagacctcagatgagctttcaaatggcttgccctctaacaggaaagactttgaatcagatgcttctattgccactggttatcagctcaaattcctaaagaacttcatcccaaataccctgtcttgctgaaaggtttactggaagtataagagaatgtcatgttctgtgtccagaaaggaaggaacacgggcaccctagtgtcagcgagttgtgctcaggctcacaggatgccccctcaccagaggcgtgggaacacggcgagccccagctggccgcgctctgccactgtttctaatagccggtcacgttgatggaagtgtcacagagttgtccaacagaactgtccagtcagaaaaccaccactcatggtgctggagtgtcttagaagtaaaatatgaataacacacacttatttaactataggcaggaggtttcttatgaattgaagagaaacttttctttgcgtgggaagctgttctaaagttgggtaaaacacaatagatccaccacctctagcagccactgatagctgaaacgtgaaacatagagaccctaagctatcactgcctctgagctggcattgttaggtcatcataaagctagcgtctcccactgcaaaacccaagaggaaaaaaatagttgaaaatcctattttaaaggcctagcagattctataagataccttgggaaaatgatgacgatgacttgaaatcagaccctcgtatgctgcttccgtgggggcgaacaaaaatatgttcatcaaaaattaagcagaaatgcagaaaattttgtgagccaaaaaagctgtgttatcaggaaatgcagatatttgtggggttgtaattttttatatttgaatcgggcggttttcaaaatgatctattccatttgtagtgtatctgaaaacctataaaaataagttgatatcaatagatatccatcttccataaaaattcaacttctaaaattaagcaaactttgctttttctaatggcccctttatcctcaaattacccactgaaatagacggatcacactcagccctaagtgaagcaagcgtgcatgagagtagtcccagcctcgcctttgtaatgaggtggaaattaacatgaaggtaggctaccctgtgatagacacttaacaggatactcggggacccatggtaatacatccctgataaggaatagacctcacaaatgaactacttgcctgttaattcatttaaagcctgactgtacagtgaaaattctcttaaataaatatttgataagtgaatcaaattctggcttactaaattgccaaaatataatgactgcctgccttgataaaaagaataattacatttaatgaataaacctgccaagtacagatatgccaggtggcacctgctgtttgctgctcacttctcccaacaaatagcagctaggtgccacctgcacaccaataagctgagtttttcacttacggaacaaataactttcagaagtcaattttatagtttctgccttgccctttgttaaaaaaatacacacacttgaagcaatgaactcatgaattgttttcatcatgcatttccacttgcctaaatataaagggtcccaggtagatacagaaatacctggtttggccaaacttggtttgaataactagacatgctagaaaaggttttcattttcctgggatctgagtggaatatgttagaaaaggcatgctttctgaattctctatgcttaaaacatttctagagcagtgcttctcaaacttgaaagagcatgtaaatcacctgagatctcgtgaacatacaactctgcttcagacctggggggaggcaggagagcaagcattcctaacaagctcccagcttgtggagcacagagccgcctcaggcagcagggcagtgcagctgagcagtgacagtgaacagggccattcagagggctctccacctggggcttaggtacgacgggaatccccactggacaggctaggacttgcactgtggccattgttcctcctcctgcccatggctgagtcagcttctcagtcccttccaggatacactgagaggattcaggggcggtctcgcctctgcccatatccccacgttggtgaagtaccactggcgccattttctaatcagctcatcggcaccagcacgtcacttcccctgttgtgcagctcagttttatatttctgactcgggtgtaatagtaacatcttccccaccaatgtctcagggttattgtgagaaccagagaggagagaggtaggaaggaagcaggaaatgcagggtgcaaatacaccacattattattctaaataatgggatttttaataacaaagaccaagaagattgtctgtgcctatctagttcccatctgtaagataaaaaggtgcagtccctgagcctcctaaaaacagcaccctaatggcactgctcctcccaggtatgattgcagtagacctacgtcagttcttgcagttcaaacacattttttcactttcttctgaaatgccctcaaattctatgacatagtatccatgaagacttccctttttacccagtgaagttactagagggggttcaaaccttcttacagagggttcctaaaatgggagatctgtggagtcattgggattaaaaattaaatttcaaattcatgacatcaatgtcctcatcccagttaaataaaagtaaatacaaccttgaagaaatttgacctactcagctgcaatagctgttgacctgcagaaggcaaatgatggaccccggccacgcaagaacacacatggcgtgggctgcgttcttgtgccccagctccatggacgtgtcttcttagctgtggacccctccaaaggaaactgcttgagtggagtgctctgtattgtcactcctgggaatgctctcttaacacccccatgccttgtgctatgtgttcataccagcataggcactcagaagcaaaaaaggtttccagtgaaatttgtttgcaggcaggtattaagacatcagacactgcaggatccaagtgaacccctgcccgcctgcctgcctgccctgctctgctctgcagaagggcatgtgtctgtagcaatctgccctttctgtctgcgatgggcagagaccctggctctgcctcctgttttccctgtagccctccagacctggggagagacatgggactccagcacctgcccagcacggaagggggtctttcccaggtgtaagtgtagggctgcattcactaatttagggtcataccacaaacactgttgtgtcaccaggatgttgtcacatgcttattgtgagcatttttgtgacatgagctttctcctgagaggccaccctgtccaaatgagagctgtagttggaggcacatccgtctcatgctgcctgggtctccctgcaccagctcactctacttttcctttttatccacttggagttaaatgcacacatttatgcacaagtgcacagaaggcccagaactgttcctaatagataattaaatgatctctctccagtggaaactctcctgggctacctggctgctagctgttttagcctcttcatccagtattgatttacatgcatcggtttgtaactcagacagtatagttagttagtttgtttcaccatcaccttccaacctgcttacgtttaaactccttctctctgcttagctaatacagatttctgtaaggatttggagaaataccagatacctcctggttagtatcaggacctctccattggcctataattgaacatcactgtaaattagtttcagcttttatagtaatgcatctaacccgccagcttaaaaaaaaagtgatgataatcatgaaattcaagtgtcaatatagacttttaaatctggtgtggatgttaatagtgccagatatgcttctgtgtaatcatttttgagaagtgctgtcttctttaccataatcacattaatcaatcgggaaatggttaaatagacattttaatacattgttttttcctgagaaaaaaagtgactccaggaaatatgttgttacaatatctcaacaccaggaattgtggtcacatagcattcttcttctaaataaagcatttgttttacaaaagagtttcatgtttacttaaacgtgacaaatgtatcactcttcgaagtgagagttaaatgaaatgttccctgatttagattccaagacctgtgactactcagtaggacaatagcatatttcttttactcagatacctgtttatccctttgtcagctccagaatggagacacaggtgctgccacacagaggagagggtcaggtgttttcttagtcacaaatgcagcagtctcacccctgaaagaattccttcataacaactaaattgcacctcttagaatacctgtacttaaaatataatttgtcttctatggatatagacaaataatagcttaaatgttttaggatttgtaaagaaagaaaaagctagaaatctcaatgcaactctgacttgtatgtcctgccataggaaggtttgggacttttctttggaagatgggaggcttccttcacagtttcttaacttctcattttattcaatctttctccatctctctctctctttctctcatcctcacgctctctgtctgtctctctcctgatttgtctgcttagggacagacaggtaatggagaagaaattgaaagggaaaatacagggaaaatgtaaatgaaaagaagttattataactgttataatgaagtgcctttcatttaaatataagaatgtaacgctgaaatgaacttgtgatcctgaaatgcatttttaatgagtttcctttttattttgctgcttcagtggcatattttaaagaccctttgaaaaaagccacattaaaaaaccccaccaaatgccacaacacgcaaaattggatattggtttattccaaaactgctgatcaggaagagtggctcttcatcacaaaatgttgcagtcactttatttaaatgagtttgaatttgcattgtgatgtgccattctgatttagggaaaaaaaattagattttcagatcaaattgacccagccagtgaagcgttaaggagctggcaggtttagtctgaaagcctcatgttctatcaaacctgcagccggtggaagtcaccaggcccccgtgggaaacaactttctcgtagcatcgtcctcatgtccccacgctgagtttagttctcaccagctctcctctctccgtcccaggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccggtaggtcccctggatgcagtccggggctgtctgggtgtcccgggattcctccactctgcccgcctgggtcccggattgtgtccttgctggctaaccctgagtccctcccagctcgcagtcctgcatcgggtgtgagctgttgcttctttgacattgccccatcccccctccccatattctccttttcccactgcaccagggagattgggcgcaggacccccatgcacatacacacacagaagtctcaccttaggtagcatgtttcagaacaggcctcctcatcccgtttgtcaggctggtatggtttccctaaaggattttgcgggaaatgttttcaccaagtgtactgctaagacccaaaacgttttcaagtacaattctttctgttgttaagtcccgctttggagtgttttacacaggtgtaatggatagcttttttgcagagctggtagagaagggtgatttagggcgcacccacccagactgagccccgtgtggctctcacaccaaaaaccagccaaggccacagttacagaggccagtctggggctgttaccagattttagacagcagcctttctctttgaattagacagttaaagtacaacccacataatctggagtcttgacaagatcatcataggcataaacgctctatcattctcaaaacagtctcagcctgcaaagttcaaatccactaaagtttggttagatcctctgcctcctgagaaatggtcctgggtgtttcattatccagcagtcccataattctacagggcagaggaagagagggctcttggccggcctgtcatggatcatgtttgcctacagtgtggtctatacaacatgacatggcacaggtctccttcataccgtccagttggggatatttgctgtagcatactgcatgagacttcggaggcgaaaggttgatggcttttgtccttcccctcaaggagcttcctgccccagccagccaccagccagggcccttctccaagcagcagcctctctaagccggtgccctgggggatggcaatgcctcagaccagctactcctcacccaccctgggtagcaggataaggaggagcctccctcagggaggcagacgtgtgttctttgtgaaatatctgcagcggcccaggccatctcttcccaaatgtgatgcgtgtatttgatggttgagggttttagaggctgctcattgtgtccatctctttatcacacatttactgagcacccctgggtgcccattctgcacagaagacctcaggtgcacacaaggaaagcaccaatgtgttacaggaggcatgacagagtgtctgaggggacagtgggagcataaggaaggggacagtgggtcctggggtggaaagtcaggagagacttcccatagaagggaggggcttctgaagtacatgctggaaggcgagtgtctgaggtttgctttagagacattctaaactagtgtgtgagtcggcagtaatcccagagaggggtgcggcacccatgttggcaagaactcggtctcactcctggcaggtggtccctgcagtagttcacccagttggctggagacaaaaaggagaggagtcacaggggctggtgcatcacctcctctccatcctgacctccttcctggcggtgcacatggagaaggatccccacatgctcgccatcagaaaattgtcatgatttgggtgatttgacttcctaaaaacttccaagaaaggagctataccaagctgaggagttgcttgcccgagagggcgggcagatcagcaggggggccatggagtgggacacttgccttgttacagagggacagggagaacaggtggttcccctgagataggaagacagtagcatgacggtgagcatctttaaatgttcacatgggtgatgagcatgtatggtggtcccacctggagacaaaggtggtacctgggcctgataagcaaggcccatggaggcctcagctaagagaactgtgcagtctgtctgccatgctaaccagtggtctaggaagaagcttcacatctgttgtttctaaggagccatgtagacatagacacagttggcagcaatattgccttgggttagtgggaagcaccacttcccatgtcagtggaaaacacagacactcgttcttaggttgacaccaaccataggtcatcatcactcctagattactctgattgcaatggaatctctcatgcccatcagtccttaaaagcagagctgctctctttcctttcttgttgtggagttaggaacatgtagtggagtattttatgttattctggctccaggcctatgtatttcatttgaggcatgatggtttcctattctaagtaccactaagtattgagtagttataaaatggtggtagactttggactgtgtatttctattctggatccacggatgagcaagtggagaaaacccatcatggatgcagggctgctggggatctgtctgtccgaaaatgctatagagacacacactgctcttggggaaaaaaacagtgatgatttcttcaaaatgatttcactgaagtgaaataaggactttggccttgctctggcaaattcaaatgtggccacactctactccattgtggaatggtgactcccctgtcccatgaaaaaccaggatcaacatcacagctttctctagcaactggtggtggcctgaggtcttatgaactagcatgttagcagggatagagttagggaatttgtccgatgctgacagcaagagggtgctgggggagctggaggggtggagaagtgatctcccttcctgcctcatggcttcctttggaagttgcaagcttagaatttctttcccaaagaatattggactatgcttcaagagacacttgagttcagttgcttacagtgaacatacttcttatgttccagagttaaactcaatcatattttcagaaaaatagatattcagacatcatgtcatatttacaggaagctatttgatcatggaatttactgaagtgacagctttttcaggaaagggtatcgagtggttatctatatcctattaatttctaaaagcaatgctcaataaaatgtgcaattttaggcaatattctgtgtttcaacattatttccttatgttgggggtacatcactttatatagataaagaaagatccttttcattctctattaaatggtcgagaagtcaaattttggctttcatgttggtcttcttactgtagcttctgttcacctaagaaagagatttaaccaacataagctttggctaaaccattgtaccaaacatttctatttggatgctcttaacttttatacaatactttgaaatgtgttcaataaaacaacatgagaaagaagtagaagattctgctattaggttggaaattgatattccttacataagtgattaaagatactttattcagtttatcccttaaaatggtatctactgaagtccttaaacttaggcatgatattaattcctggctagtctttctttttcctaaaatatcactcaataaaatccaagaaggactaaaactcattatatagaactgcactgcccaatacagcagccactagccacatgcagtatttttaattataataagttaaaattaaacaaaattaaaacttcagccctcagtggcactagccacactttttgtgtccaacagctacatatggctggtggctgccatattggacagcactaatagagagcatttctatcatcataggaagttctgttgaacaaggctgatctggaagctacaccatcctaaagctctttggcaagaaagcagagcttttccataagctcagtttatgaacaatatattttgtattttctatgtatatgtatatgagaatacgtatacatagaaatatatgaaaatacatatacatataaatatacatatacataaaatagaaatacatatacatagaaaatacaaaatattttgtattacatatacatatgcatggaaatacaaaatattttgtattatataatgcaaatgtaagatatatttatattatgtaagaaaatacatttgtgcaataaaacgcttatttcattcaagcatatttgtccagcatggtttcttagagactgaagttacccagtttagcacctggaactgaattcactctggctgtgttagatgtagcaccagcgtcatgacagatccagcccacagcatagactgaggcctactctggaggcaaatctgcagacaatgtggccaacacatgggccttcctcacatctctgtccagtcgctggcatccacgttataacacagcagtggctcgttttctccagttaaaggctaggcttccgtgattgaagcaggagagaatttggtagtcagtaaagtagacaaactaagacaaaacaagagtcgcatgagttcttggtacaattaaagaaacccttggccaccaacgtttttaaattcaggaatttcaccaagtccgtaacagttttagctctcaagggtagaattttttttttaacttttttggtaataattgtattgcatgcattccccttacacagaaggctggcatttaattggggtcttgaactcaattgtgttttctgcagttggtaaacctcacaaatgtggatattgtggccgaagctataaacagcgaagctctttagaggaacataaagagcgctgccacaactacttggaaagcatgggccttccgggcacactgtacccaggtaagcgctgctgctcggaggccagcctggtgggctctccccccagcacggtggggaaggagggcgctctgcatgcagccttaggagcagagccttgggcctgcttcctgccggggctaggagggagggaagtttttggccaatagcatcagtttcaccagaagcacgttgtgcttcccagctttctaggtcctcatctgaccagagagagcttgattttaaaacccttcccacttccaatcgggagaaactcctaggatagcagtgaccttgaaagttttggggttgttttttggatgttggtgattttaaaacaacaacaaaaaaaacacctcaagtagtgatatttctttgtaaacaaaataaaatgtaaaatattgttttgaaacaattttttaacaaagttgatcaaataagaactttcaggctgtgattttaagcatcagttcagactgagggcagggtatccactcctgcatggagtgtgaggttgaagtttgttggaagcccctggtagttgataatattgaggttgttgaaggatgagaggaaaggtcgcttctttcttaggagctgtgatgctccactgtattgcataacgagatagcacttgattcagaccccagagcctgtagaataaatgatgtggagagagtattgaaaaaggctggatttatctgggggaatggcaatgttataaaaggttcttccctaattttttaagagataagcaatttataaagagatcaaataaaactaatctctttcaaaacagtattcatttagcactacccctggaaaaatcatcactagactgtgagtcgaaatttaacgaatggaggaaaatttattaagcctcattcacctttcggactttaacaaatggttcaaaagggaaaattcaccagagtaccctcagattattaatggcagatgagagcaggaaaaaagaatgttgagaatggctaaaaattgattccaattagtcttggcatggagaggcaacatctcacctggccagagccctgcagccagagtgctgtctcctctgccagtcagccagggatctggggcttacaggcgattcctccaggcctcaatcttctcacctgtgaaatgggaagataccattaaattgtcatttggcttctttcaaaatctcaggtctagaatggaaaggcattgaaggtgagtggaagagaagaaactggatgttaaaataataataatgtaacagttattaattcacatggccagaccccagggcagaagactaatggacgagaggatgattatgttcctttgaaataaaatgtcaacattcaaatattgtttttttctgtaaaaaataagtgaatgggtcttggaaggaagtgctcctaatgatgtagtttacatattaatgcttaataaaccattttatttactcaacaaatattcactgaggacttataatcaataataccaagccctattgaatacagtaatctaatatacacatagaattgaaaagacaaaatgaacaaaagaaacagacagtatatcatttctgtttcctccactgttttcattactaaagaaacaagctgcagtacacagccggctgagagctgcttccgggggagcaggagaagcagcactcatttcactgagacctgggtttgagttctctgtttttgaatgtgacccagagctcatcgcttaaatgcgactgataattcgtgcctggccaccctcatagcagcgctctgaaagaaacataaaggagtggatacacgtgtgagcaggagcctagacatgtgtcaggtacttacctaaacatggatgtttaggtcactgacatactgacaccatcaagctaattcttctctattggtctctatgtcagtaaggctacgtgccagtaatgtgtattaaatattaccctgtggtgagtatcaatttcaccctaaaatgttcatttattccctttggtggttaagttacttggactaccacagtgatgcctctatgtccccacactcaggaggtatgaaagcgtctctaggaaggagcagtggtctggtctcagtgtggcagcagacaaagccaggctcgcacttaattacattgaattatttctgtctggtatggcctcaaaaggtgcaaaatgatcataaatatctttcgacagtcacctttggtttttgcccttgccagcacctggcccttgtaggtgctgctggtttaaggaacttggagtattaaggggatccataaaaggactttgacagaagtcttcctgaactgtgcttagggccaggaaggcaggcaggggcttggtcatttcagctgtgctgtacccggatgagtggaaactgtgccttctgatgcatctctcctcctctgttcccctctaagaaccccttgtctgtgctcagatggatgagcaagtagtctcttctcccaccccaaaaacctccttagatggggtggattcagtaaaatcaaagcctcagttaggcaatataggaaaagatgaatttttgtgaatataattttctttagtaaaaggcttttggtcacctcttataatttctcaatgtctttatggaaaaaataagtttctcttgagcctttggtgcacaaacagagtcaccagcccttggaggtgcatgcatctaatgacagagcagcctgtgactcgcgagcatcaggctcacttgttccttgctgtgattgactctggggggtggaggcttttgggaggccctgcgccatggtgcagaggaagacccctgacctctgggagccctgggcaggctgtgggtgtggcttggcagagaaggatggacatgtcaggaagcatattagcttaatagatgaagtgtgtgaccagtgtaattgggttttatggatttatatttatcttgcatataaatcagggtgtggcctatatatgtttgcccatttaataaaaaacacatattccaaatgttaaaatataaaatataccagcaacaatagccaatttgaaatatatgttttcaaagtaacattcataatagcaatgaagacataaatacttagaaatgaagaaaaccagcaagccatagtgaggcaagaaagaaaacatgggagattggagaggtagagaggtctggatgccgtccatgggcctctgcccaaattagtgtatcatttcaacataaaactggcttgtaaattttactggaatctggtaaccatgtatcataaagtatctggatatatacatgagataattggcaactttttagaagaagaataatgtcaagtgatgtatgaaaatgtagctgaaatggatggaactctttgaagaatagacaaacaaatcaataatagagatggataccctactgaagaccccatgataaatcagcatgaaatatccgaggcaggaggaagcataaggcaggaacggtattggaagaattgatcaggcatttaagataatcagtttacattatcatctccttatacactaggataaattgccgggaaatgaaagagttatatttttataactccaaccacaataactgatgtaaatatagatccagctatgcaggatacaaagttgtatcttcaattatggaaagagatgacatagaacaattgagaatgactagaaatggcccacacatcagcatttacctccataatttctaaattttctacagcagtcaggggtgctttgattttcaggagtttgttgtatgctcagggataaggggctctgggtttttcctccacattgcccagatctgctgtaggctcttgggggccacatttttgtatctccgttcactgtgctggtccatgaagtcagatgttagatcacacagttctttgcgtctcagagggctgctgttagggactgactgaggtagcagatttgggagtattatgaaaagttaaaaggacttgtcaaagggacatcaatacttaatcccagtccagcctctggtgatggtggtggtgcctgtgcatttggacttaaagaggatgatgtgtggtgagcagctgttggaggaagaagcatttgcaggtggctggtcattggcattgctccggctgcctctgcctgtctggaagtgttgctgggaagattagaattaatctctaggaagggcctggctcttgtaggcacttaacaaatgtcagatttaacattggacgcgactgaaccctttaaacataagcctttctaaactggcctctctgtctttgactttagtcattaaagaagaaactaatcacagtgaaatggcagaagacctgtgcaagataggatcagagagatctctcgtgctggacagactagcaagtaacgtcgccaaacgtaagagctctatgcctcagaaatttcttggtaagagttaaatgtttgctgtctcttaaaaaaaaactatgtgggtgttttagatgcaagtagaaatgagttgagggtggaagaaagggaaaaaaatcttattttttcaaaaggaaaaattggtaagcttaacattccttaaatatcttagaattttttccaataagtatcttaaaaataacaaacctcccatcagtttttcctagatttgattttgcagcatctggggcctgccctgtgatctgcctgtggacatcgctcttaggggcggctgcaccagcgtgcacagggtggagagtttgggcctggctcgtccgggggacaccacactgcaggacactccaggcctggccggcttctcagagcttcagatcctcatttttcatatgaagctcctaatgctccccttatgggggactctgaagggttaatgggaggaatcatacagtgactgacccctgagaagtgtccagtgaagacagggcttagctaggattgctgttttgcctaatgctctgcgggattaaaaaaaaagaagaagaagaacaagaccattcgtctctctaggagcattgcccagagtaggtattagacacaccaacaccaccatccagccagacgctgcagggacagtgagccagggtccgagtggaaaggcgctaggcttgggaaccagctcagagtcaatacagagccaccgccactcaccaactctgtcagcttagtaaaatggctctgcccctagagccctggttccatcctttagtatctcacagggtgattgtgaatatcccatgactccaagattgagaaaacgtttagaatccctcggtgtgaaggttaactctgtccggaaagaggaccagtaaaagcttcatgaggctgagatgcactttggaagaggaatagagtttcagcacattctaggtgttggaggaatgggggaatctaggcagatgtttaaaatcaatgagaaaccagaatgctgaccatgagggttggagtgggggcctaaggacatgacggaggagcagggtgtgttcccagcttaactcaggtacccatggggaagcaggaaaagtgaaggtgtcctaggcagctctgccacaggatgaatggcttcagatgccaggtgagcgagggacccttcattcagtcagcaggaaagaagcactggcatattttttatgagaacaaaggctaggatagtaaagacagcaagtaccaaaaaatgactggaaaagggagactgtggaggcagtggcagcaggcatggaaagaagggcttgtgaaggggaaggggtggtgtcagaggaacatagggctgggggcagggattaggtgagggaaaccatgagtcacactgattctagagtagtgtgcccttgatgaaaaggataacaccaggttctaggaaaagatggggttctgtttttgacgtgttgattttcaaggacttctggtgtttgtgacacatggggaaattgtggtgggagagaggtggggccagaacaggggctggtgaggccaagggtcccagagggcacctgttgacctgcaggatgacatgaagggggaaggacagaggcaaggccaagtcctgggcaccagcctccctcttgcagcttcaaatagggctccattttgaccttttgattaattagaggtttgtcataggttgggggttgagaggagcaagggagagaaggattcagtgtacaaaaagaatgaaagccactggctgagccagtggggagttgtccacacacacatgagcctttggaccatgagaacgagggaggccttgccttcctgaacggagtaggagtgaggtcctgtgctgagcgtaagcagtgggattcccacagcactgggcacagagcccacgggctgcctcctgagcagccagcatctgcctggggtggacacagtgacagagagatgggtggtgactggggtatgggcagagataaggcagcaagtgtgtgcaaggggagtgaagggttactgaccttaagaagcagggatggcgtcctctgtcaggtgaggagcctggagaatgctttggtgaatgaacgtttgcagccccttttagcttttggagacttgaaaccaaaggagagattcatctgtgaaactctactggagccactccccaacccccacccttgtgagaccacaatgtgggcgttggcttgagatgcttctgtgttagtagaagaaataaacaacacagtgctctgatgaggcaaagcgaagatgaaaaaggagttcccaggggacatagtaggaacagtggacgagggtagcagaagaggagtttggagcaaaagactcacaagcagctgcataatctgttggtgcttggcagttcatttgtaaaaatgatgcctcttcctgccctaaaatacctaccttacccccgcttcaacttgatgagatttccatcagtcactcccaatgtgtcacagcttctgcagccctaaaattaaaaggtgagtgagtctctgaggcccctctccacttctcggatgctgagtttagccttcatgtgaatgtggaaagactaggaatacagctgttatcacacaagctggcccaatagtggttcagttgagagagccccatccttcagagtcagctccagctaggagtgactggtggccttgagcatggtgctgggcttagtgttgccatctgtggaatgggtgtgggtctgttgccctgcctcctcccagagctattctgaggctcagaaggggtgatggatgtgatggtgctcccaacactagaaagcatcttaagaatgtaagattttcatgatgactgttgctcagagtggctattatagttttgctttattgttctataacctatgattaaaatttttaccttaaactttgacgtgagtgtgaataagtatttgttttgccagcaacattcctcaccactggggccattaaagatctccccctctgagaccatcaaatacaggtcaacaggactgattaatctaattagaaaagggcttgtattaaatagcaatgataattgttgtttttagtctgtctggtgtttgacttgggaacgtttttaaaatagagaaaagcacaaagaggaaaacaacaattaccaatattcctgctacccattataattatctaggtatattttcttcttttgtaagaaaaagaaaccctgttatattgttaaaataacacaaagttaatataaagaattttaatgcaaagattaatgttttcaaatcaccacaaaacccaacatccagaaattaccaatattaaaagtagaaaagtatcattctaaatattttctgttgcatatgtatgtgagtggataggctgatgaattaggtggattgatggataggtaaatatgaaataaatactttcataaatattccaacttatcatacatgccttaaattcaagaggtgaaaaaagacccaaacaaaactagagaagcggcttattttaaatatcctctgacataaaggaatattatatttaaaggatcctctaagattaaaaatatgtactatgaaaaacattaagaaatttgaattttttttaatccatttgtttcaatttaagcagcatctactggctcactgctttgaaaaataaggacagtattccagttcacattcagtgttccagtgttcacattatcttattatttttacattgtccagctttgtaatattcacattctattctgtaatcataattcatagtagtttagttatttattactaactctatttaaatagattcaaggatcagaccctgcccttttcttcttatttatgtttattttgattaatctcttaattgattggactttacattcaagcaacttttttaaaaaaaagtttctatagatgttctatttctatcattgtattgtttttgaggatgttggcctgttgcctttgtatttgatgagcattttgacagagtctatggtcttgggccactctttctttttctcccttgagaactttttagattttgctgatggcattgcttgttgaatgttgctgtggaaacatcaagtctagtgtaactgtttcttcttcaaggtgatttgcattttattcctgaatgcctgagggttctttatttaaccttgaagttaaataccctaattaggatgtatcttggtctattcattcggaataaaaaattcctgccattttgtctagagagtcccttttttttctctttatttctgggaaattctcttttatataaatatgttttgttccatctattgtgatctctgttgagggataccagttgtccatatgttagataatttgtcttccatatctgttaacagttcttaaagttttttgtttatttctttgtctatttttacatttactcactgttctcttgtggttttcctctgtcagtaatttaatttttagtagttcctgttctattacttgctatttttaatccatgcattaattttataataatattattttgctccttattttgtctcctgagacccgaaatctcttttttcctcttactctgttgcttttgcattttattttgaatacttttaaaattgattccatgttatgaagcaattatgaggcatttcctctcttgttggaattaacgattttttcccctaggagggactctatggtctgtgttttacttcctttcttcccctgtatttctagaaaatattttcctagtaaccctgacatttcttttcatcttgcttattctagttggtctgatatagcttgattgacatttcagccttcttcccactatatttttttttcctgtgagagctattgggttttctaaatcctgaaagaatgccaaagatggggttggaggagtttggtgaggcaaagtgcagcctttgttaaaatacttttcctttgctctctctccctcatctgaaatttagttaaataccctaagccatcagcactgtacctagttggggaatgctttcatccccacaggagattctctggggctttgggccatcttccccttcagtgtagaccacagaggactttgcttctgtcccagggagcccgcaggggctcacttctccatgttcatctgattcttgtcagccaaggtttcaaatgcttttctgatcagaacagggaaaagatacctatctgaatcatgtctttatagatatgaggctatgagggaaaattctgaggttattcttgactcacacctaaagatttggaaatgagattagcagcaaagctttgccctacatctcatgtcagaattttctgtttctttctagtctttgagtgtatgtgtgttctcacacacgccataatgaaatgcatattatatataattatgtgtatatataatattctatgactatacatgacatgttcctttagctgattgctgttaagagaaatttataggtttttatttttcttgttttgttgggtattaaggaagagaaattctatggtaattttcatgtggcacagtaatctggcatatatgttgatttttttcctacacccatttgttgtgataccaagtttgaaaacaacagatttcagtggttgcttgggaaaccacagaaccatgacttggggagagacaggatgattaggtgggaaagcacccttttggtggggctgtaaagacttttatatttagcaaaattggctacaaagtccattcccctccttttcttgccttgatttggtagagggatagacttggatacaaactagaatggattcattcttctctggagttagtgtaacaagacatttagctgctcaacacaaaaacagaaacaaaaaaattgtgtggtttcagcagtgctatacaattactttttctgacctttaatggagagaaacaccacttctttggtccctaccatcagcttcatagggttttcatcctgttctgtttctgggagggcgtaactggccatgcacaagttttttttctctaatcagagtatgtgccacttctgaccaccagtagatgaaaacgaatggaaaccaggctattatatgatacatatccattacaaaataagacatgaaactcaaaggtactttatggtataatggggcatatattcctggacaattcttaatggtcacagattttataaaaggactattagtaaatgtatgaattacagagtaatttatccttctgttagtaagaaccagctgatgacctcagtgtcaggtgcatcgtggaaggtgttgggaccttcccttgccaccaccctcaccagccatcatcagccataacctgcacattggggaagttttgacttatccctcacttttgcccctcttcaagctgttctttccacagtgaatgagaaggccacttcttccttcaaacctttcagtggtttccattttcctttagacaaagtctctgcctagctggcctctgcctgcccctcctgcctacctctcgagcactgcccccacctagggctctggttccccaaccttcactcggtcctgccacacctcccagccccttctcccttcagaactttccttcttgttgtccccaacactgggacacaaaaccctccttatcaaccctccttatctggctgactcttacaagatcagaaacctgtgtaatgctctcatggcacgctccccttgtcttcgtggatttctcagatgggaaggaattatccatgcaatcacacataaacttctacctaccctcccctagtagctgtctgctgctaaggatggggaccattctcacttactcactgttctgtccctctgcccagtccagatgtgttgaaggatggaaatatacagagtagtggtaaaatataaaccgttcagacattccaaggatgggctcatgtgctttgactcattaatgtaccactgctgaaaacagaacacagccgcagtcttgccagtaagagtgcagttactgtaattaatgaatttgctaattaagccatgatttcatactgaacttatgaccaacatattgagaaggtgtgtcttcaagaaaatttattttttgtattaagatatttactccaaagctaattgaagaagccaaatctaggctctggtttcaccattgccagggaaatgagctcatggactcctatgaactgatgatgttagatcagaagtttctcaaggccagggcccaatcactgctgaggcgtcaacagtagttccttgtacatcaataattctcattacttttaaaaaataacagatgaatagcaactattttccctgtagctcccttgctgtgcctcctaccctccaccacatgtttctggggagccctgcttcgggcctgccaactacagagaattacttttgagtatcccttccactctcatctcaagacagagttcatctacctttgggttatttgtcaaaaatgtgtcattttattacaaaaaatatacaatcatcatgtattttgattaaattttacactagattattaaaattattaaatacaattattaaaattaataatttaacatatcacatattttaaatatattgtatataatgaataataatataattattgtctattttaattcaataaatgtatagtaagttagccagttgtaaattactgagaacactctactgaaaaagcatcatttcaaatacactatttaaaatattaaatgaaatacaataacataattaaactaatctttggttcccctatttatgtattcatttatccaacaaaatctccttaagtgcttataatgggtaggtcctggctcggtgtcccctagacagacgcatgggccttcccccagcccgtcagtatggtgcaggtgtgatgtgtccgcaggtgtgtgtgtatgtgtgcaggtgtggggtccgcaggcgtgctgggcccccaggccgtgttccccttcccctccccggttgtagatttcagctgttgctgccagacctgaccggttccggaggtggccgcgccccactcactgtcgcctgctttccacaggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattggttggggaaagtcgtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtggaattcaaacaaagctcaaaccagaactgtaaatagtgattgcaggaattcttttctaaactgctttgccctttcctctcactgccttttatagccaatataaatgtctctttgcacaccttttgttgtggttttatattgtaacaccatttttctttgaaactattgtatttaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgttttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtgaa

SEQ ID NO: 1779 - DNA, 125369 bp, Homo sapiens; identical to SEQ ID NO: 1778
  misc_feature (23203)..(63202): n is a, c, g, or t

SEQ ID NO: 1780 - DNA, 125369 bp, Homo sapiens; identical to SEQ ID NO: 1778
  misc_feature (23203)..(63202): n is a, c, g, or t

SEQ ID NO: 1781 - DNA, 125369 bp, Homo sapiens; identical to SEQ ID NO: 1778
  misc_feature (23203)..(63202): n is a, c, g, or t

SEQ ID NO: 1782 - DNA, 125369 bp, Homo sapiens; identical to SEQ ID NO: 1778
  misc_feature (23203)..(63202): n is a, c, g, or t

SEQ ID NO: 1783 - DNA, 125369 bp, Homo sapiens; identical to SEQ ID NO: 1778
  misc_feature (23203)..(63202): n is a, c, g, or t

SEQ ID NO: 1784 - DNA, 4892 bp, Homo sapiens
gatgtgaataagatacatttatttattcaaaattaaaatctgctatgaagacagacaaacaatgtaacattcccagaggaattgaataaattctagttaaaactgagttctattagaaccaaatttatttttatttttattttttgagacagagtcttgctctgtcacccaggctggagtacaggggcatgatatcagctcactgcaacttccatctcctgggttcaagcaattctcttgcctcagcctcccaagtagctgggattacaggtgcgcgccaccatgcccggctaatttttgtatttttagtagagacggggtttcaccatgttgaccaggctggttaggaactcctgacctcaagtgatccacccgcctcagcctcccaaagtgctgggattacaggcgtgagccaccgcgcccggcctagaaccaaatttaggttgttataaataacaagctggccacagctttcaagaatgaagtggttggggaatgaggttaggggaatccctccgagacactggaaggtgaattaatcatcaaaggggctccctggtttctcttcctaagagtatttgtagcagttaggaagccccaagcccagagacaagataaattagagggaggtcagggaaaacagctcaacagctagaaagcgtggtcaggcttggaatggaagcttctgttggctccccaaagaacattttttttcctcccttatgtaacttataatttatcttaaaacactcaaataccatagtgtgtcaccctatggaaacagcttaaaaacaggtgaaaataataaatattgaaaaaaattataatattgggcttctttctaaatcgttcacagagaagctcagtaaataaatagaaatgggggttgaggtatcagaggtaataaatattctataagagaggtacaataaggtttctcaaggggctgggtcagctatcccagagccccagatccgattttggagacctctaatttatgtcctagagtctatagagtcgccaccctgatgtctcagtttcgtatcttcattgtcatgtaggcttctatgtagttgatgaagatgtcaaactcactcatggctttgtagatgcctttctcttggagctgtgcagagagataagaaacatacagttaaaatcctttctggggactaaataggctcccctccctcatgctcatggatgggcatgaccttgagtgcagaggttgcttgttctccctcacgctgggaagtaaaccagaggataggcctagctgccttgggaaaggctgtgcattgaccttcatctcctccaggcctccccctagcaaggggagcattcattttgcaaagcactgtcttcaaaatgatgccttttcaacaattttaaaggtcacgtattcacatgatgattatgcagagtttgatgaaaagacattagaggaagcgcttcgaaagcaagacggtgagaggagaggagggagccttttaaatgtctgtgttctcccaccaacacactgagcaggccctgccctgccgccctgacctactatgagaaattcacaccccctgatgttggcactctgtgcagtgtctgtccccagcccacgaggaggacataggccgcacggtttctgggaaatcagactgaaaaagttcacgcacagttggaagtgtgaaaccccatttcgtttgggaactgacattctcaggcacctccgcaggtgcgaagggcagatggaaagcgggcttgaaccaactccaggttaagtgagaatccagcttcctgctcattctgagttctggggagtctgggctgaacccccaggtgtatttgtatgtgcacatttatgtgccagcttcctgcacgtgtgggttcagcctagattcccaacaagctactttctgtactttctgtttcctttgtcactctccccagcatgcagctcactgtgttcacaggctggccggccagcctaacccgcaagcctgcaaaggcagcgagcagtcatttagaaacccccaaagacacttaacagaaaacaaatacaatcaaggcagcagctcctcactggctgagcaggtcataccatctgtcaggttcccacactctctccaatgaagaatggggcctattgagtccccaccaccttccatgctttggggttggggagtgggcatgggttgtgctctgcagaccctctctgccaccatccaagctcaccttattaaaggcattcttcacctgctccacggccttgctcttgttttcacagggaagaaatcgatgctgtggaagaaaagagaaagtgttggtgatcctggcttccagctccatgtccatcacacttaggggacaagctggtggcatcatgaggaggccagatttatccaaatgccttgcctcacagctcccagagagaactgagccctgcttccatggccctgggagttaaatgtatttctccaggactcactccaagatgtttgcaaggcttggatgacaacccaggtcttgggattccttcctcccccagaactctacagtatctcctgcagtgctgagcgaggcattcttcagcctgtccttttctgcctctctctcctgttcctccccgtcagtcacagccaccgaggaacacttctaagcatctgaggagggaagctactgggaccaaacccttcacatagccttgtcctacaaatagacaccaactgattttccaatattggtgacagaacaggggaaaccattagtagtgagggcatcatttcagttggagaaataaattacctggaggaattactcatagacactagcctggggatgaatagcccccttgtcccttctaaaatgccaggggaaatcctgtcagtcaattgggcccttcttagagctttgctttcaaaacattgagattaaaagaggtgaatgatgtttcctctgcttgggaaccttagctccccgcccagggtctagttacaaagaggcagtggaggcctgactgaagctctgggctccttttatgaagagagaggggagtagttaataacccacaaatgactcacaaataacaggaaagctgtttgcaaatttcacatgtaaatgcctagcagccacccccaacgcctgctcaaagagaaatgagcaagagatctgactccaggagtctttcctcatttacagctagctctgccagtctgtgtctttgctgtgtctgtggatgtgagtgtccctgctggtctgtaggagatggtattttgggggcagctgcaagggaaaaaactgatctgctacttacacagcgccgtagcctcagcctgagggtcttcaggttctcccccagggagttcacatgcgccttgatgtctgggtcttggttctcagcttggggcatcacctcctccaggtaaaactggatcatctcagacaaggcttggcaacccaggtaaccctaagggcaggagccaaaggtgagtgagagattggcggaggtggctgggaggaggggctgctgcaactagcttaagaggacagcttggttctagcgatcctccttcaccagaagcctccccgaagggactgagccctttgtaaaccctctggctgctggatgtgctgagttaacatcttcccacttctccttttcaaagcgaaggaaacaaacccaattccctgcaatcaggaagcagagtctcccttcccttaatcatgctgcacactcccccagcaccccgcccctgctctcaccttaaagtcctccagcaaggactcctttaacaacaagttgtccagctgatccttcatttgctgcaggaagaacaaaaggagaatgaacttgaggtttggggaaataactgaaatgcggtctttttgatgccctttcatttagagatttttttttttaaataaaattggctctggcccaaaaaaatcaaaaggggagttttaaaaacagaggattcaacagtgatgggaccatcacttaaatcaggtcctcctcctcagagtcaagttatttaaaaaatctggccgattttgaagggaaagcagaagcttgactcagtcctggtcttctttctgcggagctacattcggctttaagggacacctatgtcaacccttcggggccttgagcccccctcatgtcctgttctctgcttttctttctccccactgtagacatccagtttagcttggaaagatcccagggattaagaagctccttctaatgcaggtttccctcatgtagagtgcttccctaaaccactggtctttcaggtctggaaacgctctaagcagaggcaatttaaatttccctgctgcaaggcatggggagcatcttcacctcgaatcagacatttctttacttctcctagccaataaagtatagagcgccagcaggatcttataagtttctcagcacgagagagaacgcatttactttataaggcaggtttcctgcacatttactgtatcatctggcttagcttaactcaccaaacccatggcttgatctaggattctcttaagaatttaagtttgggggaataggtgttggggatggaggtggaggcgcaggaggagggttcttatagttccaggagaatgtctagttcaggcagtcccaggaagagagaaaggacaggaaggaatcatactcacaaagaaagtcttcactctgctgaaggcatctcggagatctcgaagcatgttaggcaggttgcctgggaagtgggtgcagctgttctcagactgggtgccctggcctgggctggccctcaccccagtcaggaggaccaggcaacagagcagtgctgagctgtgcatgccttcttttgcaagtctgtcttgtggtttggttttgcaagagcaagcccctgatgtgt

SEQ ID NO: 1785 - DNA, 15093 bp, Homo sapiens
gtcagtcccagcccaagggtagctggaggcgcgcaggccggctccgctccggccccggacgatgcggcgcgcccaggatgctgccgtgcctcgtagtgctgctggcggcgctcctcagcctccgtcttggctcagacgctcatggtaaggctccgggacgcggcccttccctgccctgccctctccgcgcccgctccattaaagttctccatccagtggagagccctggctggctggccctctggcagagcggtgcccgggtgctcccttactctggcaaacctggatctcaggctcacctgttgtggaagtggaagaggctgaaattgacaggaactgacggattgggaaggatagagaagtatgcgcaaggccaaacccccaacccgcaaacctcatcatccacccacttctagatgagccgtaagtttagctctaggttttttgctgtttaggttcaaatgatgggacttcttgtccccttggggaataattttgatctcctgactctcccttctcttagtcgactcttcaactaacctctgtctgtccttctcccatctcaccttcatccctcactgatcaccccgatctgatcccccttgctccacctgtagcccccaactcactcccactgccccctgcctctctcctcctaacccagccagttcaggcttctaacccagttcaggctcctaacccagacagttctccggcaaggtttctgcaactaagaaaagtaaaccccagagacagaatgaaagagccgggagttggaaggaccaagagcagagacagagagcaaggaccgaaactgcttcttcatgacaccaaaatacaaagtaaaacatgcagtcagccattcacgtgatcgagagctgagtcggagatgtgcagcccaaataccacaacgactcgctgcatttttcactttccgtctaatgtttcgaaatcaaggcactgacgtgaagatcaaagacggtataagaaagaaagcaagagacagatgacagagtcctcccccccaaaaaataaataaaaaacaggtgcatgattagagagatgtagagaagttagaacactagggagcgggagcagagtcgctgtcaaatggagagaacttagaggatcaaggaggagagaaagggaaccaaccagccgttggccttgcacatacttcagtctgcttgatcaacaagactcttaaagtagaaatgtttgttgcattcttacaaagaagacaatgccttcagcagtgtttcccatggtgaatggtgtgtactgggggtaaagggagagtagagctaggaattggtattgagtatctctcctcggagctacaggtgccagctcttgtggggatgtcctcagccatgtgtagagccagagctgatttattccatctgtccttgcccagccagaggttggacatctggctataggcaaagccctcccagaaactagggaatgaggcaagcacttagcttggggagcccaggagacctatgaagagaaggaggcagatgtcagcaagcaggctgtctgtgtacttagtgaggtggctttgagctggagcctgggccaagccagggtggggatcaggtgtgtggatggggccaagcctaggaatagtgctagagcagggacagggattgggcagagccagggactaacacatctgagagctcattgccaacttgcttagccctcggcccctgccttcttccctggtaggcatcagactcagcttggctcttctcagcccccactgcagcttctgatcacagagagcacagggcagtgatttagggagacacactagctctagaatcagacacatgtggattcatgtgcccactctgccccttacgggctccgctggcctcgggcgagtcatagcctctctgaacctccctttcttctttggtaaaattggggtcatcaatgcctgccccccctcccagctgtggtactgacactcttctccccagggacagagctgcccagccctccgtctgtgtggtttgaagcagaatttttccaccacatcctccactggacacccatcccaaatcagtctgaaagtacctgctatgaagtggcgctcctgaggtgaggaaaagggaagagggagggggagggaggagtgaatccccgccttgtcctctactctcctagcatgggaagatacctgccttgttaatgaagtgagtgcctgagggcccctaacacatagccagcagttgacaagtactgactgagactcccttgctgagcaatgtgccgggagctctgggtgaaaaggccagagcctttgctcactccagagtaagaaaagccttgtgccaaggcttttctcttttttgttttgttttgttttgtttcgttgagacagcttctcgctctgtcacccaggctggagtgcagtggcgcaatctcagctcactgcagcctctgcctcctgggttcaagcaattctcccatctcagcctcccaagtagctgggattacaggggtccaccaccatgcctggctaatgtttgcatttttagtagagacgggttttcaccatgttggccaggctggtctcgaactcctgacttcaggtgatccacccgcctcagcctcccaaagggctgggattactggcgtgagccaccacctccggcctccaaggcttttctatcttactggaaaaggagaagcatccacagtacagccagacaacaggggaacactaatgactgtaaaggcagtggggagaagggagagaccaggctgtgctgtaggagccagaaagaatttctggaagagctgggcctactcgtattcctatctaaaaatctgctagaccacatggaaattggtacggggtcccaagaccaagggagacccctcacaatgagctgccgtggactagaggatatagcctgagggctgtcccagtttctcccaatgtgggagctctcttcctggcctcttgcgtctcccttaaaggaggtaggattgagcacaagctcgtttccagtgcctaacctggtatctcctcaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaaggtgcttttcctcccttgacttagaacatggctctgaagtcccttccagccaggaactctagtctagagcttttctgtctattaccatagctcaccatgtctgccagcctccctggccggagaactagttgcccaaacagggcaggactttggagaatgttagataaaaatagcccaagttgtttgagatttaaaagggaactggagttgtttatcctacagaagagaggtcttggggtgggttgggacagctgagtcaccaggtccaggcctgtgaacttgttttttcagggagggttcagggagaggaagcgaatccatgaacactcagcatagggcagcaagcagtaggcagaatttgggtgaacgccccgcttctttaggggtgaacacccaggggtcatccctttgaaatgggaagtgctactaaagagaagttatggatccctctctggagaggtaagaggaaaggataagcccccaactcagtgggatttttcatcccaccagttgggattgagaaagttttgtgtgcatggagacctcgctctgtaggattcagagttagagccgatggtctaggaggtcattggcttccaaatgcctgcccacaggccactgctcagctggtgcagaaacgtttcccagcaagtgtgtttaaaatatctatttccagggcccagcctcagaaattcagaccaactgtgtcttgaatgggcccagggcatctgtattttttttttttttaacattttgttcttctttgtattttgatttgagcaaggcaattataaaaagacatttttgaggaaatcaccatatttgtatatgaaatggtttttagggcatattactaggtatttgtttgttacatgtgataacagcatggtagttatatttacaaaggtgtgatatgtgagagatacatacttacgtaattaggaattaagtaatacagtgcttgggatttttctttaaaatgctaaagtaaatttcatggggggatattgatgaccctcccctgccaccaattacttcaaaattggcctagtgtttgcaattactaaagctgggactttggaaatcattatattctcttctacttttctgtctattggaaatttctacataaaaatataatcaatgcaatttatcacattaaccatttaaaaaagaaaacaacatttaaaaagaaactaagcaaagttaaagtagaaagaaaatgtcctaacctgtagaaaggtatctatctacacatatctaccataaatattatgcttaacagtaaagtgttgggctgggctcggtggctcacggctgtaatcccagcactttgggaggccaaggtgggtggatcacctgaggtcaggagtttgagaccagcctggctgacaaggtgaaaccccatctcttctaaaaatacaaaaattagccgggcgtggtggcgtgcacctgtagtctcagctactcagggaggctgaggcaggagaatcacttgaactcaggaggcagaggttgcagtgagccaagatcaagccattgcactccagtctgggtgacagagcgagactctgtctcaaaaaaacaaacaaataaacaaaaaacagtaaagtgttgaaaacgttttataaaaaagtttttcttttaattgacaagtaataattctacatgtttatgaggtacagtgttatgtatacataatacatgtataccttgtggaatgatcaaatcaaggtaattagaatatctatcacctcaaatatttagcatttctttgtgccaaaaacatttaaaatattatctttcagctattttgaaatatacagtccattattattactacagtcaccttgccgtgcaataggcaccagaacttattcctcctgtctcactgtaacttggtacccctctccttgttccctatccacttctcccacctgcctccttccagcttctggtaaccacttctactctctacttctatgaattgaattctaaaagaattctacttagattctatacataagtgagatcttatggcatttatctctttgcacctggcttatttcgctcatgatgtcctctaggtccatctgtgttgtcccaaatgagagtttccttttttttcaatttgagacaaagtcttgctctgtcacccaggctgcagtgcaatgtcttgatctcatctcacttcaacctccgcctcccgagttcaagagattctcttgcttcagcctccttagtagctgggattacaggcacgtgccaccatgcccggctaatttttgtatttttaatagagatggggtttcaccatgttggccaggctggtctcggactcctgacctcaaatgatccacccgcctaagcctcccaaagtgctaggattacaggcgtgagccactgggccgggcctcagtttcctatttttcaaggctgaataggattctgttgtatatacataccacatttaaaaaacccattcatccattggtgggcatttccatatcttggctgttatgaataatactgcaatgaacgggggatacaggtatctcttcaatacactaatttcaatatctttcgatatatacccagtagtgggaattgctggatcacatggtagctctatttttagattttcgaggaacatccatactgttttccataatggctgagaaattcaccaccagcgacatgcaagggtttcccttttcaccacatccttgccaatgcttgttacttccatcttttggataatagccaatctaacaggtgtggagtggtatctcattgtggttttaatttgcatttctctgatgattagagatgttgaccattttttcatgtatctgttggtcatttgtatgtcttcttttaactgtctattcaagtcctttacccattttaaaaacaggtttatttgttttcttgttattaagtagtatgagttccttgtatattttggatatgaaccccttattcaatgaacatttgtaaatattttccacccattcatagattgtgtcttcactctagtggttgtttcttttgctgtgcagaagctctttagtgtgatgcaatcccatttgtctatttttgcttttgttgcctgtgctttagggatcgtatccaagaaatctttgcccagaccaaagtcttagaactttgccccaggttttcttctggtggtttttatagtttcaggtgttacatttgtctttaatccattttgtgttgattgttgcgtaagaggtgagacaaagatctattttcattgttctgtttgtgaatatccagttttcccaacaccatttgttgaagagactgttcttttcccattgtgtgttcttggcccctttgttgaaaatcaattgtgggtttatttctgggctgtccatcatattccattggttgatgcatctgattttagggtatatgtatttttaatgtgctccccaagaagtccttacattctgctgcattgacaaacctgtggccaagttttaggcctaggttctaattaagcttaattctggaggcaaagtctcggcggggacacccaggccctcctcagccctcaagtctcatggtattcccccccaccccaactccatttagtgactctgacagttggcagtgtgaacctagagatccacaatggcttcatcctcgggaagattcagctacccaggcccaagatggcccccgcaaatgacacatatgaaagcatcttcagtcacttccgagagtatgagattgccattcgcaaggtgccgggaaacttcacggtatggggttccccaaggccccagggccagaactcccttggcttccctgtcccctgggctggaagcacccttgtgtgccattgggaactttgcttatggactaaagggagggtctgggatggtgggtgggcagaggagggagtagaaaccacctcagccctcagagctatgctcttgtgagatgctcctcaaaggaattgcctactagggcaattgggcaccccagagcccttgtagatgaagcaataaggctctgagaggctgtgtaacctaccagagggcgcccctgttatgggagagctggcatctgcaaaatccaccctctctcctctccaccactgttgattccagccccttctgggaagatcttcagcatctataaaacaccgctttttcttttaaaatacaaaataaaattgtggtcattacagagatcatgtgctgcattggtaattgtggggtttgtcatcttagacaaaggatactgaagggggttggctgaaatcacctctaaaggcccaccagctctcagtgtccgtgtgccatgaaataaaaggattttgttaattgctatcatttttgtttcagttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtgtgagtcagctgggctgctctcagcatggggagggagactgggagggcctggtgcaatccaaaacgcgtgcacctgggatgctggtgccagccactgtgttaggtgctgcttcacatagctctgcatccttaataggagagaggtcctactgtcctcattttagagatgagggaactgaggctcagtattagcaacttcctagggttgcacagctaggacttggtggcagaaccaggtctcttggatctagggtcctcccactggagcacagcggtgtttcccaacaacatccccctcccccggggccatcttcagtgagctgtgctagttcctgttgttacagtcttctgctgttcttcctcagagccagggatacaaagggcttctccttacttcccctactctgctctgctcctcgccagagctgctaaagtcagcaaatactgctccaggctgtcagtcaggtgccggggctgtagggggagggagataatagaggacatggaggccacggtcttgcctaggaggatcttgcatcctggctggggagatagagtgtgcacagaggagactgtaacaagcaactcttattggacagcagatgagatgtccagtgcccaatgaaacatgccaacagtaagtgctctgggagggcccagtccagtgtgggcagagtctggcaaaggtgaaagtgactcctgctagatctgcaacaaatttcagtttgtgaaggacactcaacagctcagtgtcatttaagtctcaatgcagaggaaggcactaagtgggtatcaggcagtcttaagagtttttcatacattcattcactgatacatgaaatagttccaaatctcagctttacaacttttgaggtatatgactttgggcaaattacttaacttctatgtgcttcaggatcctaatatgtaaaaatggggctgatgatagtatttacctcctataagtataaaagttaaaagaatctgatggtattggtacatggtcagtgctgtgtacttcacaactaccttatgaggtcagtggctctgacagagtaattaatttgtccacaattgcacagctagtaagtggtgaagctgggacttgaacccagatctagcagcccccggagcctcgattcttacctgctgtaccatcctgcctcactgttctgtttgctgtgatgggagtcatgtgcagagagctggaagcagttagcgcatctcctgagggaatccttcagggcatggtttggaaggccaggtagggattcgcagaaacctagacacatctagagttgtggcctgtagtttgccttgggccactcactgaatggttcctgacagtgggcaatggatttcatgggaccagagtcctatgtccagaatcaccgtgccccatggtgacaggccacaaacacatctctctgggcctgcagatttcaccgtgaccaacgtcatcatcttctttgcctttgtcctgctgctctccggagccctcgcctactgcctggccctccagctgtatgtgcggcgccgaaagaagctacccagtgtcctggtgagtcttgcaaggaggtcactgccccgtccttcccagccacacccgagcttccaggagggcagggagctcttttcctcccagccagtccattgccttagcttgcctctgctctcagccctgatgtgattgggagataccttcatcaagcgctgtggggacagagggaggaagtgagcatgaagcccagtaccgagaatgttgccatccagtagctcagatgagacacatggaatcacaaatctcaatgaccacgagccattttgatatgatctactagtagttggccatggactagcccctgtgcattgcatctctgattatgaggcacagttattatccccatttcataagtgaggaaactgaggcacagagagattgttacacacagagggccacacagccaggaagagtcagggagggaacccactttcctactgctattagccatgggtgttccacaagagagaaagaaggaaaggccagaagtgctggtcctcgggctgctgccagagtgggccagaggagagaggacactggggggcggtggggatgctgcgccactggagaggggatgctggcaggggacagggaggggctcatggaggaggccaagccctcctcccctcccagggtgtgtcctcttgctacattgtactgacaaatgatacatttgtggcaagccagtctccaaaactcagcttgcaaagattgggcagcattttccaaacctcggcctggtctctggcctggagttcaggccgcattgaagattgcccaccatagcctccatagctggcactattgcatgatggctgagggatcagctgggaaggaaccagctccgtctgcaaggcaggggccccacaactggaaggggaatctccagagcgatcctgggatctctagggaaaacaagacgagagacaagtgcagtggcacaatctcagctcacttgcagcctcaccctctcaggttccagtgattctcctgccttagcctcccgagtagctgggattacaggcatctgccaccatgcctggctaatttttgtatttttagtagagacggggtgttgaccaggctggtctcgaactcctgacctccggtgatatgcccacctcggcctcccaaagtgctaggattataggcatgagccaccgcaccctgccccttctgtacttttggatcacagaactgacttgtccttgagggttttttctcttcaggataaatatagctcaatcccttcatctgatgatcgtagtcattaccacatgaataaattataatgcacagagcactgacacattcattagtttgttctcattcattagcttgtttgatttgatctttcaacagttcatcaaggtaagtattattggacaaggaagggatttcaaatcaggacagttgaggatgaattccagatgtgttctttactgttgtgccactttgtgcaagtcatttaacttctctgagcttcagttttctcctctaggaaatagaggtaataatacttctcttacagaattattggagggtaaagttcaattcaacatatatttattgagcaccttctatgtaccacactttgttctaagcactgtagacacattacaacataaggaggcaggtactgtcattatttccatgttacagatgaggaactaaagcacagagagggtaagtaatttggtcagggtgacaaagctgataagagtcagagctgggatttgaacccaggaagtctggctctagaggacacatcctaaatcaccaagcaatgtgataggaatagggactcaaccaataagagctgcatttgaatcatcatgtaccaaggaaatgagggcagatgtgcaacagtgagtcagtgagtcagtcggcagaccttaggagggcctactgtgtgccagctcagtttagactctggagacagggtagtaaacaacactagacagttcctgccctcaaggagtttgtgttcttttgggaatgtggagtaagtgagtgtgtgtatggtgagagacgaaaacaaacaagtaaaataattctaggaacaaagtgctaggaagaagtaacagggttaatgtggagagagtggcaggagtactgctttaggcaaggtattcaggaaggctttgctgaagaagtgacatctgagctgagacctaagccatgtacaggacacagccatataaagtgccgagagcatttcaagcaggagggagagtgtgtgcaaaggccctgaggcagcacggtgcttgatgtgttctgggacagaaagaacaccagtgtggctagggcagaggggttatgtggcttccttgaaacccttggcaattaacagagagcagccccttcactgtgagttccacacttgtgccactgccccacgctgcagccaccatgttcgcgtgagtcactactcggggaatagaaaacttaatttggtgtcttacatccagaattttagaaaatgaagtaggcaggagggcatagactgggatacaatagaataagaactgcagaaatatcgtggcacagctcataatgatgagtattattttgtgaaactggtttcagttatttacatacgggttatatatacaagtcattatgcaacttatttctgattttgagtcatagtcaaaaaagtttgaaacatgcttctagatgggtctagcctgctttcaggtttgaaaagcactgtggatggagccacctgagagttttcaccatgctcagcagaccttggttctgcctgttactccatctgggcctgagaatacaagtttcttgtgtatctggcctgagccaaactgggaattgcattaggaggaaagctggattcgaaaacaaaacagaatacattccagtgtaatttagactgtagtctcctccatcgagctctcctcctgggcctggccttccccggcagcactgggatgggtgctggaaggtgactcctgcttctctcactctgccctctcttccccagctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacagggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggccccagccaggccctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcgtagggatgtgaggttctgctgaggaaatgggtatgaatgtgccttgaacacaaagctctgtcaataagtgatacatgttttttattccaataaattgtcaagaccacaggaa

SEQ ID NO: 1786 - DNA, 15093 bp, Homo sapiens; identical to SEQ ID NO: 1785

SEQ ID NO: 1787 - DNA, 30875 bp, Homo sapiens
cccgcccatctccgctggttcccggaagccgccgcggacaagctctcccgggcgcgggcgggggtcgtgtgcttggaggaagccgcggaacccccagcgtccgtccatggcgtggagccttgggagctggctgggtggctgcctgctggtgtcaggtgaggggtccgcggggagggggcgcgcttgggaaccgggaggccccgcgagatgccgcccctgatcccatccctgggcgccctgcaagtgacttaagagccttcggggcctcgggagagaagatgcaaacgccacggccggctgctgagacgcaactaggctgctgctgccgtcgattctgtaacaggagaaagccccatccgcgcccggattacagaccgtctgggccctaaactcagggggagactcccggcgtcttttgattccctgtcctcctgcagctctctgctggcgggcgtctaaataaagtagcttccccaaaagacccaagatcccaccgtggctgtcatctgacccttctggagactatcagttcaagtggaggcccccaccagtccccgagtgccctgacagccctccctgaccccaagtctgccccctcagtgccagccctccctacagatgtgcctcccatcacccgctgcacctcccctccttccggttcaggcccgagcaccctgaaatctggattctgtcccccagcgccccagctccatggcttctaaacctaaatccattgaaaccttttctgtcctctaaattgactgcctaggttccaataacaccatggtcacctccttcctttctcatgaactcttccctggccttccgggatacccctccggtttcccgccctgtcaggctgtctctgcttgggaccctcctgctctgtcaggtttctatgtagctaattgtgatgcccaaggccttttctctccttccctggcactgttcctttgggggatttcagccaaaccctggcattaaacacgggctataggcccatgactcgcacatttatatctctcttggtaccagttgggtgatgggtggtggtttattatagtcttctacttttctacttgcatgtaggtttcaaattttcttttctttctttcttcttccgtttttttttttgtttgtttgtttttttgtttttttgtttttttttgagacagggttttgctctgttgctgtggcccaggctggagtgcagtggcttgatcttgcctcactgccacctccgcctcccgggttcaagcgattttcctccctcagcctcccgagtagctggaattacaggtgtgtgccactacgcctggctaatttttgtatttttattggagatggggtttcgccatgttggccaggctggtctcgaactcctgacctcaggtgattcaccttcctcagcctcccaaagagctgggattacaggcgcgagccaccatgcctggccaggtttcgaattttctattaaaaggtttgaaaataatttctgtctctagcccacatctcttcttggtgtgacctctgggctcattcatctggctgtctccctgacattcctacttcagcctctctccagcatctccaacctaatgcagctcaaatgggactcgtgagttccccagctgagctccaatcggggcaccagctgcttaagcccaaaatggacattgacctcagcttttatgcatcaaatgtatcaggaagtctccagtttgtttttacgtctggaaatatatctgaaatccatgtgcccaccctaccccctcatagctttctgccaccagacaaatccaaggctcctttgtctgtccccattttactcctgcccctccagaaatttctcctcacggctgttcaaagaaaatctagactcctcagcacagccaacctgtctctccctccctcacccacgtggcctttgaagacatggagccatagaggagaaccaagtgctggatgtgggctttttcatgggcatctgttttgaggagaaaagttgtaaatgtttttgtcttattttcatagcattgggaatggtaccacctcccgaaaatgtcagaatgaattctgttaatttcaagaacattctacagtgggagtcacctgcttttgccaaagggaacctgactttcacagctcagtacctaaggtgggtctggcctcactattggcaggaacgcaccggaggagccagccctgggctggtcactgggttgggccacaggaggaagggagtctgactacggtcaccgtgtgactgtgacaaccctcagggagcctccctgccagccttttgctgtctgggaaattctcgtggccaccttttctcttttaggttttctagttgtgatggttgacgatttgactgttaatcacagggctgctggcagatacagacattttatcatgcgtatgtagatataatcagccatagtggtaacctcatgctgtgcccatcccagcttgtttgtcacagttgatatattttaaaagaaaaataccactgctgtcatctctaggtatgagtagtattgctggaagtcagcaatgttgagtggatgctacccaagaaactgagatatgcaaagcggtcaggaagccccttgctaccatatatcacctgttcccctccaatggattataacatcatgccccagtgccatgcgcgatgcacataatttgcataatgagtgctcagtttctccgtggttccatcctgaaattaaaagtaagacagctactgactgttaaaaaccccattctcggacaacagcaggggctgtgaaggaagagtgagtgtcaccctagacggtcatctcagtggtgatctgaacgccctctacctctcctgcctgtcagtgtttccctacgcctggtgaaggaagtcagtgccagcactcccttggcagcctgccaccatacgccacatgctggactgcaggtgacacacctttaggccaggcgcaaacagcagcaggaggcccaaggctgacaagccaacacacctgctttctgtgtgactcagaaacatacgaagatagacaagtccttcagtgaggcaggaggaaatttcttcccagatccagctgtcatttcacaaaaatccccaaggcctgctacatcagagaagaagtagaaaggtgaataagatagtcctcgtctgtgcattgctggcttttgttttttaacttttagttcaaaataattccagactaacagaacatttcaaaattttaagtagaatacaaagaatttccaaatagcctacaatcagattcaccaatttttttttttttttttttttttatgagacggagtctcgctctgtcacccaggctggagtgcagtggcgcgatctcggctcactgcaacctctgcctctcgggttcacgccattctcctgcctcagcctcccgagtagatgggagtacaggctcccaccaccatgcccagctaattttttgtatttttagtagagacggggtttcaccgtgttagccaggatggtcactatctcctgacctcatgatccacccacctcggcttcccgaagtgctgggattacaggcgtgagccaccacgcccggcccaggttcaccaatttttaatgttggtcacattctctcccttcctctctctctctcatgccctttgtgctgtaatatttcactgtgtatttcacaagaacaaggataatctcttacatcacatagtacagtgagaagctcaggaacttttacattcataaaatacttgtatctaatttacagtccatagtccagtactgtcagctgtcccaaggattgaaggagggcatactctataattaatttttttcctgatgtgcattttctagtactgattggctttatcatttgctttctgtgctgtctctactcagtctgaatagccacggagattttactgtggaaaattaaatttcttctctgtctgtctgtctccctgtagtttttcttgttctgtgctgtgcttttgggtttgtttgtttgtttttcttttttttttttttgagacggagtctcgctctgttgcccaggctggagtgcagtagcgcgatctcatctcactgcaacctccgcctcccgggttcacgccattctcctgcctcagcctcccgagtagctgggactacaggcgcccgccaccacgcccggctaattttttttagtagagacactgtttcaccgtgttacccaggatggtcttgatctcctgacctcgtgatccacccgccttggcttcccaaagtgctgggattacaggcgtgagccaccgcgcccagcctttttttttttttttctttgagacagggtctcactctgtcaccaaggctggagtgcagtggtacgacctctgctcactgcagcctccacctcctgggttcaagcgattctcctgcctcagcctcctgagtagctgggactacaagcacatgccaccgtgcccaactgatttttgtacttctagcagagatggggtttcaccatgttggccgagctggtcttgaactcctggcctcaagtgatccacctgcctcagtctcccaaagagctgggattacaggcgtgagctaccacacccagcccatgccatgcctttttgccattatagtcgaggcacttggctttgcatgtttatcttttatgttagcgatcccaatgacttcatgaagtgacttcatgagggtatccacacctgggttccaggtctcccccgcgtggaactacagagtgagtatggcatgtgctggagaaaacaaaatatgtgctggccgtgtccttggggaagatatttgatccctaaagatgtgattgcctcatgtggctctacaaaagagttgtttagagtttagcatgagcaattgcacagcacaaactctctgttgtttgcgtgcattggggcagggcgtccagagccgggggcacttcagaggatgtactggtgattttaatataaaaacatccaaaacaattagatgtaaatatgaggaatgggtcatattacctatttaatgcggggagaagtatttgtacatgcaataaaaataacctagtgaaggccaggcgcggtggctcatgcccgtaatcccagcactttgggaggccgaggtgggtggatcacctgagatcaggagttcgagaccagccttaccaacatggcaaaaccccatctttactaaaaatacaaaattagccgggtatggtggtgcatacctgtagtcccagctactcagaaggctgaggcaggagaatcacttgaacccaggaggcagagattgcagcaagctgagattgcaccattgcactccagcctgggtgacagagtgagactccatctcaaaaaaaaaaaaaacctagtgaaaaagatgttattgcaaaacaacttttgaaatactgcacatgctggacaattgatgcattagtttaaaagaaggaaatgggccagtaatcccagtactttggggggccaaggtaggataatcatttgaggccaggagttcaagaccagcctgggcaacatagcagcctcttgtctctacaatttttttttttaattagctggacttgagttggaaagaaggaaggcggaagggaagaaagaaggtagggaggaaaaaaaatatggccacatgtgagaaaacccccttaatgaaatgaccgctggattttccaaatgatgggatgttaagcagccgtgaagaaatggttgattgacaaatatttgtggtatattaagtgaaaaaatagcatgatcccaatgatctctatctactttttgcaagggatttttctaggtatcactaagaatgctgtgagatgtgatgtgctaccttagactatgaagtcaaacagatctgagttcagttgggcagatttcttaggctctccacgcctgacccctgtgtacttaataaatgttggctgttgttatttttatcaccatcactttcatcatcacttctgggagcaaccaaattggttttggcaccagaagatgtcttgggggaccaatcagatagctcctcacttttttattttattttataaatttttaaattaaattaaattaaattttttgagacagtgtcactctgttgcccaggctggagtgcagtggtgcaatcacgtctcactgcagcctccacctcccaggctcaagcgagcttccctccttagcctactgagtagctgggactacaggcgcatgccaccatacccaaataatttttttattttttgtagagacaaggactcaccacgttgtccaggctgttctcaaactcctgggctcaagtgatcctctgcctcggcctcccagagtgctgggattataggcgtgagccactgagccgggccagctcctcactttttgcaggatgagagcctgggcttcctttgatcacgtggagccaattacacctccttggctgttgcgagcttagattcaggagattgtatttccctagcatccaacaggcatgtccaaatgtcatctcttttcttccacttcactttctgtcatgttccctttagcggttgctgtcggggctggtgttctgactgagactgatgaattgttttataatttttccagagtaattgcaatgatagtcatttataggacaggacagtcacgggtcacttaacaactggggtagattctgagaaatgcatcattagacagttttgctgtgtgaacgtcatgcagtgtacttgcacaaacctagatggtgtagcctcgtatacacctaggctatgtggtttagcctattgccccaggctgtaaacctgtacagcatgttactgtactgagtgctgtaggcaatcgtaacacaatggtatttgtatacaggcatatcacagagataaggcagttttggttccagactaacacaataaagctaaaaccacaatagagtgagtcacatgaatttttttgtttcccggtgcatctaaaaattatgtttatactgtagtccattaagtgtgtgatagcgttatgtctaaaaaaatgtgcacagcttaattttaaaatatttacttgcggaaaaatggtagcaatcatcagagccttcagcaagtcataatccttttgctcgtggagcatcttgccttgatatggatggctgctgactgatcagggtagtggttgctgagttgcagtgactgtgacaatttcttgaaataagatgacaatgaagtctgctgcatcaactaactcttcctttcatgacagatttctctgtagcatgagatgctgttcggtagcattttactcacagaagaacttctttcaaaattggaatcctttcaaaccctgctatcaactaagtttatgtaatattctaaatcctttgttgtcatttcaacaatgttcatagcatcttcaccaggaataaattccatctcaagaaaccactttctttgctcactcattagaaacaactcttcatctgttcaacttttatcatgagattggagcaattcagtcgcatcttcgggttccgcttctaattctagttatcttgctgttttcaccacatctgcagttacttcctccactgaagtcttgaaccccttaaagtcatctatgagggttggaatcagcttcttccaaacccctgttaatgttatattttgacctcctcctatgaatcaccagtgttcttaatggcattttgaatggtgaatcctttctgggaggttttcaatttaccttgcccagatccatcagagaaatcactatctatggcagctataactttacaaaatatatttctttattttattttatttcattttattttattttttaagatggagtctcactctgttgcccaggctgaagtgcagtggtatgatctcagatcactgctgcctccacctcccaggttcaagtgattctcctgcctcagcttcccaagtagtgacaccacaccaggctaatttttgtattttttttttagtaaagtcagggtttcaccatgttggccaggctggtctcgaactcctgacctcaagtgatttgcccgccttggcctcccaaagtgctcagattacaggcatgagccactgtgcccagcttcaaaatatatttcttaaataataagatttgaaagtcgaaataactccttgacccatgggctacagaatggatgttgtgttagcaggcatgaaaacagcattaatttccttttaaatctccatcagagttcttggggaaccaggtacattgtcaatgagaggtaatattttgagagaaaactttttatcctgagcagtaggtcttaatactgggcttaaaatattcagtaaaccatgctgtaaacagatgtgccgtcctccaggctttgttgctccatttgtagagcacaggcagagtagatttggcataattcttaagagctctctgattttcaaaatggtaatccagtgttggcttcaacttaaagtcaccagctacattagcccttaacaagagtcagcctgttctttgaagctttgaagccaggcattgacttctcctctgtaactatgaaagtcctagatgacatcttaatagaaggttgtttcatctacattaaaaatctgttgtttagagtatccaccttcatcattttagctagattttagctagatcttctggataacttgctgcagcttctacatgggcacttgctgcttcaccttgcacttttatattatggagatggcttctgtccttaaaccttatgaaccaacctctgctaacttccaacttttctttttttttttttttttttttgagatggagtctcgctctgttgcccaagctggaatacagtgacacaatctcggcttattgcaacctctgcctcccgggttcaagtgattctcctgcctcaacctcctgagtagctgagattacaggtgcatgccaccatgcccggctaatttttttgtatttttagtagaggtggggtttcaccatgttggtcaggctggtcttgaactcctgacctgatgatccgcccacctcagactcacaaagtgctgggattacaggcgtgagccaccacacccagccccaacttttcttctgcagtttcctcacctctttaagccttcacagaattggagtgttagggtcttgctgtggattagactttggcttaagggaatggtgtggctggtttgatcttctatccagaccactgagactttctgcatattttcaataaggctgttttactttcttattattaatgtgttcactggagtagcactttaaatttccttcaacaacttttcctttgcattcacaacttggctaactgtttggcccaaggggcctgttgtggcctgcaatatgccttcctcactaagcttaatcctttgcagcttttggaatagggatgcccgaggagaaggagagaggcaggagagtggacagtgggtggagaagtcagaacactcacaacatctattgattaatttcactgtcttatataggtgtggttcatggtaccccaaaacaattacaacagtaacatcaaagatcactgatcacagatcaccataacacatataatcatgatgaaaagttttgaaatattgcgagaattaccaaaatgtgacataaagacatgaagtgagcatgtgctgttggaaaaatggcaccaatagacttgctcaatgcagggttgctgcagaccttcgatttgtaaaatgcaatatctgtgaagtacagtaaagcaaatcacaataaaatgaggtatgtctacatctaaatgtatttaaacatagaaaaggtacagtaaaaatacagtatcattatcttagggcatcaacgttgtatatgtggtctgtcatctaccgaaatgtcattatgcagcacatgactttattgaaaatcattgtaatatctttattttggtaaatttttgtaaatcaatgtctcataaatcacatgcccctgttttcaaaaatacgtaatcaaggaagcaagctttcttggtcaagtatgctgaatactcaaccccttggagaggcacgtagtcattaagatgttcaagtctctgagaagttctgttttgaagacacgtatttctatgtttaacacagtttccactcccgcgccgcccccccctccaaattaagtaccagtcagcctcagggagactgaagccagaactctcctgattgacctatctttttgattgtgtagttataggatattccaagataaatgcatgaatactaccttgacggaatgtgatttctcaagtctttccaagtatggtgaccacaccttgagagtcagggctgaatttgcagatgagcattcagactgggtaaacatcaccttctgtcctgtggatgacagtaagccattttgttttccctttttttgtaatgtcatcatcttgccttgtttttttccacattggttggtccatcaacaagaattctttgagggcccacaaatggatggccttgcacaaggagcttaaggaatataataaagagagttgtatccctaaagaattcatgggagagacagaaaaagataggcatatcatcaatgcaacaattaaatataaatctaacaccttcagtgcctcaaggatgtgactatgttggggcccgtgctgttgaggagaagttctggaaggattcttgtggtgaattttctgggagaaagtcagtatggaattatgacttaaacaaagaaacataacgtgataggcaaaagaatgaaggcagatgtagagatggaaaatatgatgcggacagccggcttgcccagagcgaaggacagagggagggatagggctgatggcaggtgggttgggtcagactggttggtcagcatcaaaaattgttcccaggttaggtggagattgcagtgagccgagatcacgccactgcactccagcctgggcaatagagtgagacttggtctcaaaaaaaaaaaaaatattgttcccaggttagatttggagggtcatggtgaccaccagagtcccctaaatatgagatgagcatatttagaatatcaggaattgaaaactaattaaaccatatattagcaattgagagagtaaagaagattagaggttaaaagaacctaattcacaaaattcacatacagcccttcaaaactcacatagagaaaagcactaaaagaattgtctctggctaggcatggtggctcacgtctatgatcccaacactttgggaggctgaggtggtggatcacttgagcccaggaattttctttttttctttctttctttctttttttttttttttttttttgagacaaagtctcactctgacacccaggctgaagtgcagtggcgcgatctcagatcactgcaaactgcctccagggttcaaatgattctcgtgcctcagcctcctgagtagctgggacttcaagtgcctgtcactatgcccagctaaatttttttgtatttttagtagagacggggtctcaccatgttggccaggctggtcttgaactcctgaccttaagtgatccacctgcctcagcctcccaaagtgctgggattacagacatgaaccaccacacttgtccttgagcccaggaatttaagaccagcctgggcaacatggtgaaaccctgtctctacaaaaaacaaaaaaaataccaaaaaaaaaaaaaaaaaaaaattagccaggcatggtggagtgtgcttgtagtcccagctacttgggaggctgaggtgggagagtcatctgagcctgggaagtcaaggctgcagtgagccattatcacaccactgcactccagcagcctgggtgaccagagtgaagtcttatctcaaaaaaagaagtgtctctatatggggagtggtctttatgccggtccctgctctggacccccatgacccctacagttacatcctccctggtagagaatgatgctaggatgcctttcttccctttcccaattccatcccaagcctgggtaaaaacgtcttacttttggaatcataaattatcaaagttagattatattttctaatggtacctttacaaaaacaaaggaaagatgaacagaaaagtaagtttcacaatagttaaaagtacaagtttttgctcctataattgctaactggcttaccaggtcctaacttgtcccaaatcctgttagctcccatccatggaagttccctttagagcctaggtacaacacggttaagcagcttgtcaaaaagtcatacaggtcatgagtggctgagcaaggattcagacccaggctcttgcttctgtgctcttagcaactactacccaatattggagatttgcctcttgaagtctatgtattttagtgataggaaagtgtttccaggcatcatgcataacctatttatacttgctttggcaaagtattccaacaagttttcttgtctggttttcagacgagcactttagaatgatggaagcaggtccattaacagccctgaaaaagtaacagcagccaaagaagaatacaggacataactcaaacaccatgattgcctggaaccatttatgaatcattctatagttattattgagtacatctgtgtaacagctgcattctgagcactgaagctacaacaatgaacgagacaaaatacctcatggagcatatatgtgctaatcaggaatacagataataaataaatagatacatattacatgacaggtagtgactatggttcttaagaagactgaagcaaggcaataggacagaaagtaatgggagctgcacttctacatagaatggtaagatacagtctctctgaggaagtagcatttgagcagagacccatatgaagtgaaggagccagccacatgaatatctagtaaaagagcattcagaagggaaacagctttagacattgttggaaatatatatggttaattatatatgttaaacatgtaaaggtggccactaaaaataatagagatgccatctgtagcttccatcctgaaaaaggaaataaaattcaagccaacaaaaagcaggaataaaagaggagaagacaccaaaaacataaaatagaaatttaaaaagaaatccttatagaaaatacaaaatagcgtagctggaataattccaaatgtatcagaaaccacaataaacataagtggactaaacttcattaagaaagacaaagattatcagattttttaaaagaaactaaatccaactacccttcttagccatgtcaatcaatgtcatgacaatagtatatcaaagcagtgtacttccgtggactaattgttctgcatggttatgaaaaattaatgttgaagtttttaaaatgtgatttttgattgtcattttgcttgttcttctgcttagccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaaggtaaggttggctaattgcatttcagaggtagtaggctttcatattctttgcagaatcttgcaaggtggcagcaccttatggactggtcctctgtaagccaagagcttcccagactgaggggttactggtatctctggctcaagcttcccagactcctaagggatatgtgtagagcagactttcaggacaaagtctgcacagtgacagcagacctttccctccctgaagggcagctgcaggggaaggcacagttgagtcagagttagctaagggaacttggagctggctgaattaggtgatcagcaaattgacaactgtcccatgacatcaacccctgtgtcccacacacaccgcaaatcagggacgtccgtggtcaagacagccccttgttgctctattcttcaggggacaatttctttaaaaacatgggcttggagtcaaaagatctgatcggaatatcacccgtgccaccatgtgccattggtcactttcttgaccccagcctcctcaagtctgcaaaatgggcataataacttactttattaataaaacaaggataataacctacttcgtaagattgttggggaatttaatgaaataatagaaaatataaactcatcccattgcctggaatgatgtatatatggtcagtacatcagtacatgaggtttccttcctctttgctagacatgttaaggttatttttattcatccttggtcaaggtttattctgacacctaatgcttctgagctgaatgccattcatggtcctaaactgacatatatatgttatgtatgtcatattacatatatgttatcccttccacattaaatgttgattttaccacttaattctcaaagtgtttgggaagaagggatcacccatgtttattatcttaggaatgatgtagttaaatttatatacacacactgcatagcccaaaaaatctcaagttaatttttttccccaaaaaatgttccattaaatgatgcagtgtcttagtcctttcctgctgccacaacaaaataccacagactaggtaacttataaacactagaaatttatttctcacagttctgcaggctgggaagtccaagatcaaggcaccagcagattcagtgtctggtgagcactggcgtgctctgcctcctagatggtggaaggcaaagggcaaggatgtaaacagctcccttgctgctcttttctaaggtcaccaatggcattcaggaaggctctgccctcattatttaatcacttctgaaaacctccacctctgagtcctatcatagtgacagttaagtttcagcatatgaattctgatactcacaatcactgatcaaatgcaggcatctctgctaagccctggggtataaagataagagcagattgctcccctccgggagctagcaacagacctcaattaaggatctagttttacagtgagcagggtcaggtgcctcctgaggcaagtgtgaatgcaaactccacttactgtttagcttcttttctcacacatgcccacaacatgggcatctggttacacatttgtcctctctcttcggccagttgtgtggcaaccttctgtgtgacttaccgagtgtggaaaggctgcctgctgcactgctcctctcacaggtgcctgtgatgccaccaatacaggttttttgggggtttttttgaggcagagtcacagtctgtcgttgcccaggctggaaagcagcggtgcgatctcagcttactgcaacctccgcctcctgggttcaagcaattctcctgcctcagcctcccaagtagctgtgattacaggcatctgccaccacaccccgctaatttttctatcaatacaggcttatatggttcccctctagaatgtagagattcctgaggcggtgccagactaggtccctaaactcacagcatgaagggcttttgagaattctttcttcctgttgggagaaagtgagaagataaaaccagaagttgcccagacgtgaaagggcagaaaaagccccagcagggattgagaaggtccctctactactatgccaccaccttacctgcttgcctctgagtttaatctttgaaaaaatttgcattgtaaggttttagaggcactggacttctggaactgcaagcccgccatttttttcagttgttgctttgatttgcttttggtcttttaatttacttattagaagttaaaccattttcttcatatattccataagtctaatccaattattgacctccatgggcttagctcctcatgcagtagaggcatataggcatgctgtcaacgaccccaaccccaaaaaagaactaaccaattgcgactgggtgtggtggctcacacctgtaatcccagcactttgagaggccaaggtgggcagatcacctgaggtcaggagttcaagacaagcctggccaacatggcaaaaccccgtctctacaaaaatacaaaaaaaaattagctgagtgtggtagtgtgcacctgtattctcagctactcgggaggctgaggcaggagaattgcttgagcctggcaacggaggttgcagtgagccatgatcgtgccactgcactccagcctggacgacaagagtgaaactccatctcaaaaaaaataataattaaaagaccagtttattttatttatttatttacttttttctttatttctgagacaaagtctcgctctgtcaccgaggctggagtgcagtgtggggtgatcctggctcactgcaacttccacctcccaagttcaagcgattctcgtgcgccaccacgcccggctaattttttgtatatttagtagagatggggttttgccatgttgactaggctggtctcaaactcctcagtcccccaaagtgctgtgattacaggcacgagccaacacacccggcctgctttatcttttttaaaaaagaagtgatggcttgtgtgtcatttaagctggagaattcaggaaccaaaatggtttgtgggcaccactgtcagtccttgatgcaccccctgagtggcctcagggtccctgaactgagaggagcacctgctacctgctccttcctattttaagtctaaaacggctattatcactgataaatgtgaaaaaaaaaaaggtggtgcccttccactgcttagtcatgttcttatttttgtctccattactagtttcaaattactccccagtatgactttgaggtcctcagaaacctggagccatggacaacttattgtgttcaagttcgagggtttcttcctgatcggaacaaagctggggaatggagtgagcctgtctgtgagcaaacaacccatgacggtaagccctgagatgcacctccgctaagcatcctaaacagctttatagacacctgccctagacatgattgcatccaactcaaattccagctcagttcagaaatctatcgccctgacattatctctcagccctgactgctcagcttcatgctaggaaggagaccacacccgcttctgaggcagctcattcactcttagatcaaaggagttgctagaaaccttttctgtctggtggagcgaggtctgcctccatgagccccccttggcagtacttattctaccatcccaggctccctaaagcaaggctcatcagtcctcccaagaccaccagcagagctcaagccctgtcacataccccaaaggtctttcctccccaggcggcacatctccagccactgccgacatgtgatgggaagcaagtgtcaggaaatctgaccacggtcctcagccagtgctgcctgattcagggccccttatatgcaggaatccaggatgtcaacacagtccttcacacaccatatggatcacttctagcttggaggaaggaacgggagaaggaaagagagaaggttcccatgggcctaaacactgcatatttatgtgcagacacattgcagttgcatgttggtgaaaactgaggcccaggtgtctgcatacaaacagcaggccttcctataatttaaagatgttggtgaagggttcagcaagctcagacaatggaaggatgaaacatggcatgcggcatgcagtttgatcaaaaagaaaaacatgtctgccggacgtggtggctcacgcctgtaatcctaacactttgagaggccgaggcgggcggatcacctgaggtcaggagtttgagaccagcctggccaaaatggcaaaaccctgtctctaccaaaaatgcaaaatttagccaggtgtggtggcgcacacctgtaatcccagctacttgggaggctgaggtgggagaatcgtttgaacccaggaggcagaggctgcagtgagctgaggtcatgccactgcactccagcctaagcaataagagtgagaccctgcctcaaaaaaaaaaaaaaaagaaaagaaaacatttcaaatagcttgcaaataccagtaatcacccatgaactgacaaaatccaaacattttacaaaacaaaagggtatgagccattgaaaacctgctttcatcaaacaccattttcattttttcttaaaacacacctatcccatttaaatcccacaagttttcaatgagagcattagaaggatcttctcccattttacaaactagaacatgaaggttcagagagtgatgcactttggatgttgccctcatccagatctcacgctgaaatgtaatccccagtgctggaggtggcgcctggtgggaggtgacgggatcatgggggcccatttctcatgaatggcttatcaccatccccttggtgctgtcctcccgagagtgagtgacttcctgagagacctggcggtttaaaagtatgtggcatcttgctctctcttgcccccacttagctttccaccatgattgggagcttctagaggcttccccagaaacagataccgctatgcttcctgtacagcctgcagattcatgagctaattcatcctcttttctttataaattacccagttttagttatttgtttatttgttttttggatggagtctcactctgttgcctaggctggagtgcagtggctcgatcttggcacaacctccgcctcctgggttcaagcaattctactgcctcagcctcctgaatagctgggattacagtgcccaccaccacacccagctaatttttttatttttagtagagagtggggtttcgccatattggccaggctggtctcgaactcctgacctcaagtgatccacccacctcagcctcccaaagtgctggggttacaggtatgagccaccatgcccagccatccagttttagttatttctttatagcagtgcaaaaacagcctaaaacagagaggttaagtaacttgcccaaatgctagtaaatgaaaaggatcaaccagaacacaggctcattcatctaagcccaggttatgtttcctgtaacttactacctatagattaattccataggtaaactgaggcaccgtgtccttgtggataaaacaggaaagagtagtctgcctcatggtgtggtcagatgaatctgaaacaagttagagaactttacacggaggatgtagattagtagattctcccacagttcacaacctatgcagagcagggtcctctctcctgccccctgtggaactctccatctggggtgagtaacaaaagcattccttgaatcatgtcaccatcacccagatgtgtccttgtttaagatgctaagatgccccagtttgagacaccaggagacccaagcactgccccagaggttcattacccaaaataaaataacagggcggggcccatggatccctgtttgaatgagtctccgggcgccaaattagagaactaccgaaatattaatggaaggatggatggatgagtaggagcctggaactttctcaagacctgggatgtcaaatcccaaggagacctcacgtgtccagctgtggtgtggactgggggccgctccagccagctcactgccgtatgaccctggaatcaccaagagcagactcacatgtttgagctgaacatgctggaagtgtgggccagacggcaccgcttctgggctccggtgcatgaaacaaacaagaaccaagaactgggataaggagtgctgaaacccgcaaggacaggagctggggagatgggaggccgcctgcgggaatgaaagcacaagagaacgagggccatggggttgggggcggcacaagtgctcaggtccttccagccgcttccctcatacagatgccacttccatccctcagacgtttaaggagtgtgcactgtgagccacgcactgtgacaagcaccatgtcgtgccagcaggtgactgcacttgctgtagctccagggtcatgtgctgtgtcagggctctttgatccctgtgtccctttaaaacgacatgatcttcatgggcagtgtttgttctcttggcccctctcagagccaaatgctgtgctcgtgagggcggtgctggttggcaggggatgggcacagagaaatcaggtggccagggcagctggaggagggacctggagccgaacaaggggagctgggaccacgagcaacccaggtgacatcctggactctgtcaaagataagcaaagcaggacgctaattaaagcagtcaaaacattttattcagtaatgactggagttgggaaaagggccgagttccatttactcagaggtgttttaaagggagaacgagggccggggcaggaggatcgcttgaacccaggagttcgagaccagcctggccaaaatagtgggacccccatctctataaaatattttaaaaattagctgggcatggtgacacatgcctgtcgtcccagctacccaggaggctgaggtgggaggatcacttgagtcctggaagtcaaggctgcagtgagctgtgtttgcactactgtactccagcctggacaacagaacaagactctatctcaaaaatgaaaataaataaaaggagaatgagggagtagaaagaaagaatgcgtggggagttgagcagaatcagggaagtgaaaaaaattttaaatcagctaaggggatgggtcagtgccgtgaggccctctgtgtctgtgaaccggtgtttatcaaggctaggcttctaccctcccacagagacagggagacagaggccctgtacttcctgatgatttcaaaagaatggctcgcagatcattgagaaaaatatccctgcgttgtgggagatacatacatgtctcaaagggacagaggaaggattcaccactataagccctttttaataaatgctctccgaaagagaggtcaaggcctcgcatcaggggctgggaagaacaaatggtaagttccttaggcagccttgggtttttccagacaggaattcaagggtgtggccttggcctgctagaagctatgctggggtttggccaagtctcttagtgcaggggtttgtttgttttggctttggttttggtttttgaggcggggtttcactctgtcgcccagtttggagtgcagtggtacaatcatagctcactatcacagcctcgacctcccaggctcaagcgaccctcccacctcagcctttcaaattgctgggactacaggtgtctgccatcatacccagctaatttttaaaaaattttttttgttgtagagaaggggtctcactatgttgcccagactggtctcaaactcctgggctcaagtgatcctcccacctcggcctcccaaagtgctggggttacaggtgtgagccaccacacctggcttagtgcaggggtttggatagagttgttcacgcagagtttctgtttttctcaatatagaacgagatggtgcctgtgtttaactcaggctcaggtgtccaggggagtatcacttgctgtgtcaaggcagaagtggtatatccagacctgggaggcccattgctacactgccagtagtaggtacagtggatcagaattcttgcttgttattcttttgatgtatgtcagcaataattccagaaaccaaactttggagaagataggaaaagggtgaaactcttcaaaaacctctgggtcctccaaccagttgctgtttctgagacgtcccccaagataaacgtacaggctctgttttcagggattgtgatggttaaaatgctcttgggatcactgtgacccgacctgtgacaagaatgtaacatgcccattacccctggcagaaacggtcccctcctggatggtggccgtcatcctcatggcctcggtcttcatggtctgcctggcactcctcggctgcttcgccttgctgtggtgcgtttacaagaagacaaagtacgccttctcccctaggaattctcttccacagcacctgaaagaggtaggtaggatggagtgagatgtggatttgaaaaccttgatcggaaagagctttcctttctagttagggctgcccaattccagacaacatgttttccaggaaaacacacacgcgcgcgcgcacacacacacacacacacacacagacacgcctcttgtgtgctggtccattctcttgtaaccatgtcaggtgaaggaacagccccgaggaaaggggcgcggggttgtccagtatccctctctgcacctagggcatcgctccttctccagccttcactgcccaaagccccaggtccctgaggagcaaaggtgatggttctagggcaggaggggaaaaacagagctcagtgtggaagaaagagaaaactggaggctaaatgccaggaaatcaccagagggagagaatgggaggaaagaaaggaacatttccagttttggaatatacgagagcgattgaaattctgggtagtgtttcctggactttaggaaggctatttgtaaaagggttaggaagaagaaacaatgcacctgactaatgataacaggactgaagaagccctaagaaatgaaactctggatagtcactgacactagagaatgaaaagattccaagcccggacccaaaggaactatctttggtctcatttcccaggaagcagactctaagatagagatttgtattcaaaaggcttgatggggaacatccttgggaataataccctaaaggagtgaaggtagccagatgtggcagagagaggttgagctgtcacacagccacaacagaggcctcagccaatcccatgtggcctctcgagctggggtggccctttagagatgtcctaagctgaggcaagagggatgggcgtgtgaactccacattggccatgcgctggatgtgggctactcccaggaaggggccctaagctagggtgagaggtgagacagcagcagccaggagctaggagcacgagtgcctcattcctgaaggcaccacagcctccattacagtcacccctgggaccacttggatctactggaagcagctcctccaggatctgagttgatctcgtttcctggggagggttacaggaggaagatgagtggaatgcactccagcccccaccgctgctgctggtgtcgggaccacaaaggaatgcttgtgggctggctccttcctccgctgccctgagggcccgctctcctctcccgggaggagcctgtgctgtaggggctgctgacctgattgggtgacccagccctcatcccagaaagcactgagcctccggtccccaagcccatctcaggcaatggcctgtccctgcacttgtcaatttgctgtcaaaatcgggcaggggagtcccaggaggtgcccagtgactctggcgggtacccactgtgatacagtggtgacttctctcttgcctgccagtctcttggcctgaggaggtggcttaaagtttatcgggccttgtttcatgtcccctggtagaaatgctcccactctgggaaccttctagaccaggtgtcagcaaactttttcttaaagggccaggtaaaaaatattttagaaggccaggcacagtggcttatgcctgtaagcctagcactttgggaggctgaagtgggtggatcacctaaggtcaggagatcgagaccatcctggctaacatggtgaaaccccgtctctactaaaaatacaaaaaattagccaggcgtggtggcgggcgcctgtagtcccagctcctcgggaggctgaggcaggagaatggcgtgaacccgggaggcggagctggcagtgagccaagatcgcgccactgcactctaacctgggcaacagagcgagactccgtctcaaaaaaaaaaaatacaaaaatacaaaaattaacccggcatgctggcgcatgcctgtaatcccagctactcgggagactgaggcaggagaatcgcttgaactcgggaggtggaagttgcagtgatccctcacaccactgcactccaccctgagcaacagagcgagactccatctcaaaatttaaaaaattttaaaatttatatatatatatttgaggttctgttggcaagaaataaaaatcaaaattatgtagtcacttatataaccacttaaatataatcatttaaaaatccgaaagccatgtgaaaaaacaagtggtaggccggatctgccccgtgggcctttgtttgctggccctgccctagacccacagagcctcaaatcacaaggccagggagcagcggtttccccagtaggtcactgggcatgatgagggtgaacagggccactcctgccctgcgcttgcttcctgacgcaggtgttccacctgctggggacacagccccacatgattgttggtcttgggtgcatgccaggggctggaggacaatgccttgccctcaccaggtgtcatctccaagctggcgcctcccctgcactttcaacaggccgctccgtccttcttccagtctggcagctgctgggtggtgcagggtgggatacgaccaggggggtcccgccttcactgtcagtgggcccattggtctggcaccatgtgatacggcgtctctactagtttgtcggggctgctgtagcaaagtagcactcgttgcgcagctgtaacaacgggaattgattctctcacggttctcgaggccagacgtccaaaatcaaggtgtcactaggatggtttccttggaggctgtgagggaggatctgtcccaggcctctaccctaacttctgagggttgctggcgatctttggcgttccttggcttctagaggcatcacccagtctctgccttgatcttcacaagccttctccctatgtgagtgtctgtgtccacattgcccctcctttatacagacaccagtcacgggaggagggctcaccctgctccactataccctcattctaacttaactgatcccctctgcagcaaccctatctccaaatacagtcacattctgaggtagagggattaggacatatgaatttcttttttttttggagacggagtctcactctgtcacccaggctggagtggagtggcatgatttcggctcagtgcaagctccgcctcctgggttcaagtgattctcctgcctcagcctcccaagtagctgggattacaggtgccctccaccacgcccggctaatttttgtgtttttagtagagacagggtttccccatgttggccaggctggtctcaaactcctgacctcaagtgatctgcccgccctggcctcccaaagtgctgggattacaggcgtgagccacagcgcctggcccagaacatgaattttgtaggaacagaattcaacacctaacaggatcctctaccaggagagaaaacacctgtgaaaccttgggaatcctgacaggccctgcaggacacgaacagcaaatcactcctaaactaaaggttagctccagccaggatgcaccactgccccttccagagtggtgcaagagtcgacgtcatcagcttgctaccaggtggctggtcagtctcctcggggaatgccgtcatatcaggggctcagcattgatctctgtcgcaggcaggttggacattccacagcagtggtggctacccagccgtgggagtgggagccccttctttcaggcccacgcgcagcctccatccctgccaccacggctgctgtgttcatgagccctgtgccatgtacaggtgaccagtggcagaggctggctgacatccactggctgtgtcatcatgtctccctggctgtctgctgtctatgatacatgctctcagtgggagttaatatgggatgcagaaatctccacgctccagctactccctcaggtccatccttcttcccaaacgtccttgtccctaaccttccagtcttccttccccagggcccctgaccaccaggcttgtcactaacccctgcctgggatcccacagctggcctgatcttgggctgcttttctttccacataaaggtgatgatcagacccacggcccaaagctctgcccgtggggacactttctccctggttggggctgaagtgcagcagcgggccactttcggtgtgtgcccacataccatgctaaccttgccatgaaaccaggccggcctttcctcctacttctgctaggcataattacccatccccctttatggtcatcatgtgagcagacacagacacggtgcgacaggggtagaggggacaggagtccgagccacctgcatgtggccaacatgcaccctctgaccccatctcaggacctactgggtctcaggcctcatgatggtcacttctgggcagcaccatcacctcgcgtccctcgtcagaagctctgtctctgccgggaccccatagcgtcccaggagctgctttttcaaacagagtacaattatctgctgcagatggccccgcctgaccccagaactctcgtatctatgttgtgactttcctcttgggatttgccataaactccacccagcatcttttcccaccccagacacttcaaggatatgcgaagtcacacattccccaggttggattcacaggccgtccctggtgggtaatgtaccagtcctgaggtgtgcatagggctgcaggctgcacggcccataccttctgcagggccctttcctgcctggggcccctccgtgccagcagcctcctgtgtggtttgataaacatattggaacagtcagtattcctaggcgtggaacatgctgcctccagaaccctgaggcctccacagcacaatgcttccttcctagtggtgggaggggcaagatacaataattggtcctttaaagaggatgtcctggcatgccccactgcaagggtcccctcaaatatcacagatgtggcaggtccctgaatctctacagggtgagtttctcaccctctgcagtgtgtgtgcctcaccaatgccttgccacttcttggcgtgtctggtcctattaatgtattgttgtgatagctaatatcaggcccttgtccccgcaccaccagtcagctgatgcaggctgcctctggcaagggcacagagccttgaccgaggcaactgccttctgggaagggcacagcctagaaagggactcagctgtgagccatttcagcctccgatattcctggaggctgggggaacaagcgcctcctccacaaaagggatctgggcaacatagcactgcatctaccctcgatggcaagtggggcacaggaccataggcaagtgtttcagagcgactagaaccccctacagagagtgccaggccgagcatggtggctcacacctataatcccagcactttgggaagccaaggctggcagatcacttgaggtctgaagttcgagaccagcctggccaacatggtgaaaccctgtctctactaaaaatacaaaaattagccacgcctgtaatcccagctactcaggaggctgaggcacaagaatctcttgaacccgggaggctgaggttgcagtgagcagagatcgcgccaccgcactccagcctgggcgacagagtgagactcgatctcaaaaaaaaaaaaaaagtaccaaggagactgcagcaccagcatgaactaagaatcctctatgagcttttgagaagccacagctgcagcaggaagaacaaagaatgagggtgggccctttgcttgggtaaaaggtgttgtgttaactgagaaccaaaaggaaacaaaattattcacctgctatttttgcttctggcttcaccatcagagaaactggtcagacaggaaagaacagacggaatgaacggtagaggggcctgctggcataagctctcacctccgaggctagaagactttgcagacttgaccgtggagccagcccctgtaagatctgagaaatcagagatgggagtggagggtgctggagaagggccaggcaactacggagcagttcgaggtcctcacatcacgactttctccagcttgactcataatgatagaatccattaaccaggatccagaggatcatttcgagttcagggagatttgctaggaatggagactttgagttaaaaaagcactagggaggttcatcctacactgatctattgagccagccaccagtttgtgtgtgtgtgtgtgtgtgcgtgtgtgtgtgtgtgtgtccaaccgggagactcagctgatactgcttccttgagatttaatacaccttcctttgatctctcctgtccccattatcccaggaaaatccagagtagcttccagtccattctcattaatccactggatccaaagtttagagaggttccccttccctccagcctccttcctggcccaacagaggagcaccccaccaccctccatcagctgctcaaaacccacaagggaaaaatccctacaggtccatgccaggaggtagtggagctaccctcaggttccattaagtcataccagaaggctgagtgtagaaatgacattaagaggggttccatctgtagggaaagggttcaagatgcaaagctttacagaaggttctccgtctaattgtgaagattaagagcactggtggacctaggaagatgaagaatggagagtgggaaaccagcagagatttcaggaaatgtataggggcatcttcatcgttcaaagcaccggagagacaaagattattagactgtggtccctgcccttaaggagccctggctacaggtgacacaaactgagaagagttggtgtctattaaaagtgagaaggcagctctgtctgatagagcatattgcaagccatgtgtgttttagatttgctagtagccacatttttaaaaagtccaaagattgggccgggtgcggtggctcacgcctgtaatcccagcattttgggaggccaaggtgggcagatcacgaggtcaggagatcgagaccatcctagctaacgctgtgaaaccctgtctctactaaaaatattagccaggcaaggtggtgggcgcctatagtcccagctactcgggaggctgaggcaggggagtggcgtgaacccgagaggtggaggttccagtgagctgagatcgcaccactgcactccagcctgggtgacagagcaagactccgtctgaaaaaaaaaaaaaaaaaaaaagtccaaagattggccgggcatggtggctcacacctgtaatcctgacactttgggaggctgagacaggttgatcacctgagatcaggagttcaagaccagcctggccagcgtggtgaaaccccatctctactaaaaatacaaaaattagccaggcatggtggcgggcacctgtagtcccagctactcaggaggctgagggaggagaatctctggaacctgggaggcaaaggttgcagtgagccaaaactgtgccactgcactccagcccagacgacagagcgagactccatctcaaaaaaaaaaaaaaaaaaatcttcgtttgtatagcagtgagtatccccacttgtaaaaaaataaaataaaaataaataataaatcaaaagatgccagaggccgtggctcacgcctgtaatcccagcactttgggaggccaaggtgggtggatcagctgaggtcaggagttcaagaccagcctggccaacatggtgaaatcccatctgtactaaaaatacaaaaattagctggcgtggtagcacatgcctgtaatctcagctacttgggaggctgaggcaggagaattgcttgaacctgagaggtggaggttgcagtgagctgagatcgtgccactgcactccagcctgggtgacagagcaagactctgtctcaaaaaaataaaataaacattaaaaataaataaataaaataaaatagattttccagccaggagttctgtgaaaaaatctttgtaaacccagaaaaagaaatggagaaaattgatcattaactgtcctctttccctccacagtttttgggccatcctcatcataacacacttctgtttttctcctttccattgtcggatgagaatgatgtttttgacaagctaagtgtcattgcagaagactctgagagcggcaagcagaatcctggtgacagctgcagcctcgggaccccgcctgggcaggggccccaaagctaggctctgagaaggaaacacactcggctgggcacagtgacgtactccatctcacatctgcctcagtgagggatcagggcagcaaacaagggccaagaccatctgagccagccccacatctagaactcccagaccctggacttagccaccagagagctacattttaaaggctgtcttggcaaaaatactccatttgggaactcactgccttataaaggctttcatgatgttttcagaagttggccactgagagtgtaattttcagccttttatatcactaaaataagatcatgttttaattgtgagaaacagggccgagcacagtggctcacgcctgtaataccagcaccttagaggtcgaggcaggcggatcacttgaggtcaggagttcaagaccagcctggccaatatggtgaaacccagtctctactaaaaatacaaaaattagctaggcatgatggcgcatgcctataatcccagctactcgagtgcctgaggcaggagaattgcatgaacccgggaggaggaggaggaggttgcagtgagccgagatagcggcactgcactccagcctgggtgacaaagtgagactccatctcaaaaaaaaaaaaaaaaaaaattgtgagaaacagaaatacttaaaatgaggaataagaatggagatgttacatctggtagatgtaacattctaccagattatggatggactgatctgaaaatcgacctcaactcaagggtggtcagctcaatgctacacagagcacggacttttggattctttgcagtactttgaatttatttttctacctatatatgttttatatgctgctggtgctccattaaagttttactctgtgttgcactatatgtgttcatgata

SEQ ID NO: 1788 - DNA, 15691 bp, Homo sapiens
gattacaaagaagagtttttattagttcagcctcagaatgcaaaaataaataaataaataaacaaacaggaaacaaatgtaatcactttacagagcgcacatacattacttaaaagtagcaccttcatggagccatattttctggtcataattgtgtatcaggttcattcatgctaatgagaaagggattccagattttctttgcatctgtctgcttctcacagggctgttaagaagccacctgccattctgacaatttcatgtccttagccataactacttgtcctctctcttgaatcttaagatctttttgccttccagacacttacggtgtttctgtgtcatcctcctgtgtcttttagagaggtgggggtgaggactgccatggaagctaaagctgaattttaatttcaatcatttttttttttgagacagggtctcattctgtcacctaggctggtatgcagtggcacaatcacggctcaccatagccttgacctcctgggctcaagagatcctcctgcctcatcctcctgaacagctgggaccacaagcatgagccaccacgcctggctaattttaaattttttttgtagagacggggtcttgttatgtttcccaggctggtcaatcatttttttctagcccttttaaaattcaggcatccaaagattaaacttgcttagaagtgtaagtggccctaaattgctttatcaacaccatctccaggaagtcttcacagacatgggaactagcatcttgttctcctggatcttctcaacaggtttgcattgtcaggtttccatgtaagtatctcttgcgttcccatccatcacaagtgtatgatggcactggtatcagaacactgcattcttcctgattgtcataaaactgatgtacttgcagccttgcttgaaaagttgtcagtacaaataaaattaaattcacattttgcataatagggactgatcctgatggatcaggtcataagagtatgaaacattccatacatcctggcagacaaacgttaaataacagtaatatactaataaatacataaattacttaaatatttaaatagcatgaaggcccatggcaacttgagagctggaaaatctatacataaattagctgattgtttcaatgagcatttagcatctaactatacaaatacagcaaagatatcattgtgatcctaaaaaaacgttttaaagcaaatcagatagaaattatctttttgggtctattccgttgtgtctttaaacattttgcttaatatcttccacttttcctccaaattttcatcctggatcagaacctggaagagaatgccaaaagttgatgtggggtgacattgtaacagcaatgtctcttcttatttctcacaacatatgatcctgggcaactgggtttcagggatttcatgccagaaggcccaggccttccttatgtggcctggaatttggctggcaccatgcttgccagaggctttcttgagggttttcttaaaataatatctgattgtgttacttccttgctgaaaacccttcagtgggtttcagggcccggggcccccagaacaagattctgagtcctgcaagcttgcaagtcctccatgctctgcctcctggctacctctctcttttctttgcctttctctttaggaggccagaaccccggtctgttttctttcctgcaatatccctgtggccagcacagtgtcctacataacaaaggcaccaaataaatatctgttagtgaataaatgtatgtttctgattctggcaactgggtgctggccactccatccccctttcctctccaacacagcccccaatcatatccctgcatccaggtgcactgagagtgcaggcctgggctggcctttgagggcctgctcacctaactgcagggcacagatgcccattcgctccaagatgagctatagtagcggtcctgggcccgcacgctaatgctggcatttttgcggcagatgaccgtggctgaggtcttgtccgtgaagactctatctttctgcaaaagagaaggaaagctgtgaagaccccttggcaacatagtcacagggtaagctgagcctgtttctgcaatgcatactctcccaaaacaagcccatcttggtcttagggcactgtgcttgcaattcacaggggtgtgcatagaacttgcaccacctactggcagacactccacatgtaggtgcagcttttgtactttgtaagcccttgagggagaaatcgtttggcccagctttcatctttctagcacaattgccttgcctcaagaccccatggccactcacccagtcctgagctgatggtgagagagagacagatttgctctagccatccctgagatattgagaaataccatatcctgatcatttcatcagaaaacttgccttcaaattctggcactgctacttaatagctgtgtaacttcaggaaaatgtcttaggttctctgtgtctgtttcctcacttataaatagggataacaataatgcctacttcatagaattatagttcaaggtaaaaatcacgtcaaactcttagcaagtctttagcacataggaagcactcaatatcacctattagtcatacagatcttaaatagggaaagtacttgccaagatgtaaaataatatttaggtaaatatctattccaggatagcctccctacctaattattttcccagagagtaactagctcactgaatttctaccacatgctaaatgctatgctgaattagggctttgtccagtgattttaaaagtggggtgaaaggagtctggggcggtacaaaagggcctctggaaccttgcaacaggcaaaggaattctgctgtaaggtgaggaagctgggaagccaatatcttagcctctataagtgtagacattctgtttagtaaaataattttataatatctggaacagccaggagctatccattttgggggcgatatctcttgcctgttctatcattcattacatgcactcagttgaaacaacaattttaggcttctggagcccaggtctcctctatcaggactaattctgagtgccaagatcaatgaccaacatcagaggtagtggagtggttaggtgcatggcctttctgtctggcagattgagtttatgtcttggttatgtcatttcctagctgggtgaccttggtaaagtcacttaacctctctgagtcttcaatcacttgtgaaatgatgataatactactggctaccaaccatccttttcttggggttgggctactgtccaatgagcacgtagtgagggcagtgctgctaacacctacacaaaattcctgcatcagctacagctttactttaccttgccacagtttctggaaaaaaggaaagcctcttttccacaaaaaagggggtaaaaaaacaagaataacatcagctacctttgttgcgttaattttgtagattaagtgaaataaacatggaaaacccttggcacagctctagacacatagaaaagtgctaagaaaagtaattatgcatcacataataacatttcagtcaaagaaggatcacatatatgaccagtggtcctatattgttataatattgtatttttgctatatcttttctgtttagatatacaaaccattgtgttgtaattgcctacagtattcagtacaggaacatgctgtacaggtttgcagcctaggagcaataggctataccataaagcctagaagcgtagtaggctataccatctaggtttgtgtgggtacaccatatatgtttgcacaatgatatagctgcctaaagatgaatttctcagaatgtatccctgttgttaagtgatacatggatgtcattgttattatcatcattcatcttctcactttatggtgggcctccgtaaaactgaccaaggaatatactgcacctgaatcacttcttaccttttctctcttgctcttgccctggacctgaacgcagaatgtcagggagaagtaggaatgtggagtactccaggtgtcagggtactcccagctgacctccacctgccgagaattctttaatggcttcagctgcaagttcttgggtgggtcaggtttgactgtggaagaggataaacatgctttattttcctaataaggctttggagttcagtggttttggcttatgatctcacttgcacctttgatcagctgtgagtccactggatagttacttaacttctgtgagcacctggctggcaaatgtgaggcacctctgccgcaggtgctcacgctggtgcctcgggaaggcagtcattatcaatggccacatctcagatccacatgtattgcaggatctgagagatgctcagaatcctcatcactgaacaatcagatgggaccgcacagtgagaagacctctgctttaatggttatgggccatgcattgaaggaccaccctgtctgtgctaatccctcactttgcactgaacatggaactaagctgagcctctccctggggatgagatgatagattttctatttactgccctttcttttgtcttttcatagcttttggtgcggacatgtcttggagcagttacagtcaattgtctctatgctcaatttgcttgtttattccatgaatactgagcgcccattatgttccagccactggactgtgcatgaaggatacagcagtgagtttcacaaagactccttcctcaattaggtcttctagataagaggaggcagagacatgctagggtgtgtggttgggctctgtaggcctggcactgctccacacaaagatcacggctcctagcaggtgcttcgcacatatgcttccctctgctcttaacacaactgacatctttccttttggtgtcagctaaatgtcacctcctcagagaggccttccttggccaccctatgtgaactagaccccacccaccaagtacaaaccctccataagttttgaagcaagttctctggttctattacactttatcatgctgcctggtcaatgaataaatagtaaaggaaatgacttatggtgaaatccctatctgccaattaaaaaaaaagatgtccattttggaagggtttatattctaagaaagaagtcccttttcaaatgctaaggaaggattggttgggaataattgccattagtaaggaagccctggttctgaatatgaatattatgcttgattaggctctgggattcatcatggaaactatctggcagctgaatcaaagtgcagtaaagagcagctgtagtggagtggatctggatttgaacggctagctgtaagatctgagatctggggcaagttgcttaacttttctaagactcaatttcctcttccttaaaatgcagataacagtatctacatcgtattttgtttttggatgcagaataaaagagatgatgcttgtcaaccacctaccccacagtgcatggggcattgtgaacacgtgacaaatagtatctttccttatggagcacatataatcatccaaaactcactgatgtccctgatgaagaagctgctggtgtagttttcatacttgagcttgtgaacggcatccaccatgacctcaatgggcagactctcctcagcagctgggcaggcactgtcctcctggcactccactgagtactcatactccttgttgtcccctctgactctctctgcagagagtgtagcagctccgcacgtcaccccttgggggtcagaagagctgaagtcaaagacagaaattagcctgtgttacacattggggagagagttcctagtgattgtagccagtaaggcaggtaaggcctcaactgttgtctgaggacacagtttctccaactgggctgatttctacccagagggtaagaaactgccctccccaggagaaaaagcttaaattcaagagcacttacatgtctctggactaaatgaatatggaagtttttgtttgttttagatctagaatctctgattattaaacccccttgttaaaaacttaaattcattttttcccattttaattataaaatcaatacacaaatcagtacacactaattataaaagtaaagatgataaagatccatataaaggaaagaagtgtatgtctccttcatccttaactgctctccacaggtttaagtactaataatagcttgttgtatccttccagaccttcctttttctttttctttctctctctctctctctttttttttttaagagacagggttttgctctgccacccaggctggagtgaagtggtggaatcagaccccactgtagcctcaaactcctaggctcaagtgatcccctccctctgcctcccaagtagctgggactacaggtgtgtgccaccacacccacctaatttttttatttttaatattttctgagatggggtctcactgtgttgcctaggctggtcttgaactcctggcctcaagcaatcattctgtctcagcctcccaaagagttaggatttcaggtgtgagccactgtgcctggccagaactttttcaatgaatattcaagataattgtatacacattttatatatatatatatatatacacacacacacacacacacatatgtatacacacattatatatataatccatgttatatacatctctacattatatatatccactatatatattttacttatacatatagattttatttttatgaactaggatcaaattgtatacatatgattatgtaaccatccttttcccctctgaacatattatggggagctctccatgacaaaacatatgggttgggttatccacttcaatgactgcacattaagcaagagtatagtgtaccatgttttatttaaccattcctctgctgattatgtctttatgcacttggagaaacatttctttagtaagcattttccttttaaagatgaaaaagtgagaccccaatgcttaatttactcagtgaaataatggtaaagtcaggatgatcacctggggtttgcttcggtgatgattaaagtaagccacatgggggttaacacataggtcttgtatttatggaagttgctttcttacggaaagtccaggtgcattggaccaacagcgaacttcagattagtggtgtcagcagaagtaaaaggagttgaggtggccctgggaaaatttcgggaggcctcatcgagttttggagtctgcttcagggcccctaagatctacgccctggagctcttgtttttatttttgactcaaggtgcaatttcagcaagtcatttgtagctttgaattctccgtttatccctttctttggtgctatgaggcttcaggaagcatggccaggcaatttggatgagtgggttcaaacacagcagagactattctcagttcccaataatatcctgccccaacacatacatttattcaagcaatcggctaaaatctccatgttctttcttcaatgtagacaaggaagggcggttgaaaaaacacgggtttgactttgcttttcccattatcattaactgataggtcactgagaggttgcccttaatttcttaatgaaatagttctagaaaaatgctgagaaaccagagcagtttcactcaccctctgctgcttttgacactgaatgtcaaatcagtactgattgtcgtcagccaccagcaggtgaaacgtccagaataattcttggcctcgcatcttagaaaggtcttatttttgggttctggatttgaaaaaaacaaaaattcaatatttaggagttttttgcagaaaggttttgattgtgatgaatcacagatcaccagatggtacagggtgaagttcttccatgcgttgcctcttgggtagctccataaggattgggagtatcccagtggggtgttgattctgcagagtacactacacacctaacatgcctggcagaggcattcattttttgaaggctatcaccccagtgcagagtgatacactatcggttaatttccattagccattaaataatatcaccattatttaaagaaaacatgaggctaagcattcagactgatcatgaaactcccttaatatgagattttgatggttgataacccaaagggtccaggaaagcaaaggaaaatggaggttaacatcaattaacatcaataagagacttgatgttaattcattacactcaccatgacttggcttttcaatttgttgttgttgttgtttttaactcttatgagcgaaagagaaaattgatactatccaagggtatagaattacctttctggtcctttaaaatatcagtggaccaaattccatcttcctttttgtgaagcagcaggagcgaatggcttagaacctcgcctcctttgtgacaggtgtactggccagcatctccaaactctttgacttggatggtcagggttttgccagagcctaagacctcactgctctggtccaaggtccaggtgataccatcttcttcaggggtgtcacaggtgaggaccaccatttctccaggggcatccggataccaatccaattctacgacataaactggaatgcacataaagtggagaaccaggctgtaagctccaggaactctgggactgtgttttattaacccttcgggcatccccattgcctaaacacaaccttgtttacaacaagtatttggcaaatgcttgctgagatgatctcaaggcatgagaccctgcttgggctcaaggtcatggaaaagagaaacaaagagttttatagctgccatcgactcattgactggaaggctgcctttaatagtaacctttgattatttagcagattggaaacaccttaatataccaaaaactgcaaacagcacaagactctttgccaaaggtctgggggagagaaacttccagcacaatttcagtttcatagagaatacggcagggcacaatattcagcagagtaacatagtggttaaaagctcagggtgtcgagaacaacgaaccaagactgtcatcctgtctccactaaccagctgggggatttggaacaaggtatttcattatcatgagcctcagtttcctcatctgtaaaatgataataataacagtatctgccttacatttgactgaggattaaatgaaaaaaaaaaaaagcacgtaaagtacttagcacagtgtctgccacacagtaaattcggtgttagttatcgttacttatagactgaggagtcagccaactgtacagagaaactctcttaacaattttccatggatatttaaggatttcgttccctctgttttaaatcaccagtggagattttcattctctctgcattattattattattattattatttttagctatcttacactcttatgaagcagtccagtagagcttagtcttcccatttaatgaagaagcgtactgaggccaacgatctaagcatggtcacagcaagtcagaagtacaagggctacagctcagaccttttgtctcttgggctttgcaagggatgcctaatgctagtgtctaaactggcctttgaggaatggcttagtatagtatttcagagtgtgtcatagcaaagcttcattcatttttttaatccatgcataaattattaattgaatagaattgtttaatgtagtagttcccaaagcatgatcgatgaaacaccatcagcagcatcaccttggaatagatcagaaatgcaaattctcagctgctgaatcagaaaccttgggatggatttagttatatggttcttaagctctccagatggtgctgatgcctgctcaagtttatgagtcacagtggttgagagcctgcattttggagtggcagaggcctggatttagaagcagctctagcccttgctccagtcttgtggcctttggcaagacattcaactactgtaagcctcagtgtcatcatctttaaaatgagaaaaatattagcccttgctttagaaggtggatatgtggattatataagctcatacacagtgcccttacatgctttataaatggtggttctcgttattggcctctggatgtaaagcattgtagaatataaagttttcactttacatcaattggattataaggactgaatggataacaaaaataagaggtcaaaagcatttggggtccaactctggggaaatgattagctgtgctgatgtaaaaccatgtggcacttttggctttttcttggttttttttttgtccccctgacacctgaagagcatggttactttcctgtcccaactgaggctcggaagccctagaagatgtttgctcaacagcagggaaaacagctgcaggaggaaagctgaagaggagcatcaagaacctggcacttagcctcactgcatcgtctgccctcctaagtcacacctcggagagtttctcacactgattttctggaatttctgtggtttaccaaatcagaagtcactaaggggtcaaatatgccaggaccaaggttcctgagctcgctaacaatcccagggttggaagggatctgccatatacccctggctcaggcctttgcctttacttaagagagtgtctaaatctctcaaattctcatggagaaggggtggctggattctgtcttcctaaaattcttgagaagagaggagtggtcccagatttctttcaggtacccatttcaagatggtactttctagaatatcaaaagattatttctgatcatcagctgaaatattttcatccttaatttatgtccatttcctcttattcagctctccaaagacctgggaaaaaattacttcatgtccttgtaaaaacgttttcacaaatttaagtgcaccagctttgaagcaagacagaattgggatcaagtccctgttccacccttaccaggtatgtgacattgggcaagttacttaatctctctggcctcagtttccaacatctgtaaaatgggatacagacagtctctacttcatatggctcttgtgagaattaagtgagacagtgcactcaataaacattaactattattattatacaattaaagatagtaatcgccaacattatgatgttggcttcagtgataaaaatctgagggtctttcaggtacagccaacggtcagaatgcacatttactgagtgtgagatactagaaggatgggcagaactccttattttaccattaactattctattagtctactaataatttttactgatcattgggataataaaaagtatctcttgaatcatgaaagatattttaaacaaccaaaatagtaatactagctgacatttactttcactttactatctgtcgagttgtattctgcattcattaacccactaaataacccacgtggtaggcatccactttgtaacatccagtttacagttgaggaaattcaggattagaggtgacccagcttaaagtcacataaccagtcattgacagacctaggacttgaacccaagtcaatgtgagtctgaatcctatgcttcctccaaagtgcttggtcagaggtaagtcatcacagtgccaactgagggggcagtatcatgtggtggaatgagaaacgaacacagttgttatactttgcaaatcctctactttggaattttaattgtgtgaaacagtttttagtaatattggaaaatatcatatgtcatatgtctttccccaccatatcatatatcatatgtctttccccaccatagtgtaccaatgtcatccaatgtgaaaaccaaacaatatagataccatcaaagtagaaaagagagatatggcattgcattttcccagagtgatggctttctctagaggacccagtgcatggttgcccatttcagtttgatttcccaccagtggctgcccaagagtcctggcttagaagtggggcctccacagagaataatgagaggctggttaccatctttcttcagttcccatatggccacgaggggagatgccagaaaaaccagggaaaaccaagagatgaccaactgctggtgacacatctataagaagggagagaagcagggggaagagaaggaggaaaagagaaggaagaggaagaaaaaagagaagaaagaatgtcaataattcttgttacctttgtgaaccatatacacattctagctactttttttttaaataaaatcttgattctcccctttcttctccatactgtcaagcaaatactaagtaaattacaggagttctatggcagtctgtggggaagaacatctctaaatagagaaccatagggtatttggggctctggagctgaaagagacctaaggcaagccatctgatacaatcctcttatttttaagatgagaaacttaaagcttagagaaggaatgtgactttctggatcaacatctagcagttgtttatttagtgcttactacataaagagcactgggctagaagcagttgagagagaaaaaaagggcttacctggatcccgcttcctaggagcaaatacttttactcaataaatatttattaagtcagtgtgttaaatgcctccccgccagctggggagatgagccatacatttgtatcactgcagcacaaagcagtgtgtgctggagcacccagaactgaaggacttgggttagggacaggaacggtaatacagaggcgaactttcaggttctggcaacgacctggtcaccagcccttgctgtaggggtttagcttctcttgttttccaagttcaaagactactctctcccatatagagaacctagtggttctaaaatttgagtgactgtcaggataacctggaagcactgctacaacagacggctgagtcccacccccagagtgtctgattcagcaggcatgagggcctgagaatatgcatttctagaaagtttccaggggaagcagatgctgctggcgctaagaccacaccttgagaaccactggtttaacccatgttcagggtccagaacccctgaaaatcaaagtgttcattgggaaaagaccacaacatattgatatatccaccatgaaatagtaaaatgcataattttatgttaaataagccaccatctgatatagaaaccagtctaggttagtatccagggtttatgaaaatcttccgattgcaaaaattacatgccacttacgaatgaggtagggatgattattgaaacattctgaaacaactccattcaccttgcagagcacccatggtctggaggaaagtggttctgaaaccactgttttaaactatatgaagggcaatgctcaactgtttcagtcaaataccttaaaaatgagcattcctgggttgggtgacggaatattgacaaattacagctttgtcagaactgctactaactctaggcggaccttgctatgtactttattcccttataaagtttgtgagtggcagagacaggcctagaagtcaagccttcttggacactgctcagtgctgtcaccacagcatggagttttaggggcatggctatcacttcagtctaggttatgactgtagcaaagtactagctggcacagggcaccggttagtacattcacaggcttgaagttaaacagacacaggcttgaattttggtcccaccgctcatttgctgttgagcagtgggagcaacttgttggccaagttactcgctgagcctcagtctctttgtctataaaatggacctaatacttatctcaaaggcttgttgggaaaggcaatgagataacatattatagaaggcaaccaataacatattaacttgaacctagaggaagaggtaagggaacaattcggtatctgtgttttatatatcatggatagtcaagaaagtcattctaggcagtagggaaatgtgcacagaggtactgcaattacatgcgcctgtaaaacccagaggctggcacactggaagggaaatagtggagattcctggcatctcctggccacttacgctgaggtattcccactagctgtgtgcccagcacttcctctgcatgcctcagatgcatttgacaatctcaggtgaactgcacttcagggtcaagggaaccccggccatggttctaagaagcaactcccattttagtatcacctacatttgaaaccacagagcactgtccaggagaggtgatggtggtgggtctcctcctttggctctctggcccatcagctgatactagggagcgctatccctcagcccacatttctcagcatggtaagtctgagagtcttgatgattaaaacacatttttgtgtgtgcaatttcataggttttctaaactcttgaaacccttgcatgaaggacaaagggaccccacgttacacactcctacttcctggagtatgctaagggcttcccaacactggtgccaacatcagcatgccaatgacgcttgggtgggcatctcttttttaagttttgtttgttacctttaattagaaaagggagttattattaaagaataaaaagatatagtcacagatggcatgggtggcacatgcaaagatccctagtttgagggccaggcagacttctagaactgtgtgactctgggtgagtcacttggcccctttaagccccacactcctgatctataaaatgggcatgctactgtggtaaggagttagtgacataattcacgtgaagtgtcatggtgcctagatgaagtcaggacccactatttgctcccctccttccacagcatttactacaatggcaacaatacagtctcttctttactgtttgtcttctctgccacactgagtgaactctcttatgccatggatcatgtctatcttgttttgcactttacccccagagtccagcacagagggattccatgacttattagtagcatgaaggaatgtacggaaatcatacaatttcagattccagtaaactaaactctaagaggttacccacattccatctagtatcttgcaattccttgtttgaaaaagtgggtcatcacctggggtttagtaatccctttgttaaaatgacattgttgttgcacacaattttacctgggcaagtaaaaaaacctttttttcccccttctcacagatttaaaaactctttaggaagcaataatagcttttcattttttaactggggccaaagttagttaatccacaagaatggggatcccagctgtcattttggttgatatcacaactgacgaccaagaccatcacaaatatgggagcaagtctgatttgtaacattattataattatgaatccaattactttaaggaatgcacgaaaggctttttaaaaatttcaatagtaaggcaggcaccactcactttagctctatacaatcctttaactgatgggcattaacatttaggaatatacttttatacatcaatacacaccacttcaaaataagataaaacaaacatttccacaaactatgcatacacacagatcttgctatacagttattattaggtggcttttaaaatggacactgtacatcggtccctagagtactaagttttcactaatgttccagcagatgactcaccagggatgcttccaggaatccaccaactccctcctgccagctgctggggtagcacactaacggtttctacacctggacagctgcaggcccacagggaggggagggaggtaggggcttgggaagtgcttaccttgctctgggcaggacggagagtccaatggccctgaaacag

SEQ ID NO: 1789 - DNA, 27327 bp, Homo sapiens
gctacgtagcctcgggcgagtcactcaccctctctgagcctcaacgatcacatctgtaaagtacaacagtcatggttcctttcagggggtggttgtagggatttggtagggaatcatgtgagtggatggaatgggctgggtatgccataagtgcttaataaccagccgttgtgattgagatagtcgctcttcgtgtctgtaagacaaagtggatgttttcgtttctccctcaggcctccaggccctgatatcccaggagcgatggatgtctagcccccccaccccccgggcagggttgcacccctgaccgtctggcccactgggccccaggaccttggccttgcacctgtctccatcctccaaggacaactctgtatccagggccagctcaggggcaccctcaggtagctctgtcttctcgagaggctcagtcctctcgcctttgtcccaggacatctctaccaccagggcctcctgcagggatgcctcttcctggaagtccactgggttgatccactgccaagtctgcagagggagggtagggccacagctgtgagcagagctctacttcccatccacagcaggatggaacggaccaggtcactgctggttaaattctctaacatcctgagacctggacgggtgcagtggctcacacctgtcatcccagcactttgggaggctgaggcgggtggatcacttgaggtcagcagtttgagaccagcctggagaacatggccaaaccccatctctactaaaaatacaaaaattagctgagcttggttgcgcacgcctgtaatcccagctacttgggaggctgaagcaggagaatcgtttgaacccgggaatcagaggttgcagtgagccgagatggcgccactgcactccaggctgggtgacagagcgagactccatatatcctgagaccgatttgaggatggagtctgccgcactgactcccattcagcccctcttaggaagagcactcccatctgtctttgggaaatttccctccctcttttcacagatggtgtggttgacagtgcagtgaccccacctcagctctagcaatggtcatgtgaccctggccagcccacccatcagacccttccctacccctctggttctagccataggctcagggaagggcatgtgacccaagctggaccaatcagtgatggccctgagacttttgccccagttaatggggaaaatggacaccctgcttccaatcagagaaggctcagcctgcctgcggaagaaccctgaacgggcagctccgagatagaccccaatcgctggattcaggcatatctgaagcccattcccttgggattttttccatcaggtttcctttataataaagccactttgaattctgtttctagtgccaggaaatggacctctgcctgcctgtctttaaaatgggaaggggtatggagcactggttttggagtccttaccttgatgaattgggagagaataaaatgagctaatgcgtaacccttgtccagcatgtgcacccaataaaaagacttggaattagaaaaggcatccttacctccttccctccagggaactcaatggcggagctggcacagggtgtgggcagcggcgggcacaggtgccgtgcggccctggggaggaaaggggaccagtgagaggagctgaggttttttttttttttggagacggagtcttgctctgttgcccaggctggagtgcagtggcgcgatctcggctcactgcaacctctgcctcctgggttcaatcgattctcctgactcagcctcctgagtagctgagattacaaacgtgtgccaccacacccggctaatttttgtagttttggtagagagaggtttcgccatgttggccaggctggtgtccaactcctggcctaaagcgatctgcctgcctcagcctcccaaagtgctgggattacaggagtgagccaccgtgcccggcttgaaagcagctttcaatcagacatgcccaccagtgtcaccgcccctttccatgggaatgaccaaggacccaaaagttactatcccttccctagaaatttctgcataggatcacctgaggtcaggagttcaagaccagcctggccaacatggtgaaaccctatctctactgaaaatacaaaataaatagctgggtgtgatggcacgcacctgtagtcccagctacttgggaggctgagacaggagaatggcttgaacccgggagggggaggttgcaataagccaagatcgtgccactgcactctagcctgggtaacagagtaagactccatctcaaaaaagaaaaaaaaaagaaagaaattttgcataaactgccccccttaatctgcatgcaattaaaagtaagtataaatctgactgcaaaaccgctctcagcggctactctccgcctacagggaagccctgctctgcagaggcagtcacggagctataactgctgcttcaataaagctgttttcttctacctctggcttgcccttgaattatttcctgggcaaagccaaggacccaatctgcgggctaagctccactttagggctcccctgcccagcatcattaccatcgctatggtaacggtaagaggtgtcagttacctgttcaggccaaggtagccaaggacgcccacgagaaggatgctcaggaagctccccagggaggcgaagaagatgagccaatcagaaacctgcacttctgaggtgggagagcgtgggttggcagagggctacctcctgcctcttcctcagggaaggagctaggagggcctggtttctccatgaacttgctgctgatcctggtgcacatgccacgggcttctcactgggagaccacagaacccacctgcccggtagctgtcaagaaataaaggcctggcatgcaggaagtgttcaagactctgtaattccaggccgggcacagtgactcatgactgttatcccagcactttgggaggccaacgtgggctgatcacctgaggtcaggagttcgagaccagcctgaccaatatgatgaaacctgtctctactaaaaacacaaaaattagctgggcgtggtggtgtgcgccggtaatcccagctacttgggagggtgagacagaagaatcgcttgaactcgggaggcggaggttgcagtgagccgagatcgcatcattgcattccagcctcggcaataagagggaaaatctgtctcaaaaagataaaaaaagactctgtaattccaggagcctgcacatagggcacatgtggctgcccctggacccaggcctgcctgccccccaccaaccctgactcttttgttctctgggttccagttggttctcttggaactgaaaggacaccgtggcatgaacagggatcatttgatctctgaatctcttataaccatgcacccgacaacagagcctgtgttgttctcttcctcctcctcctcctcctcctccctcttcttctattcctcttcctcttcttcttctttcttctccttcttcttcttctatttttttttttttttttttttttttttttttttttgagacagggtcttgctccgtcgcccaggccagagtgcagtggtgcagtcacggctcactgcaaccttgaactcctggtctcaagccatcctcccacctcagcctcctgagcagctgagactacaggtgtgcaccaccacaccccactattttaaaaatattttttgtagagatgaggtctcaccatgttgcccaggctggtcttgaactcctcggctcaagcaatcctccagcctcagcctcccaaagtgctgggattacaggtgtgagccaccacaccgggttttgcctgtgtcctccttatttttgcattcatttatttgtcgctcaatgaacagattcctgcatcttcctcctccccaagagcccccagataccttgacacatctaccccaaccccgcagtgtcagaccagggagaagggacagttgtaaacaagggcatggccagaaggaggcagagaagtcttgctggaggagggaacttttgagctgagttttgaaggacgaataggagttggaccgtgtggaaaacaaacattccaggcaggaggcagggaagggcctgcatgggcaaggctcctggagtgtgagaggaagctgcgagagaaggcaatgggagcagtttgagctgctactttctcctgagggcagtagggagccatagagggagtgagagtgagggcagggctgctaagatcattgtgggaagcgcagtgcagtgcatgctgggtaaataactgggtcctaccccctccactcaccgatgctgaagcgctggggctggctccagacacccctcagccacgctgtgtctgctcgcacctgcaccgtgtaggctacaccagcccgcaggccactgagggtaacttgggtctctgtgggctgcacgggatgctctgcagtgggagaggcaaccctgagtcctgggacctctttactcctcagaggccaggctgggctaccacagcctgtgggtggggtggggattcataggcattttgctaaaatctctactctttctttctttttttttttttttttttgagacggagtcttgctctgtcgcccaggctggagtgtagtggcgccatctcggctcactgcaagctctgcctcctgggttcacaccattctcctgcctcagcctcccgagtagctgagactacaggcgcccgccaccacgcccagctaattttttgtatttgtagtagagacggggtttcactgtgttagccaggatggtctcgatctcctgacctcgtgatctgcccacctcggcctcccaaagtgctgggattacaggtgtgagccaccaagcccaacctaaaatctcttctcttaatgcgcccattcatctcaagattttttttttttttgagatggagtctcactctgttgcccaggctggagtgcagtggcacaatctcagctcactgcaacctccacctcccaggttcaagcgattcttgtgcctcagcctcctgagtagccgggattacaggcgcccaccaccatagccagctaattttttgtatttttaatacacatgaggtttcaccatgttggccaggctggtcttgaactcctggcctcaagtgatccgcccgcctcagcctcccaaagtgctgggattacaggcgtgagccaccgcgtccggctgacttgttggatctttgggcaggtggatctgaggttggaggcaggattggactctggaggcagggcttggacacaggaccaaactgaggactagctaaagcaggtcctgggctttccataagacacgcccaccagtgtgccatgtcagtttaccattaccatggcaacacccggaaattaccgcccctgtccacggcaatgatcccacaacccggaagttactaccttcatcctagatatttctgcataaaccgccccttcatttgcatataattaaaagcgggtataaatatgagacgtagctgccctgcctgtggggcgtccccactctgcaaggagcaggacttctgctgctgctctacacggccacttcagtaaaagtttctgtctaacaccaccgacatgcacttgaactctttcctggggaaagccaaaaaccctcctggctaaaccctgttttgtgggctttcctgtccctcatcagatcccccctccaggccttagtttcctcatctgtggaatggagacagtcatccctgcttgatgagagttcagctgctgctacatgtgaggggcagcttcccatggatgaatccaatacaccataagcacttggctggtgcccacccagccttctccagggtctgcaaggggtgatcgagaccctcaagttcagctgggtgctcatgactaatcccagcactttgggaggccaaggtgggaggatagtttgaggccagaagtttgaaaccagcctgagcgaggccggacacggtggctcacacctgtaatcccagccctttgggaggccaaggcgggtgattcacctgaggtcaagagtttgagaccagcctggtcaacatggtgaaactccgtctctgctaaaaatacaaaaatttgccaggcatggtggtgggtgcctgtaatcccagctacttgggaggctgaggcaagagaattgcctgaacccgggaggcagaggttgcagtgagctgagatggcgccactgcactccagcctgggtgacagagacagactccctctcaaaaagaaaaaaaagaaaaaatcccagcctgggcaatatagcaaggcctcatttctacaaaaaataaaatattaactgtgcatggtggtgtgcacctgtgtttccagctactagggaggctgaggtgggaggatcgcttgagcccaggaggttgaggctgctgtgagctatgatggcaccactgcactccagcctgggcacagagtgagtccctgtctataaaattaaaaaaaaaaaaaaaaagaccctcaagtctaattctcttgtttttgttttttgtttgtttgttttcgtttttgttttttctgagacagagtctcactctgtcacccaggctggagtgcactggtacaatctcggctcactgcaatctccgcctcctgggttcaagcgattctcctgcctcagcctcccgtgtagctagaattacaggcatgtgccaccatgcccggctaattttgtatttttaggagagacggggtttctccaagtttgtcaggctggtcttgaactcctgacctcaggtgatccgcccgccttggcctcccaaagtgctgggattacaggcgtgagccactgcgcccagccaattctcttgttttaagggtttgataaccaaggcccagagaaggacggcaaggtgcccagggtcacacagcaagagagatcacaggccaggatcctcccttcctccccaagccaggtctgcactgcctcacgtacctgacacctgtttgctgtcttcatctcggcagcggacaacatactcctttaggacgccgggacaggtgctcagcagggatggtgcccagtccacagacacagagtccaagctatgattcttcaccgagacgtggtgcggtgtcccagctgctgaggctgcaaccagtaccattgtcatagtcaacaccaagaatgctggtcgaggcctggcacagtggctcgcacctgtaatcccagcactttgggaggccgaggtgggtaagtcatttgaggccaggagttcaagaccagcctggccaacatggcaaaaccccttctctactaaaaatacaaaaattagccaggcatggtggcggacacctgtaatcccagctactcaggaggctgaggcaggagaatcacttgagcccaggaggcagaggttgcagtgagccaagatggcaccactgcactccagcctgggcaacagagcaagaccctgtctttaaaaaaaaaaaaaagcccagccacgatggctcatgcctgcaatcccagcatattgggaggccaaggtgggtagatcacttaaggtcaggagttcgagactagcctgaggaacatggggaaaccctgtttctactaaaactacaaaaattagccaggcatgatggtgggcgcctgtaatcccagctactcggcaggctgaggcacgagaatcgcttgaacccgggatgcagaggtttcagtgagccaagatcgtgccactgcactccagcctgggccacagagagtgactctgtctcaagaaaaaaaaaaaaaaaaaaaaaaaaggagtgctggttgagcacttcctgaatgcccagcctcccactgtccagagacggaggtaacattggccacagagtcaggtgagctgggttttaattctggttctgccactcagtcactgtcatttcccttccctgggcctcagttttcttatctataaaatggacaatgctggccgggcgcagtggctcacacctgtaatcccggcactttgggaggccaaggcaggtggatcacgaggttaggcatttgagaccagcctggccaacatgctaaaaccctgtctctactaaagatacaaaaaattatccaggcatggtagtgcacacctataatcccagctactcaggaggctgaggaaggagaatggcttgaacccgggaggcagaggttgtatgattgcagtggtgcaatcatagctcactgcagcctcaaactcctgggatcaagtgatcttaccacctcagcctcctgagtagttgggactacaggcacatgccaccatggctggcaaacttttttctttctgtagagacggggtcttgctatgttgcccaggctgttcttgaactcctgggttcaagtgatccacaagcctcagcctcccaaagtgccaaagtgctgggattacaggggtgagccattctgtctgccttaacagcattgtccttttttttttttttttttttttttttgagacagagtcttgctctgtcacccagactggagtacagtggcatgatctcagctcactgcaacctccgcctcctgggttcaagcgattctcctgcctcagcctcccaagtatctggaattacaggcacccgccaccacacccggctaatttttgtatttttagtagagacagggtttcgccacattggccaggctggtttcaaactcctgacctcaggtgatccacccaccttggcctcccaaagtgctgggattacatgcgtgagtcactgtgcccagcctctatttttttaaattatttaaaaagaaaaaataatgtaaacctgcaggtttgggtcacttaccattgcccccaaagtggtaggtggacaggaccgtagaccacaaggtgagcttctcggggtgcgcagaggcaaagatggtaatgtagtaacacttttcctgccccattgccccagactctcgactccagctgtaggttgctggaaggataagcaaaggccaggccattcagtagattgtgttcccacctctgcacctttgcactggctgtgccatctgccaggaacccccagaaaactcctactcatgtttcaaagcccttgcaccaatatcccctcctccaagatctcttccctatgcaacacccccaaccccatccccatccccctctaacccagcccttactccatggaaccagggcttcttttttttttttttttgagatggagtctcgctgtgtcacccaggctggagtgcaatagcgcaatcttgactcactgcaatccctgcctcccgggttcaagcgattctcctgtctcagcctcctgagtagctgggatttacaggtgcacaccatcatgcctggctaatttttatatttttagtagagacagggtttctccatgttggccaggctggtctcgaactcctgacctctgttgatccacctgcctcagcctcccaaagtgctgggattacaggtgttagccaccttgcccggacaatggggtcaggggttccgtgtccagttctgtctcctcaggctgtgtattcttcaaggaacaggctgaggctgaggctttctggggctctggcaaggcccagagcaggaagcgggagagtgagaggccacctgagcctcacggcccccctttccctaaagactgctcattaatttgccaccagcatctcgcgaactgccaccttccctggcgcggttgaatatttaacaaacaccttgggatgtgagattcattacctgtatgtgtgtgatctgcctggaactgagctcaggatgccagcaagaggttccagacccatatgggtgagaggctccgaacctcaccctgtccctacctctgtatgacattgagtaagcagcaacacctctctgggccttagacacccgctgtgtgccttccctgcaggtttgaacccaccaggacctaaaagggagggcacagaggaggggtaggcgcaggccattccaggccattacccattccagccggatccgggtcttgcggcgcagtcaggctgcaggtggcaaggcccccgtcctggcccacaggctgccattcaatgcaatacgtcatgctctgagcccgggctggccaatacatggtggtcccgttggttccgacgctgatattcagagccactggttctggaaggagaggggagagacgcatcgagacagttgccatctctctccccagtccccttctctggctcctgcagcctctctcccaccctctcgtctatacccctgaccctacagggccaggggtgtctgtgtttggctgtttccctgcactggaggctgccttggggccaggcacaaagtgggtagcagatggcgtttgtttttttttgttttttctttggagacggattcttgctctgtcgcccaggctggagtgcagtggcatgatctcggctccctgcaacctcagcctcccgggttcaaatgagtctcctgcctcagcctcctgagtagctgggaccacaggcatgcgccaccatttcctggctaatttattattattttttggtggagatggggtttcaccgtgttgcccaggctggtctcgaactcctgacctccagtgatccacctgccttggcttcccaaagtgctgggattacaggcataatccgccgcatccagtcagcaggtggtgtttgaatgagctgagtcctcctccagcctaactgctgtctccttgccaggatattcaccatgagagcttcctgtactgccattacacccacttccagccttgtaggcgtctccggctgtggcagatacctggctgcccaccacttgcctagcctaggcggagagtgtgatgcaagactaggcctccctggcctgaccggcgccactggtggtctcatgccaaactcagaagcacgagcacacacccactcagtccctgggcaaatctctcccactccctcccgccagggcgtcttcatgaatgtcagagagatggatactgcttgcaattctggggatagcaacagccgtttattgagtaccaactgcatgtgccaagccaatgctgagagctttacaggcaccatttcactatgatatgggaccaggctgggtacggtggctcacgcctgtaatcctagcactttgggaggtggagatgggtggatcacttgagcccaggagttcgagaccagcctgggcaacgtagagagacacctgtctctacaaaaaataaaaataaaaaattaaccaggtgtggtggtgcatgtctgtagtcccagctactccagaggctgaggtggaaggatcacttgagtctgggagttcaaggctgcagtgagccatgattgcactccagtctgccaacagactgagaacctagctcaaaaataataaaaatagtaggtcggccacagtggctcacacctgtaatcccagcactttgagaggctgaggtgggtggatcacctgagggcaggagtttgagaccagcctgggcaacatggtgaaactccatctctactaaaaatacaaaaattaggctgggcatggtggctcacgcctataatcccaacactttgggaggccaaggcaggtggatcacttgaggtcaggagttcgagaccagcctggccaacgtggtgaaaccccgtctctactaaaaatacaaaattagccgggtatggtggcagatgcctgtaatcccagctactcgggaggctgaagcaggagaatctcttgaatctggaaggcggaggttgcagtgagctgagatcatgccatctgtcacaagaaaaaaaagaaattagatcttaaataaacacagggtcaactctagccttttttctttctttctctcttttttcttttttgaaaaagagtgtagctctatcaaccagggtggagcgcagtggctcagctagtttttgttgttgttctttaataatgcataatagccaggtatgatggcacatgcctatattcccagctatttgggaggctgagggagaaagattgcttgagcccagaagttcaagtccagcctgggcaacatagcaaaactctgtctcttaaaaaaaacaaaccaacaacaacaaaaaactgcattatggatcttgattattgaattttttttttttgacacagtcttgctctttgttgcccaggctggagtgcaatggcacaattttggctcactgcaacctctggctcctgggttcaagcgattctcctgcctcagcctcccaagtagctgggactacagccaccacactcagctaatttttgtatttttagtagagactgggtttcaccacgttggccagactggtctcgaactgctgacctcaggtgattcacctgtcttagcctcccaaagtgctgggattacaggtgtgagccaccgtgcctggctgattactgaatttttgatacacccctaaatcaggcactcctttaaaattttctgcctcgctcctctcaccctggtctagctgaggctcagagtaggtgctcagctctgaggggccctcataccgccctccccacccagaggaggcacctgtgtgggtgtcggcaggaatgtgccacgtctggttcaggccaggaccaaattggttcgaggagatgacagccacgttgtaggcagcacccgagagatagggcatcttccccaggtgcagggtcctggtggccttggccttacacgggcaggacagcatgtggagctgtagtcggtaagtgacctccgtgccaggcgccagcccttgacagccttctggaagctccagctgggttggctgtcaggagtatgaaagacagcttgtgggtacctgatcacactcatcatcccataggcagacagcagggcacagcctatgaagacagacttggacaaaggccacagccaataacatgcatcaaaaattaaaagaataataaacctcaatgctggcaaagctgctgtgagacaggcattcacctcccgcacacatctagcttgagggaggtgggaaattgacaaaacccactgacattcaggaaaacaaaaatgtttccatcttttaacccagttacctcaagcagaaaatttttccttagaaaaggaatttgagaggccgggcacgggggctcacgcctctaatcccagcactttgggaggccgagacgggtagatcatgaggtcaggagattgagaccatcctggctaacacggtgaaaccccgtctctactaaaaatacaaaaaattagcccggcatggtggtgggcgcctgtagtcccagctactcgggaggctgaggcaggagaatggcgtgaacccgggaggcggagcttgtagtgagccgagatggcgccactgcactccagcctgggcgacagagcaagactccatctcaaaaaaaaaaaaaaaaaaaggaaaaaaaagaagaggaatttgagttagaggaacataggaaataaaggatttttgctacagccttatagtaacagcccattagggacctgactaagatgactatggtaaagtcaacgagtggagtatttgtcagttttgtctcaacagagatactccctctatgcctcagtttccctctctgtaaactaatcagactgcacttaatgggttgttttgggacttaaagcaataatctgctacccaggcaaatgcagtcaccattatctccttcctggccttctggcttctgtgcaattcccccacactctgtttctcacacaggagccagggaaagtctgtgaacatctgagtccagtcatgtgcctctcctgctcacacacacactccatggctccctattaccttcagagttaaacccacaatttgcccacttcctgccacctctacatctcatctccctccatctaccacttgctcatcccccgcctaggcttttgcctcctgctccccatcccaggccaccccacagccctgtgacagccccgttacctgctctttcagggtcagccgcctcctcccatcctggcccagctgctccaccgagaatctcacctgaggctgtggggggttttctgcaatcagaaccaaaccaactagacgaattggaaggagagaaagactgatggatgttttctttgtaaatgatggattctccacatttacaaagtgaaaatcccttgctgccccaaattgcagaaaagagaaaaaactgaaggaagaaaaattaacacaatttgcatccccagggataactgccacctgtaatctcatgttgcctaaggttttttgtttgtttgtttgttcgtttgctttttgagacgaagtctcactctattacctaggctggagtgcactggtgcgatctcggctcactgcaatctctgccttctgggttcaagcgattctcctgcctcagccttccaagtagctgggattacaggcatgcaccaccatgtccggctaatttttgtatttttagtagagacggggtttcaccatgttggtcaggctgttcttgaactcctgaccttgtgatccacttgcctcggcctcccaaactgctggaattataggcgtgagccactgcgcctggcctctaagttcctttttgaatgcaaatgtatttctctgcatggttttgttgttgttgctgttgttttatagactagagacagagtctcgttttgattcccaggcttgtctcaaactcctggcctcaaacaatcctctggcctcggcctcccaaagtgctgggattacaggcataaaccacagcgccaggcctttctgcatggtttgaaaccctctcactcattttcctgttgcccaggctcagggcagcagctgtttagtacaccctgccacctgcaggtgacattgtccttgagacaccgtgaggttcagcctgatgattctcacttgataaagccctgtagtgggctgagcgcagtggctcatacctggaattctagcactttgggagaccgtggtgggaggatcacttgaggccaggagttcgagaccagccgggcaaacatggcgaaaccccatctctactaaaaatacaaaattagctgggcgtggtggtgcatgcctgtaaatcccagctactctggaggctgaggcaggagaatcgcttgaacccgtgaggcggaggttgcagtgagccaagatcacaccactgcactccagccagggtgacagagcaagacagtctcaaaacaaaacaaaaaatagcagtaggccgggcgcggtggctcacgcctgtaatcccagcactttgggaggccgaggagggcagatcacgaggtcaggagattgagaccatcctggctaacatggtgaaaccccgtctctactaaaaaatacaaaaaattaaccgggcgtggttgcagacacctgtagtcccagctacttgggaggctgaggcaggacaatggcgtgaacccgggaggcggagcttgcagtgagccgagatggcgccactgcactccagcctgggtgacagagtgagactccgtctcaaaaaaaaaaacaacaaaaaacaacaaacaaacaaacaaaaaaaacagcagcaaaaaaccctaaagtgggtgcagcaagaccggatgccacattgtcagggtttgagcacccatttctccctctgccttatttctaacactcaccaccttgtttctaatacctgctgccttatttctttttccattttattttattattacttttttttttttttttacttttttttgagacagagtctggccctgtcacccaggctggagtgcagtggtgtgatcttggatccctgcaacctccacctcccgggttcaagggattctcctgcctcagcctcccaagtagctgggattacaggctcccgccaccacgcccagctaattttcgtatttttagtagagaaggggtttcaccatgttggccaggctggtctcgaactcctgacctcaagtgatctgcccgcctcagcctcccaaagtgctgggattacaggcatcagccaccacgcccagccccattttattttattttttagagatggggtctcactatgttgcccgggctggtctcaaaccactggcctcaagtgatcctcccgcctcagccttctgagcagctggaactacaggtgtgcaccaccacctccggctgttgccttatttctaatgcttgcccctgttcctgtactcagagtgatcttaccagggggaacgcacacggggctgctccacttgctccaggaacttccttggctccccagctgccgtcgtcggagctggaattcctgggccacattcatctccagggggcagaggcaggactctggggagaggcaggtcgaacatcaggccgtaagaattgtccaggacttggcaccagtcacttaaccatcatgtgcttattgagctccaactgtgtacagagccacgtgctgggtcctgggggctcagcagaagcaggccaggccctgtcctcttagggcctccaggatcacccacgtccatccctgcccctcagttcaagtcctggctgcggccatcccttcggtcgtgaccttggccaaaggcttctcaccccctccaagtcgtgatttgtttccccacctgcaatttggaaagaatccaatactgaactatggggcagggtaagaggcatacaaaaaaattcagcattggacctggcatacagtaggtgctcaattaatgccaatttgctgcagctgttgttgtcattactattattattctcaccagtatcatcatcctgaggtccgcagtcgccctagaataaaaacatattcatatattgttttgcattttggtgctgaaaaatatttgctgttttacaattagttatttatttacttatttatctgagacacggtctcactctgtcatctaggctggagtgcagtggtgcaatcatggcttattgaagcctcaacctcccagggctcaggtgatcctcccgcctcagtctcctgagtagttgggactacaggcatgcaccatcacactcagctaatttttgcatttttggtagagacgggatttcaccatgttgcccaggctggtctcaaactcctggcctcaagcaatcccaccccaactcggcctcccaaagcactgggattacaggcgtgagccaccgcacctcgctaaatttttttaaattaaagaccatacttccagggattatttctatcgttaattactagagaaccttctctaggttcaaaccttctttaggaacatataaagcagtaaaaaattattataactaaattttaaaaattaataattattttactaaacacaatgtgggatcctggattgaatctgggagcagaaaaaagacattcctggaaaaattggtgacattcaaataatgcctggagtttatgtaagacattaacattagaggagtttgggtaaaggatatatgggcgttctctgcaccagtttatatagtaacttttctgaaaatcgaaggttattccaaaagaaaaaatttattttaaaaaattttagtgggagcaaggcgtggtggttcatgcctgtattcccagcactttggaaggccaaggtgggcggatcacctgaggagtttgagaccagcctggcccacatggcgaaaccccgtctctactaaaaatacaaaaattagctgcgtgtggtagtgggcgcatgcctgtaatcccagctactcgggaggctgacgcaggacaatcgcttgaacccgggaggcagaggttgcagtgagctgagatcatgccactgcactccagcctgggcgacagagcaaggctccgtctcagaaaaaaaaaaagaaaaagaaaaaaaccacctcaggggctagagtgggggctggttgggagcggggacagatgcagagatggtgagactgatttgggggtgaaggtgccctggagaggcccgtgtccaccctggacttgggaaacaaactcaccaacttccatgggctgctgggtgtccggtgccggaactgcacctcagcaccaacctggttatccggggtctcccactccatacgcagctgcccggccaacttggacaccttgatgtctcccagaggaggctcatatttaactggaagcagaggtagggattggcgaggggcagcccacacgtatgtgagttaatgggccctgaaaatccaccctgtccagggtaagcaactgaatccctaaatatgaattaggggacacttgcaggtcccagctaagcctggtatattatgatcaaaaagtcaagatttatacacaagccacatacggtggctcaccctgtaattccagtattttgggaggccaaggcaggaagatcacttaagcccaggagttcgagaccagcctgggcaacatagtgagaccccctcatctctacataaaaattagccaggcatggtagttcatgactgtggttccagctacttaggagagtgagatgggaggatctcttgagcctaggaggctgaggctgaagtgagccctgatcacaccactgctctccaatctaggagagagagggagaacttgtctctaaaaaaacaacaaatatggccaggagcagtggctcatagctgtaatcctagcactttgggaagccaaggtgggtggatcatctgaggtcaggagtttaagaccaacctggccaacacggtgaaacaccgtctctactaaatacaaaaattagccaggcatggtggtgggcacctgtaatcccagctacttgggagcctgaggcaggagaatcgcttgaacccaggaggcggaggttgtagttagacaagatcccaccactgccctccggcctgggtgacagagcaagactctgtctcaaaacaaattaaaattaaattaaaatttaaaaataaataatttttaataaagatttatacacaggatcctgttagtgaagataactttaaaatattaacacccattgctggcaaggctgtgaagagacgggcacttttgtaaattgcttgccagagggtaatcaattctggtaagcaatttacaaaagtgcctgtctcttgggggtgatccgcccacctcgggctcccaaagtgctgggattataggcatgagccactgtgtccagccaattctttttttgtttgtttgtttgtttagaactatcagggaaatcgtacttagtttttagatctatttcaaggaacctgacccaaggagagacataaattagcataaaatagtcttgctgcaccgtggtcatacccggcctgattctttttttatatcattgtataaatttaagaggtatgatggtttgatatacatatccatagtgaaatgattactacagtaaggaatttaacatatccatggccaggcacaggggcccacgcctgtactcgaagcactttgggaggccaagacaggaggatcatttgagcccaggagttcaagaccaccctggccaacacagcaagaccccatctcttaaaaatatatatacatatccatcaccttctataattacttttttggtgtgtggtgagaacacttaaaatttttttttttttttttgagatggagtctcgctctgtcacccaggctggagtgcagtggtgtgatctcggttcactgtaacctccataccacaggttcacgtgattctcctgcctcagcatcccgagtagctggaattacaggcgcccgccaccacactcggctaatttttgtatttttagtagagatggggtttcaccatgttggtcaggctggtctcgaactcctgacctcaggtgatcctcccacctcggcctctcgaagtgctaggattacaggcgtgaaccactgcacccagcccttaaatctattcttttagcaaattttcaatatacattatttttaattatagttctctactgtaccttggaactctagatttatttgtgctgcgtaactacaaattgtattcctttgacctacatctcccccatttcctccttctctccatccccggtaaccacagttctactttcggtgcctagatattcgactttttttttttaagattatacatgtaagtgggatgggcgcggtggctcacgcctgtaatcccagcactttgggaggctgaggcgggtggatcatgaggtcaggagatcgagaccacggtgaaaccccgtctctactaaaaatacaaaaacttagccgggcgcggtggcgggcgcctgtagtcccagctactggggaggctgaggcaggagaatggtgtgaacccaggaggcagagcttgcagtgagccgagatcgcgccactgcactccagcctgggcgacagagcgaaactccatctcaaaaaaaagaaaaaagaaaaaaagattatacatgtaagtgagatcatgaaatgtttttgtttctgtgcctggcttacttcactcagcgtaatgtcctccagctttgtccatgttgtggcaaatgacatgttttccttcattcttttcttttcttttttcttttttttctttttttttgagacagtgtcttgctctgtcactcaggctggaatgcagtgacttgatcttagctcactgcaacatctgcctcctggattcaagccattctcccgcctcagcctcctgggtagctgggattgcaggcatgcaccaccacaccaggcaaatttttttggcttttttgtgtgttgctgttgttttttagatggagtcctgctctgtcgccaggcaggagtgcagtggctcaatctcagctcactgtaacctccacctcccgggttcaagcgattctcctgcctcagtctccccagtagctgggactacaggcgcgcgtggccactcctggctaatttttgtatttttaatagagatggggtttcaccatgttgaccaggatggtctcgatctcttgaccttgtgatccacccacctcagcctcccaaagtgctgggattacaggcgtgatccaccgcacccggcaaaatacatgatgtcgagtcatgagaacagataataagaacccaaccaggtcttggcagcattatggctagcagagagaaaccagaagcaatctaagtgcccacgaataggggattggtaaggggaccatgaaagactgctttgtcacaatagtgtttgcgtgacactacgtgaagtgacaatggctagtagtatcaagtcccttgccaagggccaggaatcctctctagctccagccttgcagcctgatggcctctctgggtaaaaaacggacggggggagaacaaggtgctaacctgagttgtagagctgcagggtcacctcaggagacttctctgtctggttcctggcccaggattccacccagagtgtgacagtgtacagcacagacaccccagcctggtcggagaactgcagcctggtggctgagccggcggcgaagtagcagcagcgcccggagctaaggctgcagcaggaaggagggtgtcagtgccgagtctggggtcctagtggaccccacagccgactttgtgcatcacatcccagcatcgtttttttggtgtttgtttgtttgtttggagatggagtttcattctgtcacccaggctggagtgcagtcgcgcaatctcggctcactgcaacctccacctccctggttcaagcaattctcccacctcagcctccctagtagctgggattacaggcacatgccaccacatgcgtctaagttttgtatttttagtagagatggagtttcaccatgttggccaggctggtctccaacttctggcctcaagtgatccgcccacctcagcctcccaaagtgctgggattacaagcgtgagccaccgtgcccagcccccagcatccttttctgtcccttgtacacctcctcccccagcctgggggttccttggagatcagtctgggactggaggggtttgagggaccccagtatctcccagcaaggactgcaccacacagcgaagaaacgaatgaaagggctgggcgcagtgcctcacgcttgtaatcccagcactttgggaggccaagggggggtggatcacctgaggccaggagttcaagaccagcctggccaacatggtgagactctgtctctactaaaaatacaaaaattagcaggtgtggtggcgtgtgcctatagtcccagctactcaggaggctgaggcaggaaaatcactctaactcaggaggcagaggttgcagtgagctgacatcatgccactgcactccagcctgggcaacagagcaagactccatctcaaaaaaagaaaaaaagaaaaaagaaaaaatggatggatggatggatggatggatggatggatggatggttggatgggtggataagtgaaagggtgaagaagaaaaaaggactagagagaccctcatggccacccaccctgggatgcctaccttcactgaccaaccccccaccacaatcctccaactctctcttcttagatgagaaactgaagcccaggaaggagtgttgacccagccaagatcacgcatccgagagtaggggcaccagagggggttgaagcaagagtgggatggtgggtgagggtttgggaatggtagaggggtcctcaccaacaccgcaggaagtggctgaccccagctgtgggaccctcatactgccaggagcactcgtaacgatcactggatatccgatagcatctcaggtccctagggcccgaggccgagcctggaagagatcctgtaggcttgggaacagaccagagtctggaggggtcttcgtgcctaagacaaatctttgtgatgcttacatctttcagcgtcacctcagcctaaaccctccccgcgtccttcctacctcatcccctgccgtctctcacctcaacctattccgaatcctcagcctcctaacttgtcctcacagaggccagatgtcctgccacctctctctctatccctcaccctcctctggtgtttttttttggggggtccccagggccccaactttcctcctctggttcttcaaaacacatcatcacatttgtgatagacatttgtttgcctgttgtctatctcttccactaggctgtggtcttgggaagttagttgagctcatagccagttgcctatgtctagaactgtgtccgcacatagaagatgctcagtaaatcgttatcaaacaaaagaatggacagcgtgtctgcttagtgttcagacccttttcagggtgcattaggagcataaatgttccgacaatatggccgggcacggtggctcattcctggaatcccagcactttgggaggctgaggcaggtggctcaccatcacctgagctcaggagttcaagaccagcctgggcgacatggtgaaacctggtctctactaaaaatacaaaaattagccgggtgtggtggcgggcacctgtaatcccagctacttggaaggctgaggctggagaatagcttgaacctggaaggtggaggtggcagtgagctgtgatcaggccactgcactccaacctgggcagcagaacaagactccgtctcaaaaataaataaatgaaataaatgttctaataatttatcaggttggggggggggcttcaaaatgcttaacaggtactttctcccatgtaccgaccaatctgaacggacacagacaccagccctgagaccatgctagggaagtgataatgttcagagaggcggctggctactccagggcaacttgaacctggtaagaatgggccagcaggtggtggggtggggactcccaagaccacaggcagggctgggtctttggcctggtggtggaggccatgggaggggccgctgtggatggggtcaggcagagccctacataatcctcagccaacaatgaggaactgccccgaacctgagtctgcatccggatatggcgggtcctgaaaacagcactcactggttctgcaggcagctgcaaaggcaatgaagacataatgacattcctggccttgcactgtgtggggagaagggctcagccttggggtctacacccaagtgatcatcagccctcccacccacccactttcccatctatgcaccctcctaccaccacccatccatccatctgcccatgtatttatctgcccatctacccatccatccatgtatttattcatccgtccaccatctacccatccatccacccatgaattcatccattcacccatccatccatccatccatccatccatccatccatgtattcatccatcatccatccaccccaccatccacccatctacccatccatccatccatgtactcatccatccatccactcatctacccatccatctatccaaccatccatgtattcattcatccatccacccatctatccatccatccatccacctcaccatccacccattcacccatccatccatgtattcatccatccatgtattcatccatccatgcacccatctacccatccatccatccatccatccatccatccatccaccccaccatccacccatttacccatccatccatgtatttatccatccatgtattcatccatccatccacgcatctacccatccatctatccatccatgtgttcattcatccatctactcatccatccatctgccccaccatccatccatccacgtattcatacatccatccatccaccccaccatccgtccatccatccacgtattcatccatccatccatccaccccccatccatctatccatccatccatccatccatccatccatccatcaatccatgtattaatccatgcatccaccccaccatccacccatttatccgtccattcgtccattcatccatccatccatgtattaatccatccatccatccatccatccatcccaccatccacccattcacccatccatccatgtattcattagtccatccatccatccatccatccatgtatttatccatgcatccatgcattcattaatccattatccattcacccaaccatccatctatccatctagtcaccaatctatccatctatccatccacgtattcattcatccatacacccacccatccatccatttatctacctaccgatatatccatccagccatccatccatccatccatccatccatccatccatccatacatacatacatgtatttattaattcatccatccattcatttacccacccatccacctgtctatccattcatccaccaccctttagtcctcagaggttgagatgcatatttgggagacactctcgggaggtacccctgcaggaaagaacagtaagaccaacagtctggagggcagagagaagtggaggtgtgcctggggtggcaccagtgtctgaagccagcatggggaaagacagtagagggtgcatggcagggagaggcctgccagggctggcccaggcaagcacacttggcccactagcagtcagggcaattattaataacatttctccaggaggcagcgacctccctcagccactgggatccccgtgccctttgggattgccacagtctgctaggtgtggaactgggtgagagaaggagggggatgccaccatggatgggtcaggaagaccccggcgccctcactcccacaagaaggacctgtcctgagccctgcaggcagattggaagccttgggggagaaggcggcaccccaggaaacagccccaagtgtccaaccttgaggggggaaagatgcttaacacacaaggctctccatccttccatctctctctgtgatgacacagaacccccacccacccacccacccctgagagcctaaagcccatcctccttccctttccctggactgaccactcactgccactatctccaggatacctcgtgggctgcctctcgccccctccctgctgctggtctccagccatgcctggcccctgaaggcgctgggaccttgaggtgtggccagcactgctgtgggcattctacaggcactcagtgcatctcaagagccattgaaaaagtcagcaccccgctgatccccagtgtacagagaaggaaagtttatttattattattattattgagatagagtcttgctctgccacacaggctggaatgcagtgctgcaatctcggctcactgcaacctctgcctcctgggttcaagcgatcctcccacctcagctcctaagtagctgggagtacaggtgcccatcatcaagcctggctaatttttgcatttttagtagagatggggtttcaccatgttagccaggctggtctcgaactcctgacctcaagtgatccacccatcttggcctcccatagtgctggattttcaggagtgagtcaccgtgcagggcctgagattattaaaagtatatgggaaggctgggcatggtggctcatgcctgtaatctgagcactttgggaggccaaggtgagtggatcatttgagcccaggagttcgagaccagcctgggcaacacagcgagacgctgtctctgtaaaaagtatacaccaaaaaaattaaccaggcatggtagtgtgcacctgcagtcccagctactcaaggggctaaggcaggaggatcacttgagcccaggtggtcaaggctgcaatgagttatgattaggccactgcactccagcctgggacacagagtgagaccctacctcagtaaataaataaataaataaataaataaataaataaataaataaataagtaaagtatacggaaggatgtgcataggttatatgcaaatactttaccattttatatcaggaacttgagcatctttggattttggtatctgcagagggtcctggaaccattgccccgtaaatatggaaatgactgtatacattatattatgtatgtctatctattgtaaactacatacataagatactatactatgtatacctattagatacatacttgctttttattccttccttagttttttttctcattgaactccgggaggtggaaaaaatttagtgcatttcacagaagagaaaatctagaccagaggaaagatgtctaagttcgatcccagaagccatgactgcccatctcccatttgacagcaggaaagactgaggcacagagagatgaaaccaacccacacagcaggcccacagctctccacacatacacgtgcctccacccagcaagaggagccgccatgccagggtcaggggactcaccgccctgcctggacagcaggaagaggaagaggagggggaccacccaggtcaccagcggctccatcggatccacgtagagccccacagccccaggggagcctctctgccacctgcgaggttcagccacc

SEQ ID NO: 1790 - DNA, 16326 bp, Homo sapiens
tggggatagcaacagccgtttattgagtaccaactgcatgtgccaagccaatgctgagagctttacaggcaccatttcactatgatatgggaccaggctgggtacggtggctcacgcctgtaatcctagcactttgggaggtggagatgggtggatcacttgagcccaggagttcgagaccagcctgggcaacgtagagagacacctgtctctacaaaaaataaaaataaaaaattaaccaggtgtggtggtgcatgtctgtagtcccagctactccagaggctgaggtggaaggatcacttgagtctgggagttcaaggctgcagtgagccatgattgcactccagtctgccaacagactgagaacctagctcaaaaataataaaaatagtaggtcggccacagtggctcacacctgtaatcccagcactttgagaggctgaggtgggtggatcacctgagggcaggagtttgagaccagcctgggcaacatggtgaaactccatctctactaaaaatacaaaaattaggctgggcatggtggctcacgcctataatcccaacactttgggaggccaaggcaggtggatcacttgaggtcaggagttcgagaccagcctggccaacgtggtgaaaccccgtctctactaaaaatacaaaattagccgggtatggtggcagatgcctgtaatcccagctactcgggaggctgaagcaggagaatctcttgaatctggaaggcggaggttgcagtgagctgagatcatgccatctgtcacaagaaaaaaaagaaattagatcttaaataaacacagggtcaactctagccttttttctttctttctctcttttttcttttttgaaaaagagtgtagctctatcaaccagggtggagcgcagtggctcagctagtttttgttgttgttctttaataatgcataatagccaggtatgatggcacatgcctatattcccagctatttgggaggctgagggagaaagattgcttgagcccagaagttcaagtccagcctgggcaacatagcaaaactctgtctcttaaaaaaaacaaaccaacaacaacaaaaaactgcattatggatcttgattattgaattttttttttttgacacagtcttgctctttgttgcccaggctggagtgcaatggcacaattttggctcactgcaacctctggctcctgggttcaagcgattctcctgcctcagcctcccaagtagctgggactacagccaccacactcagctaatttttgtatttttagtagagactgggtttcaccacgttggccagactggtctcgaactgctgacctcaggtgattcacctgtcttagcctcccaaagtgctgggattacaggtgtgagccaccgtgcctggctgattactgaatttttgatacacccctaaatcaggcactcctttaaaattttctgcctcgctcctctcaccctggtctagctgaggctcagagtaggtgctcagctctgaggggccctcataccgccctccccacccagaggaggcacctgtgtgggtgtcggcaggaatgtgccacgtctggttcaggccaggaccaaattggttcgaggagatgacagccacgttgtaggcagcacccgagagatagggcatcttccccaggtgcagggtcctggtggccttggccttacacgggcaggacagcatgtggagctgtagtcggtaagtgacctccgtgccaggcgccagcccttgacagccttctggaagctccagctgggttggctgtcaggagtatgaaagacagcttgtgggtacctgatcacactcatcatcccataggcagacagcagggcacagcctatgaagacagacttggacaaaggccacagccaataacatgcatcaaaaattaaaagaataataaacctcaatgctggcaaagctgctgtgagacaggcattcacctcccgcacacatctagcttgagggaggtgggaaattgacaaaacccactgacattcaggaaaacaaaaatgtttccatcttttaacccagttacctcaagcagaaaatttttccttagaaaaggaatttgagaggccgggcacgggggctcacgcctctaatcccagcactttgggaggccgagacgggtagatcatgaggtcaggagattgagaccatcctggctaacacggtgaaaccccgtctctactaaaaatacaaaaaattagcccggcatggtggtgggcgcctgtagtcccagctactcgggaggctgaggcaggagaatggcgtgaacccgggaggcggagcttgtagtgagccgagatggcgccactgcactccagcctgggcgacagagcaagactccatctcaaaaaaaaaaaaaaaaaaaggaaaaaaaagaagaggaatttgagttagaggaacataggaaataaaggatttttgctacagccttatagtaacagcccattagggacctgactaagatgactatggtaaagtcaacgagtggagtatttgtcagttttgtctcaacagagatactccctctatgcctcagtttccctctctgtaaactaatcagactgcacttaatgggttgttttgggacttaaagcaataatctgctacccaggcaaatgcagtcaccattatctccttcctggccttctggcttctgtgcaattcccccacactctgtttctcacacaggagccagggaaagtctgtgaacatctgagtccagtcatgtgcctctcctgctcacacacacactccatggctccctattaccttcagagttaaacccacaatttgcccacttcctgccacctctacatctcatctccctccatctaccacttgctcatcccccgcctaggcttttgcctcctgctccccatcccaggccaccccacagccctgtgacagccccgttacctgctctttcagggtcagccgcctcctcccatcctggcccagctgctccaccgagaatctcacctgaggctgtggggggttttctgcaatcagaaccaaaccaactagacgaattggaaggagagaaagactgatggatgttttctttgtaaatgatggattctccacatttacaaagtgaaaatcccttgctgccccaaattgcagaaaagagaaaaaactgaaggaagaaaaattaacacaatttgcatccccagggataactgccacctgtaatctcatgttgcctaaggttttttgtttgtttgtttgttcgtttgctttttgagacgaagtctcactctattacctaggctggagtgcactggtgcgatctcggctcactgcaatctctgccttctgggttcaagcgattctcctgcctcagccttccaagtagctgggattacaggcatgcaccaccatgtccggctaatttttgtatttttagtagagacggggtttcaccatgttggtcaggctgttcttgaactcctgaccttgtgatccacttgcctcggcctcccaaactgctggaattataggcgtgagccactgcgcctggcctctaagttcctttttgaatgcaaatgtatttctctgcatggttttgttgttgttgctgttgttttatagactagagacagagtctcgttttgattcccaggcttgtctcaaactcctggcctcaaacaatcctctggcctcggcctcccaaagtgctgggattacaggcataaaccacagcgccaggcctttctgcatggtttgaaaccctctcactcattttcctgttgcccaggctcagggcagcagctgtttagtacaccctgccacctgcaggtgacattgtccttgagacaccgtgaggttcagcctgatgattctcacttgataaagccctgtagtgggctgagcgcagtggctcatacctggaattctagcactttgggagaccgtggtgggaggatcacttgaggccaggagttcgagaccagccgggcaaacatggcgaaaccccatctctactaaaaatacaaaattagctgggcgtggtggtgcatgcctgtaaatcccagctactctggaggctgaggcaggagaatcgcttgaacccgtgaggcggaggttgcagtgagccaagatcacaccactgcactccagccagggtgacagagcaagacagtctcaaaacaaaacaaaaaatagcagtaggccgggcgcggtggctcacgcctgtaatcccagcactttgggaggccgaggagggcagatcacgaggtcaggagattgagaccatcctggctaacatggtgaaaccccgtctctactaaaaaatacaaaaaattaaccgggcgtggttgcagacacctgtagtcccagctacttgggaggctgaggcaggacaatggcgtgaacccgggaggcggagcttgcagtgagccgagatggcgccactgcactccagcctgggtgacagagtgagactccgtctcaaaaaaaaaaacaacaaaaaacaacaaacaaacaaacaaaaaaaacagcagcaaaaaaccctaaagtgggtgcagcaagaccggatgccacattgtcagggtttgagcacccatttctccctctgccttatttctaacactcaccaccttgtttctaatacctgctgccttatttctttttccattttattttattattacttttttttttttttttacttttttttgagacagagtctggccctgtcacccaggctggagtgcagtggtgtgatcttggatccctgcaacctccacctcccgggttcaagggattctcctgcctcagcctcccaagtagctgggattacaggctcccgccaccacgcccagctaattttcgtatttttagtagagaaggggtttcaccatgttggccaggctggtctcgaactcctgacctcaagtgatctgcccgcctcagcctcccaaagtgctgggattacaggcatcagccaccacgcccagccccattttattttattttttagagatggggtctcactatgttgcccgggctggtctcaaaccactggcctcaagtgatcctcccgcctcagccttctgagcagctggaactacaggtgtgcaccaccacctccggctgttgccttatttctaatgcttgcccctgttcctgtactcagagtgatcttaccagggggaacgcacacggggctgctccacttgctccaggaacttccttggctccccagctgccgtcgtcggagctggaattcctgggccacattcatctccagggggcagaggcaggactctggggagaggcaggtcgaacatcaggccgtaagaattgtccaggacttggcaccagtcacttaaccatcatgtgcttattgagctccaactgtgtacagagccacgtgctgggtcctgggggctcagcagaagcaggccaggccctgtcctcttagggcctccaggatcacccacgtccatccctgcccctcagttcaagtcctggctgcggccatcccttcggtcgtgaccttggccaaaggcttctcaccccctccaagtcgtgatttgtttccccacctgcaatttggaaagaatccaatactgaactatggggcagggtaagaggcatacaaaaaaattcagcattggacctggcatacagtaggtgctcaattaatgccaatttgctgcagctgttgttgtcattactattattattctcaccagtatcatcatcctgaggtccgcagtcgccctagaataaaaacatattcatatattgttttgcattttggtgctgaaaaatatttgctgttttacaattagttatttatttacttatttatctgagacacggtctcactctgtcatctaggctggagtgcagtggtgcaatcatggcttattgaagcctcaacctcccagggctcaggtgatcctcccgcctcagtctcctgagtagttgggactacaggcatgcaccatcacactcagctaatttttgcatttttggtagagacgggatttcaccatgttgcccaggctggtctcaaactcctggcctcaagcaatcccaccccaactcggcctcccaaagcactgggattacaggcgtgagccaccgcacctcgctaaatttttttaaattaaagaccatacttccagggattatttctatcgttaattactagagaaccttctctaggttcaaaccttctttaggaacatataaagcagtaaaaaattattataactaaattttaaaaattaataattattttactaaacacaatgtgggatcctggattgaatctgggagcagaaaaaagacattcctggaaaaattggtgacattcaaataatgcctggagtttatgtaagacattaacattagaggagtttgggtaaaggatatatgggcgttctctgcaccagtttatatagtaacttttctgaaaatcgaaggttattccaaaagaaaaaatttattttaaaaaattttagtgggagcaaggcgtggtggttcatgcctgtattcccagcactttggaaggccaaggtgggcggatcacctgaggagtttgagaccagcctggcccacatggcgaaaccccgtctctactaaaaatacaaaaattagctgcgtgtggtagtgggcgcatgcctgtaatcccagctactcgggaggctgacgcaggacaatcgcttgaacccgggaggcagaggttgcagtgagctgagatcatgccactgcactccagcctgggcgacagagcaaggctccgtctcagaaaaaaaaaaagaaaaagaaaaaaaccacctcaggggctagagtgggggctggttgggagcggggacagatgcagagatggtgagactgatttgggggtgaaggtgccctggagaggcccgtgtccaccctggacttgggaaacaaactcaccaacttccatgggctgctgggtgtccggtgccggaactgcacctcagcaccaacctggttatccggggtctcccactccatacgcagctgcccggccaacttggacaccttgatgtctcccagaggaggctcatatttaactggaagcagaggtagggattggcgaggggcagcccacacgtatgtgagttaatgggccctgaaaatccaccctgtccagggtaagcaactgaatccctaaatatgaattaggggacacttgcaggtcccagctaagcctggtatattatgatcaaaaagtcaagatttatacacaagccacatacggtggctcaccctgtaattccagtattttgggaggccaaggcaggaagatcacttaagcccaggagttcgagaccagcctgggcaacatagtgagaccccctcatctctacataaaaattagccaggcatggtagttcatgactgtggttccagctacttaggagagtgagatgggaggatctcttgagcctaggaggctgaggctgaagtgagccctgatcacaccactgctctccaatctaggagagagagggagaacttgtctctaaaaaaacaacaaatatggccaggagcagtggctcatagctgtaatcctagcactttgggaagccaaggtgggtggatcatctgaggtcaggagtttaagaccaacctggccaacacggtgaaacaccgtctctactaaatacaaaaattagccaggcatggtggtgggcacctgtaatcccagctacttgggagcctgaggcaggagaatcgcttgaacccaggaggcggaggttgtagttagacaagatcccaccactgccctccggcctgggtgacagagcaagactctgtctcaaaacaaattaaaattaaattaaaatttaaaaataaataatttttaataaagatttatacacaggatcctgttagtgaagataactttaaaatattaacacccattgctggcaaggctgtgaagagacgggcacttttgtaaattgcttgccagagggtaatcaattctggtaagcaatttacaaaagtgcctgtctcttgggggtgatccgcccacctcgggctcccaaagtgctgggattataggcatgagccactgtgtccagccaattctttttttgtttgtttgtttgtttagaactatcagggaaatcgtacttagtttttagatctatttcaaggaacctgacccaaggagagacataaattagcataaaatagtcttgctgcaccgtggtcatacccggcctgattctttttttatatcattgtataaatttaagaggtatgatggtttgatatacatatccatagtgaaatgattactacagtaaggaatttaacatatccatggccaggcacaggggcccacgcctgtactcgaagcactttgggaggccaagacaggaggatcatttgagcccaggagttcaagaccaccctggccaacacagcaagaccccatctcttaaaaatatatatacatatccatcaccttctataattacttttttggtgtgtggtgagaacacttaaaatttttttttttttttttgagatggagtctcgctctgtcacccaggctggagtgcagtggtgtgatctcggttcactgtaacctccataccacaggttcacgtgattctcctgcctcagcatcccgagtagctggaattacaggcgcccgccaccacactcggctaatttttgtatttttagtagagatggggtttcaccatgttggtcaggctggtctcgaactcctgacctcaggtgatcctcccacctcggcctctcgaagtgctaggattacaggcgtgaaccactgcacccagcccttaaatctattcttttagcaaattttcaatatacattatttttaattatagttctctactgtaccttggaactctagatttatttgtgctgcgtaactacaaattgtattcctttgacctacatctcccccatttcctccttctctccatccccggtaaccacagttctactttcggtgcctagatattcgactttttttttttaagattatacatgtaagtgggatgggcgcggtggctcacgcctgtaatcccagcactttgggaggctgaggcgggtggatcatgaggtcaggagatcgagaccacggtgaaaccccgtctctactaaaaatacaaaaacttagccgggcgcggtggcgggcgcctgtagtcccagctactggggaggctgaggcaggagaatggtgtgaacccaggaggcagagcttgcagtgagccgagatcgcgccactgcactccagcctgggcgacagagcgaaactccatctcaaaaaaaagaaaaaagaaaaaaagattatacatgtaagtgagatcatgaaatgtttttgtttctgtgcctggcttacttcactcagcgtaatgtcctccagctttgtccatgttgtggcaaatgacatgttttccttcattcttttcttttcttttttcttttttttctttttttttgagacagtgtcttgctctgtcactcaggctggaatgcagtgacttgatcttagctcactgcaacatctgcctcctggattcaagccattctcccgcctcagcctcctgggtagctgggattgcaggcatgcaccaccacaccaggcaaatttttttggcttttttgtgtgttgctgttgttttttagatggagtcctgctctgtcgccaggcaggagtgcagtggctcaatctcagctcactgtaacctccacctcccgggttcaagcgattctcctgcctcagtctccccagtagctgggactacaggcgcgcgtggccactcctggctaatttttgtatttttaatagagatggggtttcaccatgttgaccaggatggtctcgatctcttgaccttgtgatccacccacctcagcctcccaaagtgctgggattacaggcgtgatccaccgcacccggcaaaatacatgatgtcgagtcatgagaacagataataagaacccaaccaggtcttggcagcattatggctagcagagagaaaccagaagcaatctaagtgcccacgaataggggattggtaaggggaccatgaaagactgctttgtcacaatagtgtttgcgtgacactacgtgaagtgacaatggctagtagtatcaagtcccttgccaagggccaggaatcctctctagctccagccttgcagcctgatggcctctctgggtaaaaaacggacggggggagaacaaggtgctaacctgagttgtagagctgcagggtcacctcaggagacttctctgtctggttcctggcccaggattccacccagagtgtgacagtgtacagcacagacaccccagcctggtcggagaactgcagcctggtggctgagccggcggcgaagtagcagcagcgcccggagctaaggctgcagcaggaaggagggtgtcagtgccgagtctggggtcctagtggaccccacagccgactttgtgcatcacatcccagcatcgtttttttggtgtttgtttgtttgtttggagatggagtttcattctgtcacccaggctggagtgcagtcgcgcaatctcggctcactgcaacctccacctccctggttcaagcaattctcccacctcagcctccctagtagctgggattacaggcacatgccaccacatgcgtctaagttttgtatttttagtagagatggagtttcaccatgttggccaggctggtctccaacttctggcctcaagtgatccgcccacctcagcctcccaaagtgctgggattacaagcgtgagccaccgtgcccagcccccagcatccttttctgtcccttgtacacctcctcccccagcctgggggttccttggagatcagtctgggactggaggggtttgagggaccccagtatctcccagcaaggactgcaccacacagcgaagaaacgaatgaaagggctgggcgcagtgcctcacgcttgtaatcccagcactttgggaggccaagggggggtggatcacctgaggccaggagttcaagaccagcctggccaacatggtgagactctgtctctactaaaaatacaaaaattagcaggtgtggtggcgtgtgcctatagtcccagctactcaggaggctgaggcaggaaaatcactctaactcaggaggcagaggttgcagtgagctgacatcatgccactgcactccagcctgggcaacagagcaagactccatctcaaaaaaagaaaaaaagaaaaaagaaaaaatggatggatggatggatggatggatggatggatggatggttggatgggtggataagtgaaagggtgaagaagaaaaaaggactagagagaccctcatggccacccaccctgggatgcctaccttcactgaccaaccccccaccacaatcctccaactctctcttcttagatgagaaactgaagcccaggaaggagtgttgacccagccaagatcacgcatccgagagtaggggcaccagagggggttgaagcaagagtgggatggtgggtgagggtttgggaatggtagaggggtcctcaccaacaccgcaggaagtggctgaccccagctgtgggaccctcatactgccaggagcactcgtaacgatcactggatatccgatagcatctcaggtccctagggcccgaggccgagcctggaagagatcctgtaggcttgggaacagaccagagtctggaggggtcttcgtgcctaagacaaatctttgtgatgcttacatctttcagcgtcacctcagcctaaaccctccccgcgtccttcctacctcatcccctgccgtctctcacctcaacctattccgaatcctcagcctcctaacttgtcctcacagaggccagatgtcctgccacctctctctctatccctcaccctcctctggtgtttttttttggggggtccccagggccccaactttcctcctctggttcttcaaaacacatcatcacatttgtgatagacatttgtttgcctgttgtctatctcttccactaggctgtggtcttgggaagttagttgagctcatagccagttgcctatgtctagaactgtgtccgcacatagaagatgctcagtaaatcgttatcaaacaaaagaatggacagcgtgtctgcttagtgttcagacccttttcagggtgcattaggagcataaatgttccgacaatatggccgggcacggtggctcattcctggaatcccagcactttgggaggctgaggcaggtggctcaccatcacctgagctcaggagttcaagaccagcctgggcgacatggtgaaacctggtctctactaaaaatacaaaaattagccgggtgtggtggcgggcacctgtaatcccagctacttggaaggctgaggctggagaatagcttgaacctggaaggtggaggtggcagtgagctgtgatcaggccactgcactccaacctgggcagcagaacaagactccgtctcaaaaataaataaatgaaataaatgttctaataatttatcaggttggggggggggcttcaaaatgcttaacaggtactttctcccatgtaccgaccaatctgaacggacacagacaccagccctgagaccatgctagggaagtgataatgttcagagaggcggctggctactccagggcaacttgaacctggtaagaatgggccagcaggtggtggggtggggactcccaagaccacaggcagggctgggtctttggcctggtggtggaggccatgggaggggccgctgtggatggggtcaggcagagccctacataatcctcagccaacaatgaggaactgccccgaacctgagtctgcatccggatatggcgggtcctgaaaacagcactcactggttctgcaggcagctgcaaaggcaatgaagacataatgacattcctggccttgcactgtgtggggagaagggctcagccttggggtctacacccaagtgatcatcagccctcccacccacccactttcccatctatgcaccctcctaccaccacccatccatccatctgcccatgtatttatctgcccatctacccatccatccatgtatttattcatccgtccaccatctacccatccatccacccatgaattcatccattcacccatccatccatccatccatccatccatccatccatgtattcatccatcatccatccaccccaccatccacccatctacccatccatccatccatgtactcatccatccatccactcatctacccatccatctatccaaccatccatgtattcattcatccatccacccatctatccatccatccatccacctcaccatccacccattcacccatccatccatgtattcatccatccatgtattcatccatccatgcacccatctacccatccatccatccatccatccatccatccatccaccccaccatccacccatttacccatccatccatgtatttatccatccatgtattcatccatccatccacgcatctacccatccatctatccatccatgtgttcattcatccatctactcatccatccatctgccccaccatccatccatccacgtattcatacatccatccatccaccccaccatccgtccatccatccacgtattcatccatccatccatccaccccccatccatctatccatccatccatccatccatccatccatccatcaatccatgtattaatccatgcatccaccccaccatccacccatttatccgtccattcgtccattcatccatccatccatgtattaatccatccatccatccatccatccatcccaccatccacccattcacccatccatccatgtattcattagtccatccatccatccatccatccatgtatttatccatgcatccatgcattcattaatccattatccattcacccaaccatccatctatccatctagtcaccaatctatccatctatccatccacgtattcattcatccatacacccacccatccatccatttatctacctaccgatatatccatccagccatccatccatccatccatccatccatccatccatccatacatacatacatgtatttattaattcatccatccattcatttacccacccatccacctgtctatccattcatccaccaccctttagtcctcagaggttgagatgcatatttgggagacactctcgggaggtacccctgcaggaaagaacagtaagaccaacagtctggagggcagagagaagtggaggtgtgcctggggtggcaccagtgtctgaagccagcatggggaaagacagtagagggtgcatggcagggagaggcctgccagggctggcccaggcaagcacacttggcccactagcagtcagggcaattattaataacatttctccaggaggcagcgacctccctcagccactgggatccccgtgccctttgggattgccacagtctgctaggtgtggaactgggtgagagaaggagggggatgccaccatggatgggtcaggaagaccccggcgccctcactcccacaagaaggacctgtcctgagccctgcaggcagattggaagccttgggggagaaggcggcaccccaggaaacagccccaagtgtccaaccttgaggggggaaagatgcttaacacacaaggctctccatccttccatctctctctgtgatgacacagaacccccacccacccacccacccctgagagcctaaagcccatcctccttccctttccctggactgaccactcactgccactatctccaggatacctcgtgggctgcctctcgccccctccctgctgctggtctccagccatgcctggcccctgaaggcgctgggaccttgaggtgtggccagcactgctgtgggcattctacaggcactcagtgcatctcaagagccattgaaaaagtcagcaccccgctgatccccagtgtacagagaaggaaagtttatttattattattattattgagatagagtcttgctctgccacacaggctggaatgcagtgctgcaatctcggctcactgcaacctctgcctcctgggttcaagcgatcctcccacctcagctcctaagtagctgggagtacaggtgcccatcatcaagcctggctaatttttgcatttttagtagagatggggtttcaccatgttagccaggctggtctcgaactcctgacctcaagtgatccacccatcttggcctcccatagtgctggattttcaggagtgagtcaccgtgcagggcctgagattattaaaagtatatgggaaggctgggcatggtggctcatgcctgtaatctgagcactttgggaggccaaggtgagtggatcatttgagcccaggagttcgagaccagcctgggcaacacagcgagacgctgtctctgtaaaaagtatacaccaaaaaaattaaccaggcatggtagtgtgcacctgcagtcccagctactcaaggggctaaggcaggaggatcacttgagcccaggtggtcaaggctgcaatgagttatgattaggccactgcactccagcctgggacacagagtgagaccctacctcagtaaataaataaataaataaataaataaataaataaataaataaataagtaaagtatacggaaggatgtgcataggttatatgcaaatactttaccattttatatcaggaacttgagcatctttggattttggtatctgcagagggtcctggaaccattgccccgtaaatatggaaatgactgtatacattatattatgtatgtctatctattgtaaactacatacataagatactatactatgtatacctattagatacatacttgctttttattccttccttagttttttttctcattgaactccgggaggtggaaaaaatttagtgcatttcacagaagagaaaatctagaccagaggaaagatgtctaagttcgatcccagaagccatgactgcccatctcccatttgacagcaggaaagactgaggcacagagagatgaaaccaacccacacagcaggcccacagctctccacacatacacgtgcctccacccagcaagaggagccgccatgccagggtcaggggactcaccgccctgcctggacagcaggaagaggaagaggagggggaccacccaggtcaccagcggctccatcggatccacgtagagccccacagccccaggggagcctctctgccacctgcgaggttcagccacc

SEQ ID NO: 1791 - DNA, 7815 bp, Homo sapiens
aaattattaatactttattatattagcactgaatatattaatttttctcctaacattttagatatcaaatataaagtgtagtacatacacacatacattgtgaatattttctgtttccatccgtgcaggtcttattaagagtcctgtgaagtggagggaattgggggtcagacaggacttgttgcagagcactgggtaaggagtggcatttctacagcttcttcagctgagtggatatgcacctcttactgcacatggtggatgacaggggtgacgcaggtgcagccaacagtcaccagcaccttctccaactggaaagaaacagagcagccttggtgcttcctccggacgaccagggtctcttgctggatgggaacggaattcatggagatgtcttcctttccttgagcattgatgcagcccaagttcctacactgggcctgtacaacttccgaggggtaccggttggggtcccaagtgacactgcaggaggagcaagccaaagcacaatggtgaggcatgggggaggaagacagcgaatgagagccccacagcactgagtgttcacctgcagggaggcagttctgcagggctgtggcacaggttctggagccacacagcctggaagcatacaccagcctctggcagtggcttacctttctaagcctcagtttcctcaactataagatggggattttcatataccattttctcatgcaactgttgagaatactcagtgatacaagtacatataaaataccccactgtacaaatgttagcattcaattaacattagatctttcattggcattattattattattattacaattctttattctctgcctggagattgaacgtcactagtcagtcttccatcactagtcggtctacagagcctgctgcttggaaaggaaagccacagccccagaggtctgtgaatctcagaccttctctccatttctcctttaataggcccctctgcctggaggcataaagaccacaacatttatcctgccagcttgccattgtacatattccacttgtagtgtgacaggacccccaccaggttacttgagggtgtgtgtccactgtctgaaccctgaaggacgggcagtgagccaaggccaccatgcacagccaaggagcaggccaccgagaacccaaacatctcagagagtatctgagaacctaccaaggaaaacagtcccattggacacacacagtaggcaaagagccagaaaattcgcttaagagcagcttagagatgggaggcagagcggatctctagatctgtcctgctgtggccctagggcgccccatagtaagtcttaataaactcatccactcgctaagctggacttgtccaagtcattctttgatctctccatatcttcccagttcgaggcagggggcactaccgtcccaaggttttctcataacacactcacatgagaagctatgtgacaaccccagaagcacttcaattgtccctggaatctactttgatacttacatttggagagtatgagggagtgcttggtcttccaagaacctgtatcttaatgccaaattacaagactgtaccctgaaggtctccacctaacatcccatttcccagactggcctttctcctccactcattcccactccttaaatgataatgtctaatctgagtgaatctccttaaaccgacttttctgtttcccatttatcctcatgaggagataattatgcaatctgctttaaagaaccctctcttccaacacaggaaaatttgtgaattctatcctagaactacatgaagcagaaaaaggcacaaagtctatgagaacgtggaagcaaaatattaggaccatcaaccacaaaggtgaacctagtccaaaacaagaaagatatgagctcccaggtaaagtgaaattttcattgttaagaggattttcccttttattttttctatgtattctacattttctactttatgattagaatgaattaacatatttttccaaagaatgtgaaaatcagtctcatttgcacttacgtgtaattccagggggaggtggagcggctctcgatgttacgtgacatggaaacgcgctggttttcattgatgatgccaatgtcaagcttcatactacctcctggcacaggcgggcaactctcaggcttttggaaaaaagtatgtcctactttggggattttccgagctgccgcctcactcagaaaggcaagccccaatatcgacagcagcaagtacttgacctggaaaatagaagacgctgcaatcagttagagactcgcctcacctactagcaagagatgcatggtctggcggaactcagcattcctgtccttttatgggatcagggcttctctttgcacctcagttcctcacctggaaatgggaacactcacacctaaaggtatcaaggtgccaaactgagaactaaactcagtagcctagctagtaactgaagccctccatagtctaaaagctcccaaacagtgagacagaaagatgcaagggtctgagattgagttaaaatcctatcctggcttccttgctgagcctctagtttctcttccttccaactggataataatgctcactttatgagactactaatgagattaaatagaatgttctatataaaacacctataaatctgtataagaaaaatagaggcttaataaacgatagctcttgtttttatttccaacttgatatcccatgaatctcccacaaaatccttcttcggagccacccctctacctagaatacactgcctagaatactctgtctgtcaaaatcctacccttccattaaggcccagctcagatgtgatctcctctaagaacagtccctaaaatggttcaatcagaagcatgtttattatccttaaattataaagctttgatcatctagcactcaagcagcattttttaattgtctagaaatgtagtatttgtgttcctgtcagatctacacccattagattgtaagttcctgcatattacacattttccataaacacttttggaatgaatgagtgaatgagtgaatgaatgaacaaaatgatacagctaaattgaactatatagttaagctcactgcattaagaaaaacattacgcaaaaccaacgatagcaaagttccaattatccatgctaattgaaagaaaccggggcactaatgatgcaccacaagagagaatatggaaactatttctctttagctctggagcattttttttatacttacgttgaaatgccagtttatctggtgttataggaatgcgcaaagaatgaaagtgcactgaagacctaatgaaaagaaaagctacaaatcttgccagattccctttgtcacaaccatgctttgctcacccaccattgccactgacccttactggggatgagcaaggcccatcaccaactctcaacataatacagaagaagagctgaaggccgggtgcagtggctcacgcctgtaatcccagcattttgggaagccgaggtgggtggatcacctgaagtcaggagttcaggaccagcctggccaacatggtgaaacctcgtctctactaaaaatataaaaattagccaggcgtggtggtgcacgcctgcaatcccagctactcgggaggctgaggcaggagaatcctttgaacctaggaggtggaggttgcagtgagccgaaattgcaccactgcactccagcctgggcgacagtgcgagactcctgcttggaaaaaaaaaaaaaaaaaaaagagctgaaaataagttgcttttattctctaggcttagcgttgttcaggctcacaccttccatgagttaaggtagggaaggtgattagacatgttggtttcaaaggccttccttttcatattttgcagatactagagacaaaaaacaataagagtaaacaaaaaggtcatagtgtccatttgccatactgaggaagctgacactaaaaagaagttgaaagcaagattgacccagaagagtcagaatgaggctgatttgcctttagataatcagcaatcatcaactttcatcccccacaatcgttcattcattcaacaactagctcttgactttacagtgtggtagctcagggcatgggcttcagagtcagaagtccagggtctgtaactcaattccaggactcttagaagcgatgactctgtttcctcaaaaaaaaaaaaaatgtgaagattaaatgagatgatccatataaattatgaagaacactggcagcatatgataagtatccaatactggcgactcttgctaactctatattgtgctacacagtggactagacagatgtggaatttacactcatataccttgtcttgacaaactgctatggcgtttgtttgtttgtttgtttgtttgtttgttttgatggagtctcactctgtcgcccaggctggagtacagtggcacaatcttggtttactgcaatctccgcctcccaggttcaagcgattctcctgcctcagccttccgagtagctgggattacatacgtgcgccaccacacctgataattttttgtatttttagtagatatagggtttcatcatgtggtcaggctggtcttgaactcctgacctcaagtgatctgcccacctcggcctcccaaaatgctgggattacaggcctgagctaccgcgcctggcctgctatgactttttttttaaaagatgccaacttatattagagggtcttagataacttcccaagcctaccaatcacatatttagggttcttaagtaaattcctcctttgtgttttctctttcctcttctgtgtcatactcactgaatcactattaattttcattatgaaaacttttaaatacatacattggagttatatgacttagcaataattacaatgcttctaacaagtcattattacatttgcttatatattcttagagtatattagaaaattcttttacatctctttaaacactggattttcacaactacctggtgaggtaatcagagctagtattaattatcccaattagacaggtgaaagagttctgtcccagagggaataaataacttgattgggttcaccagcctatgagtaccagtctggggactcaaacctaggtgtcagtagtcagtgctattgtcattgaaggtcatttttattattaccaacattaatcttagttttgtctcattagaagagctaagtgttttaggtaatgtgacagctgtactagatgtgcataagtgttgtaggtcacatagctcgttatcaggaaatcagatgatgtctgcaaatactccaatttgctccacaaagcttttgatctgaaactgtagattttagtggttatgtaatacagagcaggggctctgaaccaggctgttgctggttcttaagaatgatttaaacagcacctctcagagaaatccagagcatgacttgaactcttatatgccacctataaagcagatgaatagatatcgctctcaatctgtataataggggacaggggcaagggaaagcaccaggtgaaggtgagctgtaacaggacaacaaccttctcagcctagctttgcacctcactctaatgtgagctcacctgagcaacctgaacatccatcctctatactcaccagcaatgtgtggacacatgtaagcatgcacctggccaacctctaggtccatgagaatttgcctcaactacttattgaagatgtcctatctgcctgcacctctcaacttctaatcctattccaatgctccttgcactgttatgtttcttgctgacaacccaacagatttctttaaggaaactagaattagaaatagctatggagcacaaagctacccaacagaattgcttggatgcaatggctttaaattcacaaatcttgcctctgaaccaaagaaaagcatactgtatgtggagacagaaagcttagattggtgtaccagttcttgtgcttacagtatccagcaatgttaaataaatagcttaattgagcttttgttcatctgtataaagtggaaagtattcccatctacttcagtggattgatcagaatttccaggacaataataacaatattaatatgaacagttaacacttactgaatgctttctctatcattatcagtcgttgtttattagaatggccaaattaactgaaaattaagcatacacaaatctgccagtacagagtatagactcatttattctcaaagatattaattaatcctcccaataaatgccatgagaaagatgccattgttatccccaccatacagttgaggaaacggaggcacagagaagataaataacttacccaaaaatcctacatttagcaagcagtggagccaggtctgcctgacatcaaagcctatgcccctaaatatggcactttgctgagctacatgtaatctttaaaataacacataaatataaaataaaacataccattgctatatgccatgaaccttttatgatattcaagctcttttaagttgtatggcttgtaaaaggagaaaaaaaggaaattatctaagccaataatatgatgcgggatttcctaacccctgttttcatgtacctctatagtaaattcttctcaggccttatctgactaatgtcaggcaagattccagacctgctggggctagattttcattgcattaacatctctctttcctccaagaagaatgagatggtacaaaataaataaatagcaatcagagacatgggaaatttcccttctctaggagctgtccaaagtcaacactgggtgatttcatttcttccatccagggcactcctgtaatctcaggggaatcattaaacctcttgaggccccagtttccttggttaaaatgtatatgtacataatccctaaagtgctggccaagctcccaccatgagataagaatttcaggccaacctgactctataatggatggccacaggaaagaacatgctagttgtctgtgatgccaaggactgcacacactaacaccacctgggcacacactaacaccacctgggcaaaagccattgggtgaggagctgcatttttttttctttgagacagagtctcgctatgtcacccaggatggagtgcagtggcgtgatcttggctcattgcaacctccgcctcccaggttcaagccattctcctgcctcagcctcccgagtagctgggattacaggcaactgacccatgcccagctaatttttgtatttttagtagagacagggtttcaagttagtcaggctggtctcaaacccctgacctcaagtgatccacccacctcagcctctcaaagtgctgggattacaggcgtgagccaccaggctcgacctaatttctgtatttttagtagagaccgggtttcgctatgttggtcaggctggtctcgaactcctgaactcatgtgacccgcccgccttggcctcctaaagtgctgggattacaggcatgagccaccacgcctggccaggagctgcatttttatgccattataacttttctagttatttttttctttttctccaccagacaggagtcaaaattaaagtcatctctgttttttaagaagtaattccaaaaagaccccaatcaaacctaattccttaggattctgttttctgaaatcctaggcatgacagtccttaaaccagaatgattgctgctactcaccatggctgggccatgcagggtcttcactgtcatgttgcgctggtggcttactttgtgcaggaagctctttctgtgaatgtatcttcctgtgtatgcctgtgttc

SEQ ID NO: 1792 - DNA, 30736 bp, Homo sapiens
ctgggcccgggctggaagccggaagcgagcaaagtggagccgactcgaactccaccgcggaaaagaaagcctcagaacgttcgttcgctgcgtccccagccggggccgagccctccgcgacgccagccgggccatgggggccgcacgcagcccgccgtccgctgtcccggggcccctgctggggctgctcctgctgctcctgggcgtgctggccccgggtggcgcctccctgcgactcctggaccaccgggcgctggtctgctcccagccggtgagactcgacgtggggagcggtagccgccaggatgctgcggacgcggggcaaggtcgcggagggccggacggtcgggactacgcgcccgggctggggaggcaggaagtccgcgccgcgggcttagaggggctcagagccttgggcacagatatcgcggcgcctggggaggaccctcggagcggtgggagttgcggtgtggaatacggggggggtgggtggcacatcgcgcggcgcgtgttgcacaacctggcccgccgtcgtgactggaggcgggagtgacacctccgcccgggccgcggagttcggggaaggagggcgcggcgctgggccaggccggaggggcggccagggctgatagaaaggggctgtggagaaggggcccggggaggagccaggacgggtctggacccagctccacgccttgcgcccctcacgtaccccggcggggcacggtcggccctcgggaggcccatcgcgccctcgggagcttccctcaagccgtgcccttcatgccgccgacggagccgggcgagcccacgtcgtccgtgcggaaggtggagtccctcacccgcggcccccagagggaccccgctgtcgtagagccacgcgggggccggagcgctgagacgcggcaccatgtttcggggagagctctgccgagggcggctgagggccacctccccagaggcgcgaagccctgaggatgggcagatggttcttaagacggcgcccttcccgccactcccacccccgactaccaccacctgggtctgggaacccggtgagagcgcagtcggagggtcgaacgtttgtagctgtcaagtcgtagccccgctgcgcccacaggaagtgacccacccgcctgccgggtagtggcctttctgtgagccaggaccatcttaaggaaaaaaacaaaaaaagagcaaaacgccgtgcccctccacaatatactctcctcttccccgcatccccgaggggatctttcctcccctccacctccacctccacctccaccgctgaccccaaggaataatgctcagtatctgagtcagaggatgtaaaacaaagggatatttctccttatgtagttttatggaggatttaccgaaagaaggtggagggtgagtgactatgtcgcagaaaaaaaaaaaaagatgtttttatcgtgaatgatgttgagaaatgtcctgtgacttccactattgggcaaagcaggtccctctgccctgctagtccctcctgcaggctgtgtatgaagcgttctgatatggagggttggtgcgcctgggttgacagccattggtcaggtgcctgcagagtacagggcgccatactgggaactggaactataaataaatactctggggaccctaatatccagagacctaacccatctacgggaggaacaaggcttgaagttagggaactgtctagcaaagctgcttgcacaactgctaagtgtacggaattccaggaaaaagaaaaattgcttccagttggggtgtccttcatggaaaaggcatttgggcagccctgtgggggtagcaggagcattccaggtggtggaaagggcctgagccaaggtccttaagtgggacagggtacggtgtgtggccggaatggagggtctgtgtaataggacagtgagaaaagatgccagaagcggggatgggactctgctgtgcgtggcgtgggagccaagctctgactttcactgcacagtgaagcaactgtaagtcaggagcagaagcacggcctggctccagggagggctgaagagagacacttgctgttcatatttgtctgcagtctctcgttctcttccttcctctctctctcttctgtatacacctgcctcacagacagctcttctccagagatagacagctctgggctccattgactagttcttttaaaaagaaagaaaacacatccttcaaatttctgtccctcactggtgttttagtggatgcaatgtggtatagtgaggggagggaaggccacagaggtggccagaggacctggatttgcaggcagcatcgcacttactgtctctgcagtcgggctttgaggctgcctgggcctgggttccctcatttccacaaaggcaggactgggtgagccttctcaaagtaagtccatgccaccttccagaatgtaagtgtctgtccaaagcccagttcgatttagccttccataactatcctcagacagggaggaggcttctgcacacctggcctgttcctagctcagtgctggagcacaggatgcgggggctatttgatacatatgtgttgactgaacaaaagaatgcatgaatgaaggaaagaacggtcagctctgcttggaaggtagtggcaagctgagaccaaccatagcaatggttccagatgcttggggttagcacctcaaaacccagatgactgatttccccacagaaatcattacacgagaaaccatcaataattgcatttccctgggagtttccttttggttagccgttctcgctgcctaggcttcatgcaggtttcccatgaccgccagcctggaggaatgcccataggaaagacagcagcaacttaagagttggtcagggtaaatgttaacacgtaatttcatagacaggatgtgtatttcattacagagtcttttttcctgagcgtttgcggttttgacttgtggttgtagaacagctgctcagtttaacccctttatcttttgcttgccagaagccactttcatcatgccactcttccagaggctacaaagttgtgttctttgtgccaggcactgtgccggtggctcacaagtattccttcatcccatactcaacgacagcttacaaggttggcaggatgaacctgcttttgagaggctgggttattggcccaaggtcgcacagctaatgagtgctaaggtgagattgaaagcaggctgtgcttgtaagttcaaagcccactttctctgtcaggcactcagtagtgttcactgaggcacagaattgaatacaatcttccatttcttcctcttaaccttcaccttgtgggtagagaatagtggcctattggaggtatcccttatttatttatttatttatttatattttgagagagttttgctctgtcgcccaggctggagtgcagtggtgcgatctcagctcactgcaacctccgcctcccgagttcaagcaattcttgtgcctcagcctcccgagtcattgggattacaggcgcccaccactacacccagccgatttttgttttttgtttttttgacacagaaagacactgtcgcccaggctacagtgcagtggcatgatctcggctcactgcaacatccacctcccaggtttgagcgattcttctgcctcagcctcccaagtagctgggactagcaggcatgcaccatgatgcccagctaatttttgttatttttagtagagatggggtttcaccatattggccaggctgatctggaactcctgacctcaagtgttctgcccacctcggcctcccaaagtgctgggattacaggtgtgagccaccgcacctggccaatttttttatttttatttttattttgagacaaggtctcactctgtcatccagattggagtgcagtggtgcgatctcagctcactgcaacctccacttcccaggctcaagcgattctcctgcctcaacctcccaagtagctgggattacaggtgcgcaccaccactcccagctaatttttgtatttttagtagagtcggggtttcaccatgttggccaggctggtctcgaattcctgacttcaaatgatctacctgcctcggcctcccaaaatgctgggattacaagcgtgagccaatgcgcctggccaattttttaatttttttagtagagacagggtttcaccaggttggccagactggtctcgaactctttatctgcccacctcggcctccaaaaatgttgggattacaggtgtgagcaaccacacctggccccttttgttatttagagagacaaggcagcagagattaagatcatgtattctggagcaaaacttcgtcatgcaaatgccagctctgtgggaccttgagccacttacccaacctccctgggtcttagttttttcatcagtacaattgggataagggtgcttagctcataggattgttgtcaagatcaaatgagatatatgtacaaagtgcttagcatgatgccagacacaaaagaggagctcaataaacatcagctgccatcaccttcattgtcatgacaatcccccctctgatttctgcaagatgcctcacgtaatgccattcacaagcaggtagctcatagataatattctgattctgctagttttaaagaatgggcagtggccccacgcctgtaatcctagcattttgggaggctgaggcaagggaatcacttaagcccaggagttcaagaccagtctgggcaacatggcaaaaccctgtctctacaaaaaatacaaaaattagccaggtgtggtggcgcatgtctctagtctgagctactgaggaggccgaagtgggaggatctcttgcgcccaagaggtcaacactgcactgagccctgagcatgctgctgcatgacagagtgagaccctgtctcaaaaaacaaacaaacaaaaaaaaaaacgaatgagaggtttgaaattagggatgactattggagaggaatttgttggacaagacaagatatgtcttagtaatatcctaagaagatcccgaacactttttttttttgctttatttaaaatgttatgtaattctataaattttttttttcttagagacggagtctcgctctgtcacccaggctggagtgcaggggcgcaatctctgctcactgcagcttctgcctcctgggttctagcagctctcctgtctcagcctcccgagtagctgggactacaggcgcacgcctccatgcctggctaattttttgtattttagtagagatggggtttcaccgttgttggccaggccagtctcgaactcctgagctcaggcaatccacctgcctcggcctcccaaagtgctaggattacaggcgtgagccatgaaattaaattataaggaaaaaaatgtctactctttcttccactaaacaaattaatgttttcattcatttatcttacttttcagtcctttcatttgtttggcattacatcatagataaacttctatcttttaattaatttttgtcaagttacgtatggtgatcctcctttaaaaatggtactaagatgtttaaaacaaaaaacagtagatccctgcgccacccctaaacctgctccccaaatatgattcctttagttaattcttctgagatatacctccatatttctaaacatgcttatagtgttaattcatgatttgttaattttagatattatctattgacttctaatagatgaaaattacattatctttctgccaccacttctccctgttttttattacagttaaatcatgattttagttaaattaatagtcagcatttatataacaattaagtaatcttcactgctgaggcaagtaagtgtactttgattatatattttttctggtacaattcccctcccctcctgccccagagataataattgctttaattcttcacttgcataatgtttcatgtaactagtcttagttttgttctatcagacttgtcatatcatttccctccaaatcatcagatattccatcaattccatcccccgctttccccagagaacttcctcctagagcacactgttctccagccccagcaaggtctgtgctctctagacctgtggcacaacaggtctagaccagaacagacatcctgtcatggtctaatctcccatgtcctggatcctgtgtcttcttcctcaggggttactccctcattttgctggagaatatcatcctgtaatttcctaagcatatgtatgagggatggatatagacatatatatcaggaacatatatgttaagtcttttcatgtcaacatatctttattctaccctcatacctttttctgataatttggctgggtgtgaaaattatgtgttaaagataattttccctcagaattgtgaaagcattgctttattgccttctagcaaacagtacagatgctaagaaagtcaatgttattggccgggcgccgtagcttacgcctataatcccagcactttgggaggccgaggcgggcggatcacgaggtcaggagattgagaccatcctgtctaacgcagtgaaaccccgtctctactaaaaatacaaaaaaaaattagccaggcgtggtggtggcgcctgtagtcccagctacttgggaggctgaggcagaagaatggggggaacctgggaggcggggcttgcagtgagctgagatcgcaccactgcactccagcctgggtgacagagcgagactctgtctcaaaaaaaaaaaagtcaatgttattatgtgtcttattggtttatatgacacttatttttttctctctggaaacttttaggatcttctttttattcctgatattacaacagtttcaagatttggggccttggtctgggtcttcgttgttgtttttgtgcaggccatttagtaacctttttaatttggcaacgtgatactgtgaaatatgtatttagtcttcaacccctttttctggcatagaactcctaaaatccttagaatctccaaaattgtatcttttatatactaatgattcattggtggctggcagcctctaggcagcttcaggatgggggctggtcccgggaagcaagttaggattagagggctgggacgtttagccccacccctttacccatcacatctgggaaggggagagggaactgaaggccccctgaagttgcaatggccagtggtttaatcagtcatgctcacatgaagcctccataaaaacggggttcagagagcttccaggtagtggaacatgtggaggttcctggagggtggcacacctgaggagggcatggaagctttgtactccttctcctatacctcaccttttcttctgtattatttgtgatatccttaaaataaactgggaaatgtgtttccctgagttctctgagcagctttagcaaattaattgaactgaaagagaggagcatgagaatctcacgttgaacccggttggtcttagaagttctggaggcccagacttaccactggtgtctagggggtgggcggtcttggggactgagcactcaacctgtgggatctgatgctatctccaaatagtgtcagaattaaattggaggatacccagctggtgtctgctgccgaattgattgcttgcttggtggtgggaagaaaccaccccccgccaatatgtagtcacagaagtcttctgtgacttctgttgattgttgtggtgatgtgagggcagaggaaaaatacagcttgagtttttccacactctcggggaatatgtgtccttctcttccagaatattttctttctttccttttttaaaaaataacttcttccttctgtttttttgttaatctccttctagaaatctagtcaatcatattttgtttcctaaattgaatctctaatgatcatatattttttcctattctatttgtgctttcagagaaatgtcctcaatttcatagactaacccttctattgaatttttatttagtagaacttctattgagtttcaaggttcagttttcattctctgcctgctcatttgtccatggtgtcctgcccctgtcttacagatgcagtgttgtatctcttcggggctataataattttacttgtttggtttaattgtgttaacagcattgttttttttttccttccaggagcattttttaattgttttgatctatttttcatacagaaaacctatctcaaatatctggtactccttggctgtctgagaatattttaagaatgaagtcctaaaagctgattaaatgctctgtgtagttaaggtttattgaacattggacttcactgtataggaggtcaagctaatcgtgaacctggcctattgggtgacctccaaatgctgaaatctggaggtgttttttttgggcctggctgccagcattctgagatcagagcacggaaagagaggataaggttcccaacactccatatgtagaccttcacttaattctccctgcccctaagccctgaacgttataaggttctgaggggcccctggcctccttatcaataactcccttttgtagcattcagacagaagttcctccactcagcacaagccagctgcctactctgctgccacttggacagttatttatttattcattcatttgttcatttttgaggttttataattttatttgacatcaacagtttgttctcatccacaatgtctgactgtcagtttctgaaagtggtaatgggtacacaggtaaccaaagtatagagcttgcttggtgaatcttcatcctcatgctttctggacagctgcacatggacacagtatggaacgttccttattcctttggtccagacagctttgttgagcctggtgttagcatatctggagtccccatctccttcatggcaaagttctgggactttttgagtgaccaaggggcacactgcttgacgtcccctccatgggtgtgcttgtggatgctgatggcatattctggtgtcaccacctcattggtggcaggtgacagaatagcccttttattttattttatcttactttattttattttattttattttatttagacagagtctcgctctgtcgcccaggatagagtacagtggcacagtcttggctcactgaagcctctgcctcccaggttcaagcaattctcccacctcagcctctcaaatagctgggactacaggcacatgccaccacacccagctaatttttgtatttttagtagagacagggtttcaccatctcttggccaggctggtcttaaactcctgacttcaggtgatccacctacctcagcctcccaaaagtgctgggattacacgcatgagccactgcgcccagccaacactcttctttacaggagctatgctgctggggccaagttggaaaggacttttaaaattttgttcacatcttttgtccactgagtttggctctttgagtttgagaatttacaaaaaaaaatgttctttcctataattgttatattgtttggagagagggagaaaatatgtgtatatggtcaatgcgctattacctctaatagaattgttattctatatttcacctatatgtatatttttcagttttgattaaatcttttttccccttatcttccctcatgccatctcctctgcttgtgtgccctttgcccccagcaaactgtgttaacacctgttaacatgtttctattctcatttagtcatacacacactctctctctctctctctctctctctctctctctctatatatatatatatatatatatatattcagggagatctttttcatgacttatttccatagaaattgggatcatactataaaaagttatttgaaacttattttcctctctcatcaacacattccagccatctgcaggtcaacagatgtctatgcaactaattctcattctctttaatatttgcataatattccatagtagatagcaatctattcaaccatttctagtttgatggacatttagatttaaactagatctcaccttaattcagccattctctattgatgaccattcagtaccacagaaaaagagggaaagctgtccattttttttaaagctagtataagcttaattctaaaacttgacaaatcttatacaaaaagaaaaactatggaccaatctcatttatgaacataaatccatgcaattctaaataaaatattagcaaatgtaatctagcagaatatcaaaagaacaatgcaccataatctagtggtgcattaacaaactttgtttgttaatcagtgctggagaggtatatgatgaggttcagagctgttttgaatgaaaactataaacctaatagtaactgaaggaaaagacttatatgcaaccacaactatcagaaaccaagaccaaaaacagtattccatagggcataccaaactatttccctccatctcgggaatgagaggacacctgcctgcaccactgggaatcaaccaagtgtgttgtcagacccttccactttccttgtggtcttcatgaagacaagagcttttcatcatgggcatcatcctgcagtgttattgagtagctcccagtggctagtaggaagttactccaaatgatgtatctgtttgccttctctagaagagttccccatctcaaggtgaaataaccgctttttttttatcctccacatcctaggaattttaagggagaggaaaaatgagaggactcaggggagttaatcttctcgccatttaggaaagagtgacatttattagtgtgagcctaggcagccagatggattttgttgggaacatgtgcggagccccctagtggggtggtgatgctagcccgggacctgtaggggagaattcaggagctgaacagggcgagaagcacttatgaactggggtcccagagaaggagggtccaggtgaaatagcttgctagagtcaatcctaggtgcgtgcagatgtcatcctgtgtgtgaccactctgtaaatgaaccctggtggcacggggtcttctcctgtgcttagccctacctctctgttccctctcaagagagaggagggtgtcagccctggcaccctactcacaccagtcactttgttggccttgagattgtgtttctggtctgcctcagcatctgactttccaccccgggatgcgtttggtctgttttgccagttagagaactggagacacctgagcctgagctccttcctaatggttacatttccctggtagcatttgtcactagggcttctaaatttggccatcaggatttcctcaggcttggaaggttaacacatactgcccaagagggaggcaatataatgtaacatgggtgcctcagcttcctcatctgcagaatgggctgaggataatacctcgtcacgatcacccggaacagggcctggcatactttacctagcgactttgtagggacttagtgaatgttccccaacagatctgtcacagaaactgtaaatattgcccttcaccccttccgcacctcttgcagcagtgttatccaggaaggttggaaaccttaggagatgaaggggcccttttctcagggcactccaagagaaccctctcagtgtcttttaaaattgtcaaggtcccagctcatagcagttcctcataaaataccattcctgtgccgggcgcggtggctcacgcttgtaatcccagcactttgggaggccgaggcaggcggatcacgaggtcaggagatcgagatcatcctggctaacacagtgaaatcccgtctctactaaaaacacaaaaaagtagccgggcgtggtggcgggcgcctgtagtcccagctacctgggaggccgaggcaggagaatggcgtgaacccgggaggcggagcttgcagtgagctgagatcgcgccactgcactccagcctgggcgacagagcaagactccatctcaaaaaaaaaaaaaaaaaagcaccattccctttgccatcccctggactcactcctcatcctattccccaaaaagtgagaagggcaggctgtgtagatggcattcctgagaatgagccagtggagagcatctggccctggcatgtgaattcaagccttttcccagctgtaataaccaccctcttttttccacaggggctaaactgcacggtcaagaatagtaagtcatctttttctgttcttcttcttgttgccttcttaatcaagtgagagcctgctgccaacttctgacagaagtcttgccatgccactccaggttcaggctgtgagctacagccatccgcaggagggttcccggagaattgtggatgcgtgcacctgcgcttcctgtcgagaacattcattatgcaaaagtcaggaaaggagaaacagaactgtcatttggattgtgaaagtattctctggggagctgccctactgtatctataatataatttgatttgccacagcttgtcactgtaaagtgagagacatctgtgctgttgattttgttttgttttaattcaaagaggcacatattcaagtgtctgagccaattagagacccctgacatataacaataaagcagctcttactacaactgcatccctcctgtgcccttattcccaatcacaacttcttctcaaaatcaacttgtgtactttgtcttctctcctaaaattccctttagacttgagaggtttgcagtgaccccagtaaacattagagaagagggagcagggcagtaaagctgaggacgcggccaagggccacaggctggaaggccgcgggcccctgagctgtttgctgtctagctgtctgtacctgctgctggggcatctcagggtctcggctataagtctctgaatgttgcttttccctggctgccaggtacctgcctggatgacagctggattcaccctcgaaacctgaccccctcctccccaaaggacctgcagatccagctgcactttgcccacacccaacaaggagacctgttccccgtggctcacatcgaatggacactgcagacagacggtgagtgggcatgccagcagggccctgggggattctccctgcctccaagtggctctcccagtcaggctcaggattgggctcccagtcctgtgctcagacatgggggttcaaatttagtgctataaggatccgtcatttcatgcagtcaaatacttgttcagcattttagatattaacccacagtgataccttctcatcacaccattcttcatgaaaggacttccttcaacctaatatttttagcaccctgaggggaaaaaaaagcaagcagttaattttgtgactacagtaccaaaaatgaagtggaaaatggtaacacatttgtcaacctgttccctgaatttaggggccagcacttttaaaacgtcccccaagcctattcaggaatggagagtttatgttacagaattgggacgattggggcttatgagcactagccccagatttgtgaacggggcatgggggaagttctttttggaagtccccgccctcagtgctcctgctgacagccacaacctcgtgaggatggtggggatggctgtgtttgacacccatgccagattgtcaaagccctcaccacaagtttgcaaagcctttacttctagcccagtgtaaagtgtcatttttccttgcccagctgggaaataactgtctgcaaggcggtaggctgaggccagagagtgaactgaaaggaacaggatgtggagagttgggtaagacggcagattttcttttaggagtgaacaaccgcaacagatagggaagtgacacacccagcacttgtcttggctgatctgcatctgtttgtcttctcttctccctctcctgcagccagcatcctgtacctcgagggtgcagagttatctgtcctgcagctgaacaccaatgaacgtttgtgcgtcaggtttgagtttctgtccaaactgaggcatcaccacaggcgggtaagaacacagctcctgagtggattatgttccactgatgacaccagtacagacttcttgtccccaaattcagaccctgatttagagtgggggagacccagaggtgctgagggagtctgtggaattcagaatggcagcctgagatgggcagaagtcaaaagagaagtggtgtggccgccgtgagcaatagtgagggacagagcgtatttttgaaagcgtccctcacctgctcacccctggtttttcttcccactttacctagctattcgttcggaaaggaagttgaattggaaggcagcttccacagccctacctcctgccatctttgtgtaactttgtgtaacatcttttatgtgtaacttggattcagctggggcctaccttcaggaagaaaaaaccgcccagaccaaagaactgctgtaggtgggcaaatgagcactacaacagcttagtctcattttgctgctcacagctaaatggtgaaatgttgattcttgtttaagtttgtttaaagcagtgggtctcaaagtgtggtccgtagaccagcagcctcagcctcacctgggaacgtggtagagatgtttggccccaccccagacttcccaggccagaaactcttagggtggggtccagcaactggtgcttaacccttaagtcatcacgatgcgagccttagtttgaagactactggtttaaatctgcaaatggtcacttgaaaacaagttagatctcccacaaactcaagcagcaaaggcagaacccctctccgatgttaaattaggacccccaaacttgactgctatgcgaatggtgagaaccaggttcctccgtccacttagaagcaaaggaccccggcccctccaccagggtaactagaatgggggttggagtcgatgtctgtaatctctaacacccagaaaataacttagcacaaattcaaatatcattgcaactgaggtgcctgctggcccagggtgagtgggggtctctagcttgtcctttgcacctttttactccataatggtctcaagaggttcctggcttttccgtttgaggaggaagaatcatttgacaaatagtttttacctgcctggcgtgtgccagatctccatagccccaagtcccctggctccgccctctcatacccattgtcctagaatttgagagggcaggtgggaggggtgggactacttccactttccccaaattcttttgccttattcactgtctactgatgaggccagatccaggtttaaaaaaaaaaaaaaaaaaaacaggcagaaaggaccagaggaaacaaaaaacaaagatactgatttccctgaccttggattttgctgtggttgttgctttgttcttatttttggctgaatattcgggagtgggtgggaacgggggtctttgggcatagatgggtgacagaggtgtgtgtaatccatccaccttcccttcctcccttctcttcagtggcgttttaccttcagccactttgtggttgaccctgaccaggaatatgaggtgaccgttcaccacctgcccaagcccatccctgatggggacccaaaccaccagtccaagaatttccttgtgcctggtaagagcatcctcccaagacattccctccccaatggcctctgtgagaaggaagcaccaggtggcacagatgccagcccccctgctcagcaagacattggctggcattgccagcacctgggacccacagaacaaacagaggccaagactgggagtgctttggtgtgtgctgcaacctccattccctgaggcagaggccattctctgttggcacaacagtggacggtggcccaagatcccaggagttttatgggaaccagagcacctccctctatctagagaagcacccagcctgcccagaaaatagcataaaggcaagccacaagccactcgtggggaagttgcagcctctgcccccagcctggtcccagcctccgtggcttgctcttctccttccaccttacattctgcctgcatcatccaacgttcatcccatgcatggcgctctactccccatgcctatccacactgcctgtgattaccgccaggcttttcttctcaggcatcctttgatgtacatgtaccttctacttctctgtcctccccagaagctcagctattacctacatttctctctttttgtttttaatagagatagggtcttgctttgtcacccaggctatagtgcaattttgctatcctagctcaatgcagcctcgaactcctgggctcatgcgattctcctgcctcagtctctctacaattctctgtccatagccagctatgtcaggaagcccacttgaaaacaaagcctgggtcttctgcccatttttataatctccagaacctcacgaattgccttgcatatagtaggttggtcaagaaatgcttgttaaggatggtgttgaccttcttcatcctgggaccaccctgcacacacgcgtgcacacacactctgtgcttaccctgctttatgtcaccgcgtgtggctcatcactccctgactggtactgcatgctgtgtgtttgcttttattggtctcttctactgggttgcaatctccagggggcagggctttgtcttgtttaccactgtacctccagtgccaagaacagggcctggtgcatagttggtgctcaatatgtatttgttgaaggagtgaatctcctcagttctcgcttctgttcctaaagttgactgactcagtccctgtccctccatggtgattcacacctgtcacatgtcttctcagcctgtgcaaagacaggggcagccggggacaagaagctgtgggtgggcagagaaggaactggaggggaccaagattgcttggtcacccacagcaagctcaggaggaatgcacttgcatcaggagggttccccgagagatgaggatcagacaggcaggctggcacccatgccaaggtgggtccagccctggagctcactctgaaggggccacctgcggacaggctcccagtggggaaaagattgttgttcttggtgtcaggagtctggaagaacagatttctgaaggcagaggcttaatgagtttccttttttctgggtcgacagactgtgagcacgccaggatgaaggtaaccacgccatgcatgagctcaggtaacagctggcccgggagagctttatttggatgcatacacatgcacatgtgcgtgcccctcctcactcccagcctgcgtgtgtgaccttggcaggcagcctgtgggaccccaacatcaccgtggagaccctggaggcccaccagctgcgtgtgagcttcaccctgtggaacgaatctacccattaccagatcctgctgaccagttttccgcacatggagaaccacagttgctttgagcacatgcaccacatacctgcggtaactctgctctttttgacccctctagcatagctcaggaccacccctccaagccctgagtctcttctctgctggtctgacagaaccgcgttgctagaagctcgcgactcagggctgtgcttagtccatagtgatcatggcgccttgccctttttcttccccagtgatcttatgcttgatagaaaggcagttgactgtgtcctgcccatgactcagtcctttttgttctttcctcccccacacgcccccttgttctctttttgttttgctttgtttattacaaaaaggatttgaggatttaaaaaaaagaagaaatgtgaaaatagagacaaaggggaactaaagataaggaaataaggccaggtgcagtggctcccacctgtaatcccaatactttgggaggccaaggcaggagaatggcttgaagttggagttcgagactacagtaagccatgatggcaccactgcacccactctgggggacagagcgagaccctgtctctaaaaaagaaaataaaaattgaaaaataaataaagtacattaatgacataaaatatgccaggcacagtggttcacgcctataatcccagcagtttgggaggccaaggcaggtggatcacttgaggtcaggagttcgagaccagcctgaccaacatgatgaaaccccatctctactaaaagtacaaaaattagccaggtgtgctggcacacgcctgtaatcccagcaatttgggaaactgaggcagaagaatcacttgaacctgggaggcagaggttgtagtgagctgagattgtgccactgcactccagcctgggtgacaagagtgatactccatctctaaaaaaaaagaaataaaggtaatacgatgaagccagctcagtgcaggaaacgtgtgctgtgtggttctgtacaactggtgtccatgaacacagatttgttgccccaattcccagcagccaaagcaaagagagacttaccagttactacacgtacttaaggatttacaataaaccagcttccatgcagaaacggagtttttttctggaatagaaacctgaaaagcatttctcccctggccttcctaaggggtgctctggacagcctctccatggcagtgccacagcgtgttcttacccaactagccttacccatcccaactagccttacccatcctcgcctctctcctcagcccagaccagaagagttccaccagcgatccaacgtcacactcactctacgcaaccttaaagggtgctgtcgccaccaagtgcaggtgggtgagtgtggtgtggacaggtgcagggagcaaaacaggtggcaattatagagtggacaggagtgaggagtgtgcacaggtgaagagtggtgtggacgggagtggggagtgtgcacaggtggagagagtggtgtggacgggagtggggagcgtgcacaggtggagagtgtggtgtgtctgggagtggggagtgtgcacaggtggagagtggtgtggacgggagtggggagcgtgcacaggtggagagagtggtgtggacgggagtggggaacgtgcacaggtggagagagtggtgtggctgggagtggggagcgtgcacaggtggagagagtggtgtggctgagagtggggagcgtgcacaggtggagagtgtggtgtggctgggagtggggagcgtgcacaggtggagagagtggtgtggctgggagtggggagcgtgcacaggtggagagtgtggtgtggctgggagtggggagcgtgcacaggtggggagagtggtgtggctgggagtggggagcgtgcacaggtggagaggtgtggctgggagtggggagcgtgcacaggtggagagagtggtgtggctgggagtggggagcgtgcacaggtggagagagtggtgtggctgggagtggggagcgtgcacaggtggagagtgtggtgtggctgggagtggggagcgtgcacaggtggagagtgtggtgtggctggagtggggagcgtgcacaggtggagagagtggtgtggctgggagtggggagcgtgcacaggtggagagagtggtgtggctgggagtggggagcgtgcacaggtggagagtgtggtgtggacgggagtggggagcgtgcacagtctggcattcttgctggtggacaggggaaagcttgtcctctctgtggcaccaagcaccactaccagtcaggattccttgcctggtaaggcactgcccctgcctttctcctgtctggttctcccaccctcacctgggcaggggttcgctgacccgcccttgctggagggagatgatggtcacctggagatcgtggtgtagccagccaggatcccctcctctcacattgccgctgctggctggaaggcatgggcgctctacagttctggagcccttttcctgccctctctgcccgcagatccagcccttcttcagcagctgcctcaatgactgcctcagacactccgcgactgtttcctgcccagaaatgccagacactccaggtaggggacatgcggctgtcctaggccatactgggagaacaagtggctgaaggcccccagcctgtgctgcgtccttacctggttctgaggggtgattagggaggagagtttagtttaacttggagtccttcaggcctgaagtgtggagtggggctttagagtgtcactccctggggctggactcctggctgtctttcattagctatgtagccttaggcaaattacttaatctttttgattctcaacttccttgactggaaaatgaggtggtttttatcctagagccctagttctgtgccatgcactgagcgcagtgctccaacatgccgtccattttttcatcctcactcattgtgagtcacggtactatgcagtagaggatccccccaccccaaaccccaggttcctggataaggaaactgaggcacagagatgttgaataacttgtccaagatcacacagcagggacgctgttttcaaaagtcgcatgccctaatgcacgggaggctgcagccacgtgctcaccagaaggcaaggcgcaggcatggagccaggctggaaggagaacccagcctcccaaggaggaggcaaggtgtctcttcttagaccagcaactcaagtgtctcttgtagatggtttcattaagttcaacctggatctagagtgcctggtgcagggccaacatcattaaagccctcaagggacgtcagttgtgtttcttgtgatgactgggaagggttaagaatgctattttccctttttcctctgttctcattgcagaaccaattccgggtaagcttggatctctctccgacagcactgcagccctcaggggacattccccagtggccacttgagaagtccctgcctcagccaggcagacaaggctgaaccgaggccagcccggggtggggggtgagaccatggtttgtcgtggtggggccagagaggacagagcctggggctggggagcagggctgggggcctcagggtgggcagggcaggccccgccgcatcactcacgctgttctgctcaccgcagactacatgcccctgtgggtgtactggttcatcacgggcatctccatcctgctggtgggctccgtcatcctgctcatcgtctgcatgacctggaggctagctggtaagcgctggggctctggctgtcctggagtcaggctctaataccagcaccaccactcactaccaaggcaaatcgctttattctcagagcctcagcttcttgcttgagaaccacgtcataaagctgttgtaaggactgagtgaaataagacacatgaattcttagcacagaacctggcatgtgctatttgcacagtatctgttagccacgattatatttgttgttatcaaatgtagtattattaaaatcaatagtttggaaggagccggagtaaagtttccctgtgtcaggaatgatcatccaggcaggtggagcagcctgaacaaccccatcctgcagccgccagacgtggacgcctggggtcagggagaatagtgagggtcagcatcgggtgatagagaaggctccggctgccctgagccacaggggtggaccccagccccacctcattagccttgtagtcacaggccagttacttaatacaccatggattcacttttctgtaaaatgtactgataatgcctccctctaagggtgtgacgaaggttaaatgagtagctgaggaaggtgcttgctggtggggattagtacataccagtgtcttctcccacctgcagccctctgctggccaagtcctaagccgggagaacacaggccttccggttggggcttcagcccttgcctgccccaccatgaccctaggctgctccttccgtcatctgggaagctgtttccacccttccctaggctcgtcaggattaggtgttaatcattattaattattatgtggtagaaagaaaaccagccaggcatgggaggacctatgggaggttccaataacattcagtagcatctcggccagtgctccacaggcggtgcagctctctaaaggtttggggctgggcggcggcggcgcttttggtttcctttctgctgttgcgcttctgttttccgaagtgtcctgcaccacagggtgaaggcaagaggagcctcgctgttatttggctgtcttgtgacagttctggggaagagctgaaagggttaggattgagattaaggttctaagtcgtttgctcagtcatctgtggatctcaatcctcccagctgtcactaaggagttaacccccgcagagcagttttttcatcacatctctgaggggaacaattgcttaagtatgtgggttccccttcctcacctcaaaaataccaggaggaaatgttgcaagcagcctggtggggctgcttctggaaagaagtgtggtaagatgcatgtcttctgtaaagacacttctggggaagagcttttcctcatgtggagtcagtttggggtggccaaatttcagggagacagggcagaccaggaccgtaatgaggaaccagaatggacaccaccccctgccccccggcactgggggtcccagctggatcagtgctacaaaataactgtgatcccaattgattatgtacaacgtgccaggcacgtcacatacacacactcatttaatacccattaaacaagagcaaatacagacccacctcacagaggaagaagctgcatttcagaggcactagtaactgctccaggtcatagtgctcgtagtggcagacccaggactcatgcctgtgcgaccacctagcacggcctcgctgctcagtctcggggctgcccccttacccttcaccctttgtcagggatggggcagacaccctgtgagctggtttctatttctcttcccaaagaaccactccagtgtatttcttttcctttccagggcctggaagtgaaaaatacagtgatgacaccaaatacaccggtcagtatttcctggtttgcatgtttgcttatttttaaagcagtggagggttctcctgggataagtgcgtgggtcgcctcctgtgctctaactcccaagtcccttcaggagaccccaccttagaaacccccttccagtaccccactcagaagggcccccaataacaaggcctgggtgccattttttgaatcactcagacaaggaaagaaaggtaagtattttgtgaacagaggtcctccctggagcagaccaacagagcttggtgcctctttttcttttcttaattaaagtataggctaaagaccagctaggaacgttgagagattctttttcccacaaggcagcagactgatttttttcaggcagccaaaggtggaatagtaacatctgggtttttccaacaggcctcagttgggtttctcagcttagggagggagccaagctctgtgtcctggtccaggcccctcctgggctggcaggcacagagctgccctgggccctggggtgagggtcagcatgtgtggtcttgtttccttagatggcctgcctgcggctgacctgatccccccaccgctgaagcccaggaaggtctggatcatctactcagccgaccaccccctctacgtggacgtggtcctgaaattcgcccagttcctgctcaccgcctgcggcacggaagtggccctggacctgctggaagagcaggccatctcggaggcaggagtcatgacctgggtgggccgtcagaagcaggagatggtggagagcaactctaagatcatcgtcctgtgctcccgcggcacgcgcgccaagtggcaggcgctcctgggccggggggcgcctgtgcggctgcgctgcgaccacggaaagcccgtgggggacctgttcactgcagccatgaacatgatcctcccggacttcaagaggccagcctgcttcggcacctacgtagtctgctacttcagcgaggtcagctgtgacggcgacgtccccgacctgttcggcgcggcgccgcggtacccgctcatggacaggttcgaggaggtgtacttccgcatccaggacctggagatgttccagccgggccgcatgcaccgcgtaggggagctgtcgggggacaactacctgcggagcccgggcggcaggcagctccgcgccgccctggacaggttccgggactggcaggtccgctgtcccgactggttcgaatgtgagaacctctactcagcagatgaccaggatgccccgtccctggacgaagaggtgtttgaggagccactgctgcctccgggaaccggcatcgtgaagcgggcgcccctggtgcgcgagcctggctcccaggcctgcctggccatagacccgctggtcggggaggaaggaggagcagcagtggcaaagctggaacctcacctgcagccccggggtcagccagcgccgcagcccctccacaccctggtgctcgccgcagaggagggggccctggtggccgcggtggagcctgggcccctggctgacggtgccgcagtccggctggcactggcgggggagggcgaggcctgcccgctgctgggcagcccgggcgctgggcgaaatagcgtcctcttcctccccgtggaccccgaggactcgccccttggcagcagcacccccatggcgtctcctgacctccttccagaggacgtgagggagcacctcgaaggcttgatgctctcgctcttcgagcagagtctgagctgccaggcccaggggggctgcagtagacccgccatggtcctcacagacccacacacgccctacgaggaggagcagcggcagtcagtgcagtctgaccagggctacatctccaggagctccccgcagccccccgagggactcacggaaatggaggaagaggaggaagaggagcaggacccagggaagccggccctgccactctctcccgaggacctggagagcctgaggagcctccagcggcagctgcttttccgccagctgcagaagaactcgggctgggacacgatggggtcagagtcagaggggcccagtgcatgagggcggctccccagggaccgcccagatcccagctttgagagaggagtgtgtgtgcacgtattcatctgtgtgtacatgtctgcatgtgtatatgttcgtgtgtgaaatgtaggctttaaaatgtaaatgtctggattttaatcccaggcatccctcctaacttttctttgtgcagcggtctggttatcgtctatccccaggggaatccacacagcccgctcccaggagctaatggtagagcgtccttgaggctccattattcgttcattcagcatttattgtgcacctactatgtggcgggcatttgggataccaagataaattgcatgcggcatggccccagccatgaaggaacttaaccgctagtgccgaggacacgttaaacgaacaggatgggccgggcacggtggctcacgcctgtaatcccagcacactgggaggccgaggcaggtggatcactctgaggtcaggagtttgagccagcctggccaacatggtgaaaccccatctccactaaaaatagaaaaattagccgggcatggtgacacatgcctgtagtcctagctacttgggaggctgaggcaggagaattgcttgaatctgggaggcagaggttgcagtgagccgagattgtgccattgcactgcagcctggatgacagagcgagactctatctcaaaaaaaaaaaaaaaaaaagatggtcacgcgggatgtaaacgctgaatgggccaggtgcagtggctcatgcttgtaatcccagcactttgggaaggcgaggcaggtggattgcttgagctcaggagttcaagaccagcctgggcgacatagtgagacctcatctctacctaaatttttttttagtcagtcatggtggcacatgcctgtagtcccagctactcgggaggctgatgccagatgatcacttgagcccaggaggtagaggctgcagtgagctataatggtaccattgcaatccagcctgggcagcagagtgagaccctgtctcaaaaaaaataaaaaagtagaaagatggagtggaagcctgcccagggttgtgagcatgcacgggaaaggcacccaggtcaggggggatccccgaggagatgcctgagctgaaggattgtggttggggaaagcgtagtcccagcaaggaagcagtttgtgggtaagtgctgggaggtgagtggagtgagcttgtcagggagctgctggtggagcctggaggggaaggagggaggcagtgagagagatcggggtggggggtggggggatgtcgccagagctcaggggtggggacagccttgtgcgcatcagtcctgaggcctggggcacctttcgtctgatgagcctctgcatggagagaggctgagggctaaacacagctggatgtcacctgagttcatttataggaagagagaaatgtcgaggtgaaacgtaaaagcatctggcaggaaggtgagtctgaagccctgcacccgcgttccgactatcagtggggagctgttagcacgtaggattcttcagagcagctgggctggagctcccctgagctcaggaagccccagggtgcaagggcaaggaaatgaggggtggtgggtcagtgaagatctgggcagaccttgtgtggggaaggggtgctgctgtgacttcagggtctgaggtccaaagacagcatttgaaaagaggctctgaagccagtgtttgaagaatttgttcctgaagtacctcctgggggtaggctagaggcttctggcttcagggtcctgaagaacacattgaggtgccgtctgacactggaatagggtgcccttcattcctatgcctgagtccttaactatatttccaacctccagtgaggaggagaagattcggaaatgtgacaggagagcaaacaggacagtttgcatgtgtgtgtgcgcacacatacatgtgcgtgaaagattatcaataaaagtgcataaatttgttgatctggtaagagtttctagcaggaaggtcgagccacttactgtaggtcaagaagttgctagttgcggagttttttcttgcagttagactttacctagtggtagcagggccaccaaagctctgtgtcccagatggtgtatggcccataatccacccaacagcagcaaaggaccaggcaaaggagaacaggagcagaagcctcccagccactagccttttgggctcagtctctccaataatcctggagaggggcttcgttgggtctggacacctaccatgcattctgtgacctttccctagcttccaataaataactgtttgacgcccagagtacaggataccacaatgcactcttcctgcgtagagcacatgttcccatctgctcccattcctcaggaaccttgaattctagctctgctggcctttgagcccatgccagtaaatgtcctgatgggcattgcctactatctccagggcagctgcctttgtcctcctaacagctttattggagtacagttcacttaccatacaatccacaattgaccctgcacaatttgatgccggtttagtatagtcacagttcagcagccatcagcacagtcagtcttagagtttactacccccaaaagaaatccagccccccttagtcaccaccccaacctccccatccctaggcacccctaggctactttgatctctgtagacttgcctcttctggacatgacatagagaaaggagtcataaattctccaaggtgtctgtttcttctttaatgtcattccctgtttctcctcacattccctccccatttcctgggcccagtctcacactggtccttgcttaccctaaatgctattaattccatcactctgagtatggtgtttgctgtccgctgaatgccaagagcttcaagagtgtgtgtaaataaagccacacctttatttttgtattattctgaaccatggctaataaattgtttcaccaagaaatgtctctctaagaacaggtgccctccacgctgtgcccctcccacctcttcagctcgtctcctgagtgtgcagaggtggttccggttgggaaagaagcagcggagcatctaaccatgcctgtgtccaggccgattatgcacgcagccaccaacaagctcccaactcccgcgtagagtttcatgactttttcctgcctactatcttgatcctagttttttttttgttttttttttttttaaggaataattactttgattcaaaaccagtttctcttttctgcataggaaggtccttgaaggtgtttagggtctaaaaagggtggtgttcggtctctgaaacatccattcagcagtttgagctgggatctctgaatgcaagggtatgatggatatacttctttcttgcttttgttgtgttttggttttttgtttgtttttaagtcagggtctctctgtcaccaggctgtattacagtggtgcaatcatggctcactgcagcctcgacctcccaggctcaagccatctttccacctcagcctgccagtggctagaactacaggcgtgcaccactgtgcccggctaatttgtgtgtatatattttgtagaaatggggtttcaccatgttgtccaggctggtcacgaactcctgggctcaagccatctgcccgcctcatcctcccaaagtgctgggattataggcctgagcccaccgtgcctggcctttcctgtttatctttgaaaattaaatagggcataagagagaagaagatgtacttacaatgcagtgggtggttttaactctatagcctttgggctctgtggttggtgctccccttcctaaataaatgaggtgtatgcagggccctcttctgccttagcgccctgccagctgggactccagcaaggcccggggcacctgaggacagagtgagatggagggccgctgctccagcagccgggcctgcatcccacaagtcaactgtgtcggacagaggatccttacaaagaagaggcagcagggttgggggctggccagctgctcgtccgccctaggtagcttgctcatctgtaaagtgggtggggcaggagttcccacctcatggggtcctggcaagcctgcagtatccccgagtggcaccagcctgcttctggggcagagcagtttgtgccccctgaggtaccactgatcctctttccctgctattaggtattgctctcttcctccggtgtttgccttttcagattatagaagtaatatgtgttcccatatttggcgtctctcaggagctcaggaagtacttggctgagtgaacatgtccattgtggaaaaatggcaacaatatggattccatgggtatattttatagaagaatatgaagaaaagcagctacccctaaacccattgcacaagctgttcatgttaattctgtacccgacgctttccccacggggcctcccctcactctgaaatggcatccaggtccatcttgccctccacctctgcatggctctccatgccccatcgcctctcccagatcctagcactgggtccacactctcgccctgtccatttaggttgatgaaagcaggcagtcacccgggtgggccagtcttgcctgtgggaggaacatgcagtctcctgtctcatggtttgaagtgtgccaggaagcctggcccagcccacctccccctggagtccttcccaggaggaataaccccttaggtcattgactataagatgagttcgctcactggatccttcctctctgatgagacaggaagaaggtacacagtgaccaggtaggaggaggagagggagtagaaaggagggatgcgggtggctggtccctgcatttgcctgcttccctgcacgggtgtcccactggccgcctctgctcaccagtgtcatgggattctctcagaagatgaaaacagcccctgcttttttgctagaatggctgagctttcatggaaaggaagctggacccaagcaacagccgactaccgaaggttgcctggagcagtgcagatgtgggaggaagaagggccttggtgcacactggcttttcttcctgactgcaatgtggcattgtgccagctacctcctctttctcggcctcaggaaaatggagagaaagcagccctgaaggtggctgtgacgagggaaggggcagagggcctgacagtcaaccacgcgctatattttcctgttcttccttagggcaagaactgcatggccagactcaggcaaggcctaggtgtgggctgggcattgcctacacgtgaagagatcactccgcgtccctactgcacctgtcacaaagtgccttctgatatgcctggcaaaccaaaatcggtgagcgccagcttgcttccctagaagacatttctaaatattcataacatgcttgctcaaatcaatcaccttattttacatccgctccagggagaaatgaagacatggtcctacgttgttctgtaattattttctatgtaaattttgttccttgttacaattatatatgtcttaggggaaaggaccatttcacatgtgtcacctcatgtgattctcaccacagccctgtgattgctcctgttttataaataatgacatagttccagttgatggccaaagccacagctaacgagaggcagagagagctcaggctcccaggagcttccactctcagaccttgcctcccgggctgccctgagtgaaacgcctgcttagcatttggcacagccagaagcagcaagctagggtcacaacacagagaggggctgtgtaatactggctgcctctgtgctaagaaaaaaaaaaaatcactgtgtgtttgtttattttggtgcaggcccagtgttcttgcttagacttaatactacccttcatgttaaaataaaaccaaacaaaaacccat

SEQ ID NO: 1793 - DNA, 7020 bp, Homo sapiens
cttcagtgaagtttatttcagaaccattgaacagtatgatatttgctcatttataaatattcccatttaaataatctgagcttatatattttcagtcttaattaaaggacttgatttaaagagagcacaccagtccaaattgaattgattccatagctattaaaaactaggctcttttacagacactgctacttcttgccccctttgaataaattagaccaatgaataaaacaaacaaacaaataaataaataaatagggaagcggttgctcatcagaatgtgggagcgaatgacagagggtttcttagaaccaaatgtggccgtggtttctgtcaggcgggctttaagtgagtaggagaggtgagagaggcctggctcaacaaaagggctggggattggccctgaaaggagagagctgactgtcctggctgatggacaggagatcctcttagcactaccctaaggcaggcagttgggcattggtgtagacaacaggaaagtccaggctatagccgtactcaaaaacctttctgttccctttctgccagccctagggattgagtccacattcagcacaggactctctgggtacagctctctttaggaagacacaaattgcatggtgaagtcagttatatcctggccgcctttggtccctcccaggaagacgggcatgttttctgcttgagaggtgctgatgtaccagttggggaactgggcagactcaaattccagcttgttattgatttctatcttgttgaagacaaatcgcttttccatcttcttctttgggtaatttttgggatctacactctgcagcgaaagagaaagaagaatttttgtggggcaagggacaaagatgctatgggaaagatgttctttgggttggccagaaaggaaactgacgagcaggtcacatgatcaggagccagactcctgagttgtaactgggcccccaactttccgtgtgattattaaaagagcccttcttcttttctaaaacttagtgccaaatgctgaggagcataatgtaggtgagaattttttttttttgggggggtgaaaattaagctagagcttcttgaagtacctagtttccaggggctttttattgtatttttccttatggtcctagaatgacatcaacttggaaatgaagcttttgctgagaaagctggaggtgatagtggtggtaattttgggagtggagtggacatgataatgggaccctttaagtcatctatttcccaaggtgtctatcaaatgagagcagccctaacaatatataatctgttggggttgtaactatggtaggacataataacatcggcaaaatgatttaattttctgcagcaggattgaaggttgcacgcagttaaaaattatgttaaatttatttacattaatgcaaaattgtcaaatagacctgttcccagcttttcctagggatgggggcggggagaaggtggttgtctgggaataagtggtagcaggaggctgagaagggcttcattccatagcattcacttacctccagctgtagagtgggcttatcatctttcaacacgcaggacaggtacagattcttttccttgaggcccaaggccacaggtattttgtcattactttcttctccttgtacaaaggacatggagaacaccactgaagaaagaagggggtcttgtggttagggacacagcagtgcagggtcaccccaacccctaggccccatgagtaggatacatgtaatttggtagcctctgtgggaacccacagtgaggttccttggcctaagacacaggataacttgacttctcacagacaatagcagggtcattttgttgatttagggtttcccctcaaaggcctgagggtttctcagagcctcatagcagtaggaacggagaatgaaagagggtctacattttaaatgctgaaggaaggaaggaaggaagccattgtgtcactggctggcaatgtgcccatccacaggagcggaacaacttgatcaatgtggaaggaaaggaaagaggtgaagctgtacttctgccagaaatcaggcaccagaactgtttcaggaacagagagtagcccatgggaagaaactgggagaggagaggctgagctgggaaagtggctccaaagagagacactcattttgatcttcctcagtcacagcagtgtcaattggaggccctgggatcactcttactacccgattccaaagaaacaggattttcttggcctggctgagagcaaatagcttccccctgagtgaggctgtccttcaaagtcagcagccttagttgcccacactcctgtgcagaggctttggctactgtggcacgatgccaggcagatcaccacagctaatgatgggttcaccgcacttgaaacttttgcccgttacagcggagagatataagttcctgctgggcggtaaaatttccctacaaggaaccacctggcattgggtgggacggatgttggggcaaggggggaagactggggagggggatggacacattatcgctccagcactcttgtttcagcctcaacaacaggaagagagaacccacaggcagttaggccatgtccatcaaatgaccccatattgtggaagaattgacattgcactatgcccaagagacttgggtggacatggtcctgggagtgcttgagccgtctaatttctcagggtcacactcctgttaacaaatgcactggccagtgcaatcaaatgtgccatttctaggaccaaagtttgtatattcctttttaatattttttttcacttgtgttgatcatttgccttaaattaactttctactttgtttaaaacatggagaattagcaagctgccaggaggccaggcagggaaaccaggatgtttccatttaccttgttgctccatatcctgtccctggaggtggagagctttcagttcatatggaccagacatcaccaagcttttttgctgtgagtcccggagcgtgcagttcagtgatcgtacaggtgcatcgtgcacataagcctcgttatcccatgtgtcgaagaagataggttctgaaatgtggagcacatgttgtttaggtataaaatcagaagggcaggcctcgtgaggcgaggcggcaaaatttgatttcttggaggacacctgagcatatacggtcaaagtctgatgacaacaccagtagggatgaagctgggagtggggtggctaagaacactggacctgacactattagacatgggttccagcttcaggtctattactgctcactgtggccgagcaacagagctacttaggtaaaatggtgatggtcataacactagcccacagggaggttacgaacctctggtgacaatgtaagtgaaaggcccctgagaaagagtgagggagttgcaaatgtcagtagccatcaagatcttctttaagaatagtttccactaaagagatgattgctttggtttccagccttctttgttttgtctccccgctgggccttctacctttaaagggctttggctctgggggaattgagttggctggggcttgatgacttccaagaggacacaagtggagatctactgcctgctcttggctaactaccttcttcaaagatgaagggaaagaaggtgctcaggtcattctcctggaaggtctgtgggcagggaaccagcatcttcctcagcttgtccatggccacaacaactgacgcggcctgcctgaagcccttgctgtagtggtggtcggagattcgtagctggatgccgccatccagagggcagaggtccaggtcctggaaggagcactgcggagagagcgagggagggagcctggtgaggtggtcctgccaggaaccatgctttgacatcagagagtagaaagctcagagaggaggaaagggcttgaaagaatcccgagcttctaaagatcatccctctctgggccaggcgtggtggctcatgcctgtaatcccagcactttgggaagccgaggtggatgaatcatttaggtcaggacttcaaaaccagcctggccaacatggcgaaaccccttctctactaaaaatacaaaaattagctgggtgtggtggggtgcacctgtaatcctagctattcaggagactgaggaaggagaatcgcttgaactcaggaggtggaggatgcagtaagccaagattgtaccactgcactccagcctgggcaacagagtgagactctgtctcataaaacaaaacaaaacaaaacaaaacaaaataaaataaaataaaataaaaagattatccctctctgaagctcaaggaggttaagtgtgtactcaagggcacacagcaggttagaggcagactcaagactagaatgtgggctttctgacaccttacaggctattcttttagaataaatcccatttctactttgttcatcttttttgtacatgccccacctacaccatacatgtataccttctctatatctttttgtatccctaatgctgtcacactatgatttgctttttcatgcagatgaccataacattttccattcacctatgctcactcagcaagtattcaatttttctacactgttcttttttttcctttttcataacactgtctcataggcattctgcaaatcctgtgagagtactttttgtgaaatgttaccactttcctcttattcagagaagctccgtattaaggcttcactgaggttgccttaaggcatgataatggttcaaaggcttgaaagacagttaaagagacctgtaagtgcacaaaagaaagttgagcaggagagaatttcctgcctggagcagagccaagctgctggaagaggcaatgggggcaaaggccaggcagacaagccaatgggctcctcccacagctgcagccaacaagttatgccagtcttaaaacttctaaagaaatatgtttttaacaagattgaggactggattatgaggctaggggaggctatcacaaactggaataaaataaagccagagaaaagtggctgcctcccaacctgcacaactgacctagctaggctgatggctgggccacctaggaaggctactgagcatcatataaaacagaagggacagcaggaatataacatggctctttgtaaggatgagtctgaaaaatgaccatttgctgcccaaatgcccttagctacaactgaaaatatttcagaactggaggttgcaggatgctggaatctcagagatcatccagctcagccctttatttttcagatgaggtccaaagcgggtaaaatgacttgtcaaggtcaaacagcaagtgaatggttttctttcaagtctcaattcatctttttgtttatatcatctatgtcttgttgttataagcttcaccccaggtagcaaaaaactattctactcaaaaggggtagacatatgttagttctcaagatcatctcttggtttcagagtttaactcaagtgattggcataggctgaatccatctcttaaaaggataatcaaatttatgttgaagacttggttgtcttcctactatgaaatgggaaacattatcactactcctcccctgtcaccaccaagtgtggccaccaccaccaacgttagtgagtgactgtggtgatatgatgaccaagtggccaggtcagcaagtggtgcagcctgtgtctcactggaagaggttaaagtctttctaaaacaaaataccatggcatcaaagtggcccagaactcccttctttgagctttccctgtgttagagcccttccttgggttgggagttaaacccatagtcttaccttcatctgtttagggccatcagcttcaaagaacaagtcatcctcattgccactgtaataaaaacagggacatgtctcaattatgtcttctaaacaggtttatttttccttccctgtgtacaagacttgactgttcataagaaactgcaaacagcctgcctctcaaagctgcctgaaacacctggcaagtttcacagtgatatgcgcagaacagtccagaaggcagattctaggcctggcaggtgggcaccctgggtgctccctgttggatcttgaggcctaacctctagcccagcagagtcagctaaaatctgagctctccctctccctccaagccacactttgcaaagggattccttgtattgtgggcttggagtcttttctccccatttgcctctgcaggaagcccttgcaacaacacatctggatagcctccaggtcccaaggctggagggacttgtaatgggaaagtagtctttaaatcagatttacttggcaccctgtttgccactgaaagaggcaatttaggggaaaaatctggtctccaagcacagataacactctactcttgaaagaggagacctgctcatgttactggtctcagcgtctccactgacctgtaataagccatcatttcactggcgagctcaggtacttctgccatggctgcttcagacacctgtgtaaaaaggagaaaatgagtgacttccccatgacggctacgttcatgtgtgatttctctcagcatccagtgcatggcagtcatgcaaagaaatgatctctgagtaaatgaatgaatgtgtgaaagagaagtcctttgggtctagagaaaagcatttgctaaaccaaaccccaactagcaatgtattggctaggagagctggagcagaggctttgacactaacctttagggtgtcagctgttagataagcagtatccattcccagaatatttcccgagtcataagcattatattacacctggcatttttgcaaaaagctgagagagggaggcagagagggaaggagagggagagacagagaaagaaagagagagagagagagaatatgcatacacacaaagaggcagagagacagagagactcccttagcacctagttgtaaggaagattaaagtcatacttgagcaatgaagattggctgaagagaatcccagagcagcctgttgtgccttgtgcctcgaagaggtttggt

SEQ ID NO: 1794 - DNA, 8430 bp, Homo sapiens
ctcctccacttggaatacaaagaaatgactttcactactatattagagtatgtaacatagtgtccaactgcaagttagatcctcaggaatcttcacttccgtgtgttctagaggacagatgctgatgaatcatctgtggaaatagtataccgtgagtaactaagaagcaaatctggataggtaaagataaagcagaaaatcaaatgaaacttaaggtagataccttttggagaagtgatttgaatctttctaggaattctttgggtggttttttctcataagaatcacatgaagggcatgtctagaaatcaatgaaaaagtaacagtcttctttaaaatttttttcgtaataaaatgtttcttaaaattttttttcattaaaaacataaattatgttcactgaaaaacattcgagaagtacataaaactgtttggaaagtaacaatggaaaaagtccttgtaatcccattcccagagataggaatcccactgcaatgttttaatgtatattctctctgtgttttgggtatttttaattattattgtgcatttacattatttataccagttggtgatttgctttttttttttcacacttaacatatcacaggatttcctaagtgttaaataatcttcaaaaatatgacatgtagtggttgttctgtattccaacataggatgcaactcttactatttttggacccaaaggttgcatctaactttttttttttttttttttttttggagacagtcttgctgtgtcacccaggctggagtgcagtggcgcgatctccactgactgcaacttccacctcctggattcaagcaattatcctgccttagcctcccaagtagctgggattacaggcacgcacgaccatgcctggctaatttttgtatttttagtagagaccaggtttcaccatgttggccaggctggcctcaaactcctgatctcaggtgatccgcctgcctcggcctcccaaagtgctgggaatacaggcatgagccaccacacccagctgtatctaactttttatttttgtctacattactccaaagaacatctctgtaaataatttttcatatatatctttgcttatttgatatattcctagaagtagaattactaaattaaagggataaaaattttaaggctttgatatacattataaagggttttacctcttttcacttggagcattcttattattatagggtattgtttaaaatgtttaattggaaaaaacaggatttccttgttttaactcgcatttatgtgattactagggagattgaacagtttttcatatatggattgctcacttagatttttaaaaagctttcttagtttatgctctttgtctttatccctatttagataccaaacaccaagccattgcttggtagttagcatctcaatgccagtgtgatgttgtagtgagagcatttcactaaaagatagtagatatacgttctaattctcattctgacactatttatggaacttggggctagtgacttaactcctttgtagatctcactttcctcatctataagatgaacatgcttaactggagagttctaagtttagctccaaagctaccacttcatgagtttcaaaaatatgttcagctcctttctttctgaggaaagatttagagggatatttttcacatggtcaccaggccaagcaatcaaaagaaataagaataattttgataatataattaagatttcatttgaatcacatgtggaatgtttttggaggcaaaagaactaatttaaaaaatttgaggctgggtgcgatggctaacacctgtaatcccagcactttgggaggccgaggcgggcagatcacccgaggtcaggagttcgagaccagcctgaccaacatggtgaaaccccggcactactaaaaatacaaaaattagccaggcgtgatggtgtgcgcctgtagttccagctacttgggaggctgaggcaggagaattgcttgaactgggaggtggaagctgcagtgagccaagaccttgccactgcactccagcatgggcgacagactgagactctgtctcaaaaaaaaaaattttttttgagagtaatttattttatgtattttcccactggctttaatctttgaattactcatgttcttgggtatctgcattgctcatgagttggcatatacaagaggatctcagggctcctaaaagcttgggactgttaaaattccccagccaagtaatgaggcctccctatttcaattcaatactgactctgctgatgtacaggatagtaatatgatttaagagaggaggcaaagtttaagatttgccctagtcttcttgtaggctcttttcttgttagaaagctaggatctagctcctgttaataagaatacaagttatctgtgaccatatgagaggaaatagttcttaactccaaaatcacagttggattctctgcctaatgacttcctcaccttgagaagctatattaacatattccagctgccaaggactactaggaaattataattgggtttttgaatactttcaagtctgtgggcttaaaagagtgaccctacttcttaaaatgcaccacgtataggccgggtgcggtggctcatgcctgtaatccccacactttgggaggccaaggcgggcggatcacggggtcaggagatcgagaccatcctggctaacatggtgaaaccctgtctttactaaaaatacaaaaacaaaattagccgggcatggtggcgggcacctgtagtcccaggtactcaggaggctgaggtaggaggagaatggcgtgaaaccgggaggtggatcttgcggtgagcagagatcacgccactgcactccagcctgggtgacagagtgagactctgtcttaaaaaaaaaaaaaaaagcaccatgtataataaggcataactataggtaaggaagacaccagcagccctggctacaggtgtgtgtgtatgtttatgtaatgcaagatatatagtttataagtacaaataagagagatgacaaatgacaatcttactagtctgtgtttctgtcttctccctgcatttgtggaaggtggtttcctcttcagctttttaattgatacattgattatcctttcattgtttcctgtatttgctgactttagttgggccttctgaaagcaggaaaaagctgaccactcacagtttgtctgaaagataaacaatttgtatatatgttaacaaacattattcagaaagtaaaagatagctttcccaatcctctatttctatctcttctgcaatgtcgtgcattacatcgtttcaacagatgagtgaggtatgatttcacctcctacttaatctttgggatgggaaaaagggacaatcccctgcttcgcagataagagagaaaggagcctcacttcttcacaatgctttattcctgatgctacacagaggaccattttgatgtctgggtggtggacaagacctttgtgttttataaaggagagttagttcggtttaggacacatttgctgagttatgaggctctaaaacttacactgtgactagtggcagctttgggtaaattatgttatagtctgatgaagaacatttttcatttgtttgtggtttctgttaatgtatctatcatgacatgtcttgagcagcattttattctgtacagcgccaggcatagtgtcttgccagttaatgatcaacatatatttgtaaagttaacagatgaagaaaatgaattaaagcccctcctttggagaaaggaagtgggtacctccctctgatagcatattttacatctaagattcaatatacttgccatagatcacacatgacttttctaaaacccttttcatactcccagctcagttagggttaggattctgcctgaatcaagcagttgaggaacagtttgaggcttgtccaaccaatgagacggaaagtcatttcttagaaggtaagaatagggtctcagagaatggaggagcggataaaataagcatcaaacacttatctcttggtttggaaaaatagctaatgactaacaagccaaaagcttagccatcaaactggaaaggaaatggaatttactggaaaaaccaaacatatactgacttgttgaaaaattttaatgctgatccaaaagcttatatccaggtgacttgtatccaacttacttttttctttcagcaaacgtgtgtatgtgatgctattttccccctgaagttgctatattttcatttcactatgcatatggaagctactaccttataaccagaagcctcaatccctcccagtccctacaaaggcaggcctatacgtaacaatattacctgaatcttcttatggacaatcagctgaacacagcatctggcctgctttgcattttccaacccatatgcttacccaatatgaatgtagattaataatatgcatctctaagacacaaacctatcaggtttgctttgcatatatagccacaagccgagaagcagcttatctggtttccttatatcaaggcagattgcctctcataagggcaaggtggtgtcctttccatatgtttgccaaaatgcttatttaatagaaactatttataaatgttcaatatagcacttttttttccttgaaaaccacacgttcatgtttgttgaagttttttcttttctcttctttttgaccacaaccggcttaacttactggaaaaaataatattcatatttaaagaggtaaattttccagctgaaactgaaaatactgactgcttcatccgtgatgatctgaaaaaccagcatttctcacagaggctcattttgctgagttaacatttacatgtgtatgctgaaagaaaattaggttccaaagaagtagaggggccctgccagccaaatgaactcccttgagataatattgccaggaatggtcagtaccggtactcaaagcactgaaattgtaaaactacaatttcagttgtaaaaacaactgaaaatcttttctgaaagcctttgaatggtacctggacactgacgcccatattgatggggctgtgcttcctctcccacccttccttgtttacctctgttaacagacaatggggttttgttttcttctgttctgcaagcagcagagctgtgtctggcaatatgtggtccaggataaataactgcgggaattggctttatatgcacatcaaaggcagcctcaaaagaggaaaagaagtagagggctgtcgccactaaactgccttaaggatgtattgagaaggagagtgaaaagattaaccttgatttaggcagcctcaggtgccctatcactcaggagtctacaggatgccaactccatatttagcactgtctggaagcatgaacattgctttcctttgctatgccttggtgacaacagactccaaaggcaagactttgtttccctcatgctttaacatatgagaacatgaggagttttctgctgctacattgttttgcagactagaaggagcggtagtaaagtcaaacgcaagaattaacaaaccattcctcttcagctgaagaacaagtcaagtgctgcttttgccaggagtcacacttggctttgttgttttgcaattgaatttttgaaattttttacctccttagggcttttttttttttcttttgtagaaacaggatgtctcactattttgcccaggttgttctcaaactcttgacctcaagcaatcctccaaacttggcttcccaaaaggattacaggcattgggattacaggcaggagccacttcacccagctgaggcctatttttacatttttttccttttgcaaagaaagccctggccattcacactaagaagtcttgctaattgggcaagactacctttgtcctggctgggtgcagtggctcacgcctgtcatcccagcactttgggaggccaaggcaggtggatcacggggtcaagagattgagaccatcctggccaacatggtgaaaccccgtctctactaaaaaatacaaaaattagctgggtgtggtggcgtgcgcctgtagtcccagctactcgggaggctgaggcaggagaatcgcttgaacctgggaggcagaggttgcagtgagctgagatcgcaccactgcactccagcctagcaacatatcgagactccgtctcaaaaaaaaaaaaaaaaaaaaaaaaaaaggattacctttgtcctacacacaaactaggtttatatcagggtttctcaacggtgataccactgacatttggggctagataattctttgttgtcagggctgtcttgtgcattctagaatgtttagtacctggcttctacctactagatgccagtagcacccccattctacctccaagtgtgacaaccagaaatttttccagccaatgccaaatgttttctggggcacaaaaatcaccaccggttgagaaccactggttatatgattagacggaaagaaaaagagaaaaagaaagatgcctggctaggccaattagagatcttagataattactatatgcatgcaacattagatagttttattttcattaaacttttaaatcttttaaaatctcttacagaccctactttgaagctagcttgatataatgctaatgtgaccttgaacgatttctttcttcctgagtttgcctactagtatagcttaaagatccaagttacactattactcacttatatcatagccagcattgcttgatcagattatcagatagatacagtatcacggagacaaaatcctttcattatgatgtaagataaaaaatatctttcattaacaacacacgtaaaggaagtacccactggaccaactcaggttagaaggtggaatctctttcttatttcttattttgcaagttatagactacagccaggaaactctggaaagaactctaaccataacagttaaacaaggtgcatgagatgctagaaatgtatgttttgataattaggcacattgattaagaagtattttcagttattggaaaagtctttccaataagctgaatgtgctactttcattttagatgctgcttattagaaaaggacctagtaaatgagagtgtttgggttcagagctagagagtgaattttagagaaaagcaatagttgtgactcattcactttctaaacttttacacatagtcatttacgataattgttttctttgcaatgtatcttcttaagtctccccctttgtagtgtcctaattactggtagcacttttagttattctaatttatgcaattaaaggtctgtgacaatgaaaacatttccccaattgcatttatactctcagggtaccagaccagaagatcagatcgtagaagttactggagaaaaagatcagcggacagcactcttgaactacatgccaggcctcttcttcctggaactctaatggatttaaatggcttaagagacgggatgaattgttgaaaatggttctttcaaaagacctcacggaaggccaaagacaagactcactgaggccaaggtatatgtgaattatattctgaaggacagctttgatttccacaccaccatttctccatgctgtccctgtaatctaattctttctttctttcttttttaagtttgttattaaaaggttaattctgcttcctactgtatgtatctatgtttcttcggtaggataacaaagaaggctcaaaagctttcatgcccaagggctcttaaagagtaactagctgtgcattgttcagaaactgatcagagtatagatttcgtttctagttttgttattctgtctcagcaatactacttaggagtactcttagagattcttgaagataaacatagtttatgaggaatataatatagcattttttagttggtttttggtaaatcaatgaatttaaccaaaatataaataaatatttcatcaattattagaccgctaagttcattaaaattcagtatactcctatataatcatgctaatgtctttcttattggatttaaaaacttatgtccaatgtattttcagaaataaattcaactggtcttacctctacatcttctggagctggcagaaattcagggacctagagcaaaagaaaatttgttctgagttatttttataagccaaaccctccttttatattaattgaaaagtatgatttagattttgttgtgacaaatatagtcttaccaagtcattcacataatttttcagctgatcaacaatatctataagttgacgcattctaatcatgtggcgatcttgaccttgggagcttgatttgtggaccagtgtccccaagaagatgaccatcagacagatgacaatcctctccatgttgccaggactggatctcataagtaccaacagtagagctagaccttggtctcgttttcacttcagc

SEQ ID NO: 1795 - DNA, 8430 bp, Homo sapiens; identical to SEQ ID NO: 1794

SEQ ID NO: 1796 - DNA, 49881 bp, Homo sapiens
ctcttcctccccactctgcacatgcggctgggtggcagccagcggcctcagacagacccactggcgtctctctgctgagtgaccgtaagctcggcgtctggccctctgcctgcctctccctgagtgtggctgacagccacgcagctgtgtctgtctgtctgcggcccgtgcatccctgctgcggccgcctggtaccttccttgccgtctctttcctctgtctgctgctctgtgggacacctgcctggaggcccagctgcccgtcatcagagtgacaggtcttatgacagcctgattggtgactcgggctgggtgtggattctcaccccaggcctctgcctgctttctcagaccctcatctgtcacccccacgctgaacccagctgccacccccagaagcccatcagactgcccccagcacacggaatggatttctgagaaagaagccgaaacagaaggtaattccagccctggttttctgctgggaccagggtgccttctctgcccaggagggactgttccctgcctgctgcatctagtgtcacagtgggagggctcggaggactgtgcccaagtcacaattggggacactgaggcaaagaagattcatgcagtgaggctgggcagaaatgaggttggggtctcttgttcagcacagcttaggggcccagcagcagggatgtggctgagacgaccctctatcttgaaaaccagcctccaaaatgtagcgggctggggaaggaaagccagtttcaagccaaacataacatgtcaatcacccgattctgggcggctgagtcgggaggtgacgggcatgggtgtagagcctgatgggacccattctgtgtcagtttctatgtcttaccaccttgattccacccagtcattcaaaacaatggctggtgtgcccatttcgcagatgaggcaatgaggctgcgagaggtagagtgattttccctcggtgactcaactgggacgtagcaggtcgggcagtcaagccaggtgaccccatgagctgtcgctgcatctttctcatgaagcacggggaacgggtcggatggtaagaggccaacccagttccctgtgcatgtggaggagaggagggtggggaggtcagtggaggctgagccttgaaggatgggaaaggaagaacattcctggtggaggagccctggggagcgggaacttaggacttgccgcaggaatgacgtctctgctcagtgaaggcagaagaccaggtgcgggacattcaaagccaggaggctgctgcgaggaggacatctgtgattccctggggggagagtggggctttcagaagcacatggtggagtcggggaaaacctgccaggtcaaaacccggccacgcgccttcctcactcggtgaacttgggcaagtctctctgcttctagccttgagaagccatggttttctcatctatgaaatggggaccaaggtacccccatcctggtggagctagttgtggggacctcagggccgaacagggtgaaagctgtgctcctaatggcccttttcctttgaggaagagagtttgtggcatgagaagctttgagcccatggagacgggcccgactccaagagtgacagagggggagcgacacactcaggctgctgtggtcctgcctggccagccacctggctctggcccccccagtgccaactcaccatgttgtaggcacttaagcgtctcccatagtcctcaacaggtgaagcgggcagcctcattcagcccatttcacagatgacaagagtgaggcttagtggggacaaccttgccccaggttaactgtgaccagatgacatggagctgggattggatgccagtctgtaggacaaggccaccacctgctagatagaataacatgaaaacaagactcatgggcttgggtagcttctgggaagcagcattggatggggatggcggagtattcattcccacgaggacaggcaacccccagaggagaggccctgctcacctgctccccaccgtgggctcagcgatgcccctgtcctgcccgctcctctgccaggagggtgtccggatccttactcagtcccacagtggaggtagctaaaagcccttgtgataggaggaggcagaatccaggaccaggagaggtggggagagcaaggcaaagacagctctgagctcagactgcaggctcccactgcccagcgttcctggtttcaggctaggagaagaaactgggaggtggggattagagccagtaaggggcttgtgggcagtagagtagggggtggataccagaggaggaggcccattcaagagaaagccagccaccagaagttctgggaggaacccacctctttgtagcatcaggacaacccaggtgcctgataaataaatgaatgaaaggaacggggtatccgttccttccacagccagagagggaagctagcgccttcagcatcctcacaggcaggcacaggggccttctccacacaactaggaaggggtgcctgcggttagatgggggaactggaactggcttcccagcacaccaccccttgtgactttgagctgtggaactggccagacctgggttcaagtccaccgcttagtacctgtgtgaccttgaggaagccacctaacctttctgcagctcagttgctgcatctgtaagagtggaaataggaataagaatgcctgtcttaggtctgtggtgaggatttactcaacctattcttcatggaacatctaccatggcccaggcacctccctaggtcctgaagctctggggtacacagagagagccagtgtgatggggaaggcaaaagagctgggcacagatggctcatgagaagtgcccgctatcatgttttacttttttttttttttaatttttttttgagacagagtcttgctctgttgcccaggctggagtgcggtggcgcaatctcaactcactgcaaccttcatctcccaggttcaagcgattctcctgcctcagcctcccgagtagctgggactacaggcacctgccaccacacctggctaatttttgtatttttagtggaggcggggtttcaccatgttggccaggctggtcttgaactcctgggctcaagtgatctgcctgtctcagtctcccaaagtgctgggattatagacatgagccaccgtgaccggcctatgttttactttaaatatgtaagagctctttgcttttagctatgaaaatacagaaaaaaaataataaatattattggtcatattggcatatatgagacctcagtaaataagagctcttatgatgattctgcttccccccttttacagatggggaaactgaagttcagagcagggtgggggtttttctagggtcactcagggaaccgtctagaagggagcagtgaaaagaggggaacagatgcttcctccaggaagagggtcttcttgccctcgcagccccttcctcacatgccctccttccctgccctccggagcccccggacacgtgaaggggagggagagggggcaatgggaggaacccacccccacccctggctcacaggtgccaccgcccccactccctgccctggccccaggccaaagggacttttcatgacagctcaaatgagacctctgagtaaacttggaacttctgaaacgacctgagaatattccccaggctggggggcaggggccacaaggagggcccccgactgcccaggacatctgcatcaggaacccagcctgctgatctctgcagcccacaggaaggatctggccaccccgacccctgccctgaattgtccccggggagttggggcaagtgcaccagcccgggtcctagcccaggcccctgccatcccccactgtgtgaacaggacaaggccctgggcctctctgggcctcctttccccatctgccaagcgggcttgactaggacgagggcttgccaactttccccagaatgaatcagtaacaccagtccactttggccagggccagggcgggctgatgggggctgctgggaactgaggggagagagacggtgggtggccagctccgctccatctcgtggcatagttcaaagcctcctttcactgctctacaagcggcccctcctgggctggaggaaatggagctggagtgagatctggctgcagaggctgagagattgcaaggtttgggcaaggctgcagaggatggcagggcttgcagggagatagagattgcacaggcagcgggggtggggagtggggggtgcgggtgctgggactgggacctcatgctccacagctaggagaggttgcacaggctggaagaagtgccaggagggaaagattgctggagctaatagagatttgctgcctggctaggagagagagataggctgagaggtcgcacagcctcagaggttgcacgagctggggaggagaaggcccttcctctcaccttcgtcttctactgattaactgtaagcctgaggtccccaacatacctgccttcagacacccataacccaccccttgccactggcgaaaaaaaaaaagatgaaaagcaactaacactaaccacacacctaatactaaccacactaacctgcctcacactccgcatccaggctaagcctgctgcccccattccacagatgaggaaagctgaggctcaaagaaaggcagagatacggccaagttcccactgtgagtgaatggcagagtctgctttctgacccagggccactgggctagttcttccccagcctgagaacccactgagatgagaacttgctgtgtgaccctgggcagcccactgtccttctctgaaagttccttgttactaatctgatgacattagtcatgattattcacactctggaagcagaagatgttgcctgaggtgggtctggggggagtttctggggacagtgaggaagctaatgaggaaagcaggacctcttaggggctgtctccatttttagcctcattcattcattcacttaacattcttcttcagctacttatggggcacctacaggtccccttctctgcactagggatactgtgctgaacaaaataggtcaattacccagcctctgagagctcatgcttcagtacagaaacaagttacaaacacatacacagagacatttacaaaacgattcctcatcttacacctgctatgaaggagacaaactaggggatgtgggctacagagatctgtggcgtagacccagttcagatagggttgcctctttgaagaggcaacactgaacttgaaacctgaggatgagaaaggaaagaagctgggggaaaagcattctaggcagagggaaaggcatgtccaaaggccctgatgcaggaaaaaaagattgaagcattaaagcttttatcctcggccaggtgcggtggctcatgcctgtaatcccagtattttgggaggccaaggagggtggatcacctgaggtcaggagtttgagatcagcctgaccaacatggtgaaaccctgtctctactaaaaatacaaagttagccaagcttggtagcccatgcctgtaatcccagctacttgggaggctgaggcaggagactcacttgaacccgggaggcggaggttgcagtgagccaagatcgtgccactgcactccagcatgggcaacagagcaagactccatctcaaaaacaaaacaaaacaaacaacaacaaaaaacgtatcctcaccaaatacataaggctctcaatcccctaaagctccagaaaaatgggtcaaaaagggtaagatttaactttggagtgtacggtctacataggtcttaacattgaggataatgtttgttcacaattcgtttccatagaaagcattctctttcatttagtcactcatgtagcaaatgttttgagcacccactgtaggcactggttagttactggggattcagcagtaacaaagaaacacactgtccctgcctagatggtgcccagaatatagatgaaaacaccatgagctatgtactatgtggagggtggaccccagaggaaggagtgactcatgctctttggagaggtcaaagattgacagaggagctgccatttgaatgggattttgaagactgagtaggaggctaacagtcagtcaaaaagggcagatagtttccgtggctaaaacagcacatgcacaggtgtgcaagccaggtgaatggagcatgttggtgaggctgtcagtggtctgatgagcctgaagtccagtatgaatactgggggctagatcccgaaatgccttgaataccagacaaggaatttggggtttttcttttgtggataacagagagccatggaatgacacggttggagtaagaatggagttggaggaaccacagctctgtagctatagcaggaaggtcagagaggaggaccagcaggagagcaggtgggcagaagtccttgaagaccctggataactttaggagttctttcttctgtgttccctctcgggaagtccctccgccttaacacttcctcttctggtgacctgttggctcctgttcctggcacttctggggagtccctcttcgcccacctcatttctttgtgatccctataggaaatagggccattttacttttaccacactacccacctttcactttcagccccatgtccctacctgggtcacattgcagagaatggccgacttgaggaactagacgcatcccattcctcaatcgtgtgacagaaaaaagatacagggaaaccaagaacttgggttctttccagtgtggggaggttgtaaataatggctgctatgaacatgctggtacatgtctgcttgggcacatatgcttgcatttctctttggttatataacttggaagtggaaatgttgagtctctgctcagcagaagttttccaaagtggttgtgtcgatttacactcttaccagaatattgagtagagacagagagtttagttactctgtatccttttcagcacttggaattgtgtttatttctctctctctccatatatatatttataaaaataaattatatatgtttattatatataatttatattttataaatatatataatatttataaataaatatttttatatttatattttattataaatttacatatatatataattctttccctcttcctctttcagtttcttttccattctcttaatggaaacttttgatcaataaaaaatcttaattttcatgaagtttatttataaatctttctttatgaccagaactttctatgtgctgtttaagaagtgttgcctgcaataaagtgataaaaatattattctgtgttttcttctagacgatttactgttttacctttcacatttaggtctacagtctatctgtagtttatttttctgtatggtgtaaggtaggggtcaaggtttactttttccatatgaatattcaattaatataccatcatttaagaaaacatgttttctctccactgccttgcactggtgacttactgaaaatcaagtggttgaatacatgagtttatttctactgtttctgttcttttccattggttagtttgtttttccttgcaacaatgccatactttctaaattactttataaatcttgacattcttcttcaaaattgtctaaactattttcagtcctttgtatttctatataaattttagaactatcttgtcaatttccaccaaagaaaatcttgctggagatttttttcttgaaactttggattttactgaaactttacttcaatttgggggggactagcatccttaaagtattaaattttccaatccatgaacatagtatgtaccaccacttatttatgttttctctaatttttcttagtaatgtcttgtaggtttctgtgtagaagtcttgtacatcaactaggtgcagtggctgacacctgtaatcccagcactttgggaggccaaggtgggtggatcttttgaggtcaggagttcgagaccagcctggccaatgtggtgaaaccctgtctccactaaaaatacaaaaattagctgagtgtggtggtgcatgcttgtaatcccagctactcaggaggctgaggcagaattgcttgaacccaggaggcggaggttgcagtgagcagagactgtgcctctagtgacagagctgagtgacagagcaagactccatctcaaaaaaaaaaaaaaagtcttgtacatctttcattagatttcttctcggatatttgattttttgatgctgatgtaaatggcataattttaaaatttcttgactgtttgtagtgtacagaaatataatgagtttttatactttacaactttattaacactttttaaagctaaagttccagatgttaaaagaaatagctatcaaacccagcccacttcaactgaccaccagttgagggcttcctgcctttctttgcttttgtaatgtttatggatcctttcctttgctaatctaacaagagagggtattgtagtgcaaagtatagtgtcccgggtttggattttattaaccagtagatcttttttacccttaacaatttttagatgtgcagtacaatattgtaaactgtatgcacattggtttacaagagatctctagaactttttcctattgcatgggtgaaactctatacccattgaaaaacaacttttcatttctccctcccccagtccctggcaatcagcattccactttctgtttctatgagattgattactttacatacatcatataagtgatacaatgcagtatttgtttttttgcaattggtttatttcactttgcagaatgtcctcaagaagcatccatgtcgtaacatatgacaggacttcctcctttttaaagtctgaataatattccattatgtatgtactacattttctttatccattcacctatcaataaatttaggttacttgctcatcttagctattgtaaataatgctgcagaaacaggtgtgcaaatatctctttgagatgctgtttttatttcttttggatatatgtctggtatttctatttttttaattaaaaaaattttttaaagtttcgcatcattttacaatcccactaaaagtgcacaagggtttcaattctctacatcttcaccaccatttgttcttttctttttttttataataaccatcctaacaagtgcaagatgatatctcattgtagttttaatttgtatttccctgatgattagtgatattgagcatcttttcgtatgcttaatgggcatttgctgatcttctttggggaaatgtctattcatgtcctttgtccttttttttttttttttttttttttttgagacagagtcttgctctgttgcccaggctggagtgcagtggtgtgatcttggctcactgcaacctccgcctcccaggttcaagcaattctcctgcctcagcctcctgagtaactggaattacaggtgcctgccaccatgcctggctaatttttgtatttgttagtagagatgggatttcgccatcttggccaggctggtcttgaactcctgacctcaggtgattcgcccgcctcggcctcccaaaatgctgggattacaggtgtgagccaccacacccggccatttttaaattgagttatttgtttttgtgttgttattgagttgtaggagttctttgtatattctagatattaaccccatatctcttgtatggtttgcaaatattttgtcccattccataggttgccttttgattccgttgattatttcctctgctgaacagaagttttaaagtttgatgtagtctcatatgtctatttttacttttgttgcctgtgcttttgttatcacacacaagaaatcattgcccattccaatttcacgaagattttcccatatgttttcttctaggagttttatagtttcaggtcttatgtttgggtctttaacccattttgagttaatgtttgcatatggagtaaaataaggatccaacatcattcttttgcatatggatatttggttcttccagcactatctccttgaacaaacttccttttccctcttgtatagacttagtgcctttgtagatcatttgactatatacacaagggtttatttctgggctctctattcttttccattggtctgtatatctatctgtatgccagtaccatactatattgattactgtagctttttaatacattttgaaatcaggaaatgtgaggcctccagctttcttctccttctccttctccttctccttcttcttcttctttttttttttagagtgttcttctttctcaagattattttggctatttagggtcccttgaagttccatatgaattttaggatgaattctttttttatttctgcaaaaactgtcattgagattttgatagggtttatattaaattcagttttctgtgagtagtattgtcatcttaacaatattaagtcttccaatccatgatcatgggatgtcttttcacttatctgtgttctttaatttccttcaaaaatgttttatacaagtctttctcctccttggctaagtttattcctaagtacttttctctttttgatgctattgtaaatgaaattttttgcttaagtttctttttggattgtccattgttaatgtaaaaaatgcaactgagttttgagtgttgactttgtatcctgcaactttgcttaattcatgtattagttctaaccatttttttaatatttagggtttcctacatataaaatcacgtaatctgtgaacagagataattgcatttcttcctttccaatttagataccttttatttctttttcttacctaattgctctggctagaacttccagttgaatagaaatggcaagtgtgggcatccatgccttgttcctgatcttagaggaaaaggtttcagttttttactgttgaatatattcactgtgggctttttatatataaactttgttatgttgaggtaatttatttctatttctagttccttgaatgttttctttatcatgaaagagtattgaattttttcaaatactttttctgcatcaggtgagatgaccatgtgatttttgtccttctttgtgttaatttcatgtattacatttatctgatttttgtaactatccttgaattctgcagataaatcctacttggtcatggtgtatagccttttaatgtgttgttaaatttggtttgctagcattttgttgaggatttttgcatcagtattcatcaagagtactggtctatggttttgttttcttgcatctttgtctggctttggtactggggcatcataaaatgagtttggaagtgttccctactgttcaatttttggaagtgttagggatgaattggtgttgattctttaagtatttggtagcattctctagtgaagccatttggtcttggccttttttttttttttctaggaggttttcgattactgattcaatctcctttctagtttaggtctgcttagattttctattttgtcatgatcagtatgggtaggttgtatatgtctaggaatttactaatttatttgaagtatccaattcgttggcatataattgttcatagtagtctcttagaatcctttttatctctgtgacatagttacaatgtctcctctttcatttctgattttagttaatttgagtcttctctctttttttcttagtttaactaagggtttgtcaattttgctgattgttagaaacacaatagatttttatattgatctcatcttcagcttctttgaataataataacaattattattctaatagtttatttgttgagtatcgtggacttttctggttcctcaattcttatataacttaaacacatagttttctaatctttataaattaaaagtttcttatcattgccttattatgttaattagcacctctagtataagatgtttttgtttttgccctgacctcagtaaggaagtgttcaatatttcacaattaaggataatgttagctatgtatagtgtgtgtgtgtgtgtgtgtgtgtgatcgtaattagattaaagaagactcctctatttctgctttcctgacaggttttaaaaatcatgaatgggtgttgcaatttattaaatgtgctttctgaacttattaaatgataatataaattttcttgtttattgagttaatgtggtgaaattgattatggtttctaaatgtcatactaaccttacattcctgaaataaaccaatgtgataataatatgttatccatttttataaatattattagatttgacttgttaatattttgtttcagatattttttagattatttatgggaaagattgacctgtaattctactttcctttaatgtcaagttttggtattaagactgccttttatttcagacatcaatgaaagcactgatgtgtctgggattatgtctaccatcttgctatttgttttcttttttgacctatctattcttccttctttgttctagtttttagaaaatcaagttttaaaaattattattccatttttcctattagtttgttcattgtactttcttttatattctttttgtgcttatcttagagattacaacatgcatacttattattattaggatctacctaatatgaattcttccaaaagttcatggaaaattcaaattatgaaaaaactatgcataaagttcaaacttttttctgcaccaaaataaacttgtactaacttgctataacatgtctgaacaggatctagtttgaggcactaagaaggataaggcgtctgtttgcaaaaaagcccctatcattgcaacatgaattctgctaaaattgaagcaggaacaaacatcaaatttatggtgcaactagggtggaaggatggcgaaatcaatgataaagataaagccctccgtggccgatcatccatatcaatttgttaggaaaaaattcatcttgttcatgccctaattgaagaggaccaactattaacagcccaaacaatagccaacaccatagacatctcaattagttcaggttacacaattctgaccaaaaaattaaagttgggcaaacttcccacttactgggtgccaaaccactgtgcccagatcagctgcagacaacagcagaaacttccatgcaaattttaaactaataggatcaagattcagaagcatttcctcacataattgtaacaggagattaaacgtggctttaccagttcatcctgaagacaaagcagtggctccaaagaggtagacgaggttcagtcaagacaaaagcagaccggtcaagaaaagcaaaggtcatggcaaccggtttttgggatgctcaaggcattttgcttgttgactttctggacagccaaagaatgataacatctgcttatcatgagagtgttttggggaaattagccaaagctttagcagaaaaacgcgcaggaaagcttcaccagagagtcctccaccatagcaatgctcctgctcattcttctcatcaaataagggcaattttacagcttccatgagaaattaggcatccaccttaaagtcctgtttggctccttctgacttctttttgtctcctaatcttaagcaatctttaacgatcacccatttttctttagttaataatgtaaaaaagcctgcattgacatggctatattcccaggaccccccagttctttggagatggactatgtgcctggtatcatcacttacaaaagtgccttgaccttgactgaatttatgttgagaaatagagtttattttttaattgttatctttaattccatgtttccatgagctttttgaagtcctcttgtacaatttgaagtcctcttgtacaaagtcctctttaactttattcacctcttcttacctttggggtttcatggtcgtgtattttaattctgcatatagtttacatcattagtatgttaagaaattaaaaatcatagtaattcacttatttatttatttattttgatacagagtctcactttctcacccaggctggagtctcactttctcacccaggctggagttgcagctcactgcaagctccaccttccggattcaagcgattctcctgcctctgcctccctagtagcctacactacaggtttgcgccaccacacctggctaattttttgtgtttttagtagagactgggtcttgccatgttgtccaggctgatctcgaactcctgacctcaggtcatccacccacctaggcctcccagagtgctgggattacaggcgtgaaccaccgcacccagcctaattcatatatttagagtactttctgttgctcttcatttcaccctacagtaacttgcttcccatctggaattatttttcttttacctgaaaaactcactgttgtatatctcttgatgcaggtctatcagtgacaaaatctcttacttatttttgtctgaaaaaaaatccttattttgccttcattttcaaaaatctgtatttcagatgtaattcacaaaactgaaaatgtactcttaagatgtgcaattcaacaaagttgtgcagtcatcaccactaactctatattttcatcactccaaaaacaaacctacatccattgctgttactctctatcccccctcccctcagcctcagctcctggcaaccactaacctactttctgtctctatggatctgccaatgctggacatttcatacatatggagtcatacaatatgaggccttttgtgtctggtgtctttactttagcatgaatttttaaagttcatccattttgtagcacgtatcagtagttcattcccttatatggctaaataacattctactgcatggatatactacatttctttatccattcaccagtcgatagaaattttgcttgtttccagttttttggtattatgaataatgttgctgtgaatatttgtctacaatggtttgtacatttctttctggacatatatccgcaattgttttctttcctttttctttcttttttcttttcttttttttttttttttgagacagggtcacactctgtcacccaggctggactgcaatggtgtgaaaacagctcactgtagcctcaaactcttgggctcatgtgatcctcccaccttagcctcctgagtagctggggccacaggtacataccaccatgcccagaaaatgttttcattttaatttttgtagagatgaggtcttgccatgttacccaggctagtctcaaactcctgggctcaagcaaccctcccgccttggcctcccagtatgctgggattacaggcatgagctactgcatctggtcaattcttttcactatataactaggtgtgaaatttcttggtcatatggaaacagtcatacattgcttaatgacgaggatacattctgagaaatgtgtcattaggtaattttgtcattgtgtgaacgtcatagagtgcacttacacaaacctaggtggtatagcctactacacacctaggctgtatcttacagcctataattggctacaaacctgcacagcatgatacggtactgaatactgtaggcaactgtaacacaattgtaagtatttgtgtatctaaacatagaaaaggtacagtgaaaacataatataaaatatgaaaaaacggcacacctgtgtagggcacttaccatgaatgcagtttgcaggattcgaagttgctctgggtgtcagtgattaagtgctgagggaatgtgaaggcccaggacattgctgtacactcctgtaaactttatcaacactgaactcttaggctactctaaatttatttgaatttttaaaataataaattaactttggcttactgtaacatttttcctattttatttattttattttattttattttattttattttattttattttattttattttatttatgttattttattttatttaagacggaggttcgctctatcgcccaggctggagtgcagtggcgtgatctcggctcactgcaagctccgcctcccgggttcacgccattctcctgcctcagcctcccaagtagctgggactacaggcgcctgccactgcgcccggctaattttttgtatttttagtagagatggggtttcacgtgctaaccaggatggtctcgatctcctgaccttgtgatctgcccgtctcgcccttccaaagcgctgggattacaggcgtaagctaccgcgcccggccctattttatttcattttttgagacagagtctcactctatcacccaggctggagtgcagtgtcgcgatctcagctcactgcaacctccgcctcccaggttcaggcaattctcctgtctcagcctccagagtagctgggactacaggtgcgcgccaccacgctcggctaatttttttggtatttttagtagagacggggtttcaccatgttagccaggatagtcttgatcacctgacctcgtgatctgcccgccttggcctcccaaagtgctgggattacaggcatgagccgctgcgccccgccaacattttttctttataaacattttaactttttaaaactttttgaataacacttttgtaataacagttatcttattgtaataacacttaagtgttttcgtgcactcttgtactaacacttaagacacaaacacattgtacagctatacaaaatatttttctttatattcttattctaaaagcctttttatatattatattttaaaattttttattttttatttttttacttaaaaaaatttttttttgttaaaacctaagacacgcggggcatggtggctcatgcccgtaatcccggcactttgggaggccaaggagggcggatcgcctgcaatcaggaattcgagaccagcctggccaacatggtgaaagccccatctctactaaaaatacaaaattggccaagcatggtggcgggcgcctgtaatcccagctacttgggaggctgagacaggagaatcacttgaacccgggaaaaccaacaccacgccattgcactccagcctaggcaacaagagcaaaactccatctcaaaaaaacccagaaaacaaaaaacaaaaaatctaagacacaggcagacacattagcctaggcctacacagggtcaagatcaccaatatgactgtcttccacctccacattttgtcccactggaaggtcttcagtggcaaaaacacacatggagctggcatctcctatgataatgatgccttcttccggaatccatcctgaaggacctgcctgaggctgttttacaagttaacattttttgtttgtttttaagagtcttgctctgtcacccaggctggagtgcagtggcacaatcttggctcactgcagcctccacctcctgggttcatgcgattcttgtgcctcagtctcacgaatagctggaattacaagcacacaccaccgtgcctggctaatttttgtatttttagtagagatggggtttcaccatgttggccaggctggtttccaactcctgacctcaagtgatctgcctgcctcagcctcccaaagtgctgggattacaggcgtaagccactgtgcccctccaacatttttttttaagtaagtacaaggagcacaccctaaaatagtgatttaagatatagtatagtaaatacatacaccagtaacatagtttattattattattattattattattattattattatcaagcattatgtacaatacataattgtatatgctatcttttttttttttttttgagacggagtctcactctgttgtccaggctggagtgcagtggcgcaatctcggctcactgctacctctgcctccccattcaagtgattctcctgcctcggcctcctgagtagctgggactacaggcatgtgtcaccacgcctggctaagttttttgtgtttttagttgaaacggggtttcaccatgtttgtcacactggtcttgaagtcctgacctcaaatgatctgcctgccttggcctcccaaagtgctgggattacaggcgtgagccaccgcacctagccctgcatatgctatacttttatatgactggcagtgcagtaaatttgtttccaccagcatcatcacaagcccatgagtaaagtgttgtgtcatgacgtcactagacaataggaattattcaccttcattatagtcctatgggcccgcctatgtacatgcagtctgtcattgaatgaaatatcattatgcagcacgtgactgtatttaacattttgaagaactgcaaaactgttttccacagtggctgcaccattttacattctcaccctccgccccctcattcacacttgtgattgattattattattaccatcctaatgcatgtgaagtggtatctcattatgttcttgatttgcatctctctagagagtaatgtcaatggccaccttttcatgtgtttgttgtttggatatcttctttggagaaatgtctatccaaatcttttgcccattttaaattttaattcttgccttttagatcttgagttgcaagaattctttgcatattctaaataccagacctttaacaaatacgtgatttgcaaatgctttttttcccatgctgtatgttatagttttactttcttgatagtattttttgaagcacaaacattttaaattttgatacagtttaatagatctattttttctttgtttacttatgcttttgtgtcatatttaaaaaactattattgtctcatacaaggtcatgaagatttacacctaggtttattctaagagtttaatagttttactttttacatctagtctttaatctattttgagtaaatttttgtatacggtgtgaagtagaaatctagcttcattatattgcattgtggatatccatttgtgtggtaccatttgttttaaagactattctttcccccattgaattgttttggcaccctcatcaagaatcggttaaacataaatatatgcacttctttctgaactctcagttcaatcccattgatctatatgtacatctatgtgtcagtaccacagtgttgataagtgtagctttgtagtaagctttgaaataaggaagtttgactcctccaactgtgttctttctcaaaacctttttggctattctagtcccttacatttccctataaattttaggactagtttgtcaatttctgcaaaaaaaaaaaaaaaaaaaaaaagagccagctgggattttttatagagattactttgaatctgtagatcaatttgaggcgtcatcttgataacattaagttttccaatctatgaacatggtatatcctccatttatttaggttttctataatttatttcaataacatttgtaggttttattgcacaagtctcacactaataaacaaattcatctcatattaacataactaatgaattttgttaaatttactttaaccattttgttctgttttgtattattgtaaatgaaatcactttcttaatttcatcttcagattatttattgccagtgtgtataaaatatcattatttgtgtctattaatcttatattctacaactaggctaaatttgtttattagctctaattggtttttgttcgttttaggtgtaaattcctttagttttgtatatacaagatcatattatctgcaaagagaaatggtttacttcttcctttccaatctgaaagtcttttatttcttttccttacctaattgccttggctagaacctctagtaaaatgttttataaaagtcacaagagtgaacatacttgtcttgttcatgatcttaggagcaaagctttcatttctttaccattaagtatgatgttaactgtaatatttttatagctgtctgtatcatattgaccttacttttattttttaagagatttttttctggatataaaattctaaattggcttttgaaatttcagcattgaaagaagttgttccattgtctgctgtcttccatcattttgttaaaaagtcccctgccagtcttattgtttcttccttgaaggtgaagtgtcttttttttctgcatactgcatatctttgtcttttattttttaaaatagtttttctatgatatgcctagatgtggttttctttgtatttatcctatttgtggtttgtagagctatttaaatctgtggcttaatgtcttttgttagtttggaaaaaaattttaagatcactgctatttcttcttacttgttttctctctcttctgcttcttaattgcaaatgcatgtatgttagatcatttcacaatgtcttctatgtctcttttgctcttttctgtatttttgaactttttttctctgcatgcttcaatcttggtattttctattgaccaatcttccagtttactaatcctctcttctgatgttactagtatgttgccaaatccatctcttcagtccttataaacttcagttattatatttttcagttccaggatttctactttttaaataggttccaaatttctgatagaatttttgaacacattaatcatagttattttaaatcatatctgataatgccattttccaattcacctaagtaacttttctattgtctattttatcttcattgttgatcatttgatactgcttgttggtttaccttgtaattttaactgaaagttggacattatgtataaaaagtatagaggctttggatgaagctaactttttctagatcaatttaaattttcttctagcagacatatagcatataagcagattacaccttgatgcagtcaagaatgaactatttctaatttttccttattcccaaggaatagtattttctaaatagctgggtactcaccagggcccatcttttttttgccaggccctgaactctaattcttccctcagcttgtaaaactgtgaaaattccttcttagttttcccacctattagcaggtgtttttttgctaagtttcttggcatgctacttattttcaatgactttgcacatgatttgaggggaaattgcatgcagaatttcaatgcatttttcctctcttaagtactatataagttggcactctcttgtgcagtttttttttttctgcttagtagttgccctcagtgggaggattagtgtgacaacagctacttcattatagccagaagtggaagtccctcatccatattttattttacaaaactaagcctcacttacatttaaaatggtatgaaatagtttgaacatacaaaagggcataaaatataatcaacacccatggtagcttcaccaagctttaccaaactgttgagacccttgaacattcctccttctcacaccccctccttttccacactattcaaaatttgatgttattatccccatgaatttttaaatatttttatgatgggtgtgcttacctaaacaatatataggatgattttgtatggttttcagtgtggtgtcaatggtgttattatgcttatgctgttctctaacttccttttttcactccaaattttgtttgtgagagtcattcactttgttgtgtgtggctgtaaatgattcatgtttacactgagtgacagtattgcgatttattttttcactctcctgatgatggctatttagattgtttccaatttttcactattaaaatcaatgctgctatagacatgcaggaagaatttctttaccagtttacataagagtgaagttactgggttttaggtagggcatgtgttcgcttttattaggtcatgccaaactttttaccagaccagttgtaataatttacatttcctctggctataaatgagagttcctattatatcatatcctgagcaatatgtgatgtcatcagactttcagtttttgccaatccgacaaaattaaaatggtatgtcattgtggtttttctttgtatttcttttctcttctttttcttttttttgagatggagtctcgctctgtcacccaggctggagtgcagtggtgcaatctcggctcactgcaacctccacctcccgggttcaagcaattctcctgcctcagcctccagagtagctgggattacaggtgcccaccaccacacctggctaatttttgtatttttagtagagatgggtttcaccatgttggccaggctggtctcgaactcctgacctcaggtgatccacccacctcggcctcccaaagtattgggattacaggcatgagccaccacgttgaccatgaagttaagcaccttatattctccatagcactcacttcaatctaatttcctgccccaagcttctccatttccccagaatctcttgaaatttggtcaacttttagggtgaattacagcaactccaggaaacatttctcagcactgaaactggtggataaatgcacctacaggacttcaaattcgatgacacttttaatgctcatgacaaacctgcagcaaagattgatgacctccattttatggatgagaaaacagagaatcagaggggttagagaacttgcccaaagacgcacagctgggacctggcacactccaagtcaggtgcacttcactcctccgtaggagactgcagaggttgggtgctgcagcggtgtgtcaggccattcttgcattgccataaagcaatacctgagactgggtaatttataaagaaaagaggtttaattggctcatggttctgcaggctgtacaagcatactgccagcatcttctcggcttctggtaaggaggccctcagggagcctttactcaaggctgaaggtgaagcagaagcagacacatcacatagcgacagctggagcaaaagggggaggcgccacgcacttctgaacaattagatctcaggtgaactcactcatcaccaagcggatggcactaagccattcatgagaaatccgcccccatgatccaatcacctcccaccaggccccacctccaacattggggatgacatttcaacatgagatttgggtgggacaaatatccaaaccatatcaaggggctcctgtagcaggaagcctcctaagacaccttctgtccttgtaggaaacacacatggtggcccgatctgtatctgaggataaggtgctgttgccctcaggggtcagcctgcgtgcaaagacccaaaaggggatggattcggggcagagaaggcagtggaattagggtaggccccatttggtgctgtgggagcatgaggagggagtgatggagaaagtctgtgtttttaagctgatgtttcccagaagtgagcagtttattttaaacagtgttaaatatccctggatcccctagtgaaagcgtaggctctttcatcacttgccctgctgatggaggaggcaagattctcaatttggtgctatcgcatcttaaacactactctctctttttttgtgttttgttttgtttttttttgagacagagtgtcttgctctgttgcccaggctggagtacagtggtgtaatctctgctcactgcaacctccgcctcttcctgggttcaagcaattctcctgtctcagcctcctgagtagctgggattataggcacacaccatcacacccggctaatttttgtatttttagtagagatggggtttcgccgtgttggccaggctggtctcgaactcctgacctcaaatgatcctcccacctcggcctcccaaagtgctgggattacaggcatgacccagtgtgcccggcctccctttcttaactttaaacaaagacaaaccacatctccagtttctaggactctcaggcaggcagtagcatgtcactaaaattcaattactgcctttgtttttcttgtatttagtttttatgttgtattgtatttagttttatggtaagttgattgttttgtttaagtaacacttatataatatctgctatatgccaggcactgttctaaatgctttataaatgttgactaatttaattctcccaaagacctatgaggcaggtgctgtgattatcattactcccattttacagatgaggcccagaaaggttaagcaaactgcccaaggccacaaagcctataagtggcagagctgggatttgaactgagaccagccagctccatagtctgtgtcttgaccagcatggcgcacactgcctatttcatgccagttatctgctgatggtcatgatataatatttttgagacatgtttattggagtaaaaaataggaggcaaggtaaagatcaatagtaagtggataattaatagtagcaccagtgaaaacctcaaacgcaataggctagtggcaggagttctggaacactccagtgtggctgcagggatacagcacatggaccatgaaagttgagttgagaggatgggaggggaaaggtgttggagggcaggagtctgctccagcagaggcaaagatgcatgacgaagcctgggctgccggggagacgatgagtaattcagggcagtcagccagtaatggcaggaaacccgtgcactggtacagcacttcacagtccgtgaagcactaccacatctgctttctcacagcctcttcttcactgccaggtgcagtgagcactattgtccccatttcagagatggtaactgagttcagagaataaaagagccagagaagagctactatttgcttcaagatcttctggcttcaaattctgagcccttttctcaactccactgtgtcagggatctttggtggcaagtgacagaaatagaattcaacatgattaagcaacataggtggtttttggctcatgggaatgagaaatccacagggtggacatcagatatggctggatccaggacctcccatgatgccatggggactcctgacctgtatttctcagtatggctgtcattttcaaggaggctgtctctaagaggtgacaaagatggctacaagctctgagaagataccaaaaaaagtgtcagttttctagagttctagaaaaaaaatctcaggactgctttcactggccttgcctgggttgacatccatccctgatgcaatcactgtggtcagacagatggggtgttttgattggccaagcctgggtcaggagcccactttgtggagcatggggtggagtcagcctcaggcaaaccactagaggcagctcagatagaggagctctttgggaagagacgccgggcaggcagaagcagcaggtaccccctccacatccctagggctctgtgatgtaggcagaggtaagaaattaggagggatgaggagttttttgtttgtctgtttgtttttttaaagacagggtctcactctttcattcaggctggagtgcaatagtgcaatcatggctcactgcagcctggacctccggcactcaagtgatcctccttcctcagtctcccgaatagctgggaccacaggcacacagcacccggctaacttatttttacttctatttttatttttggtagagacaaggtcttgctatgttggtcaagctggagatgaggaatattgaatctgggcaaaggagtttgcactttttgctgtgctgtggtcaagataaaaccatcagggagtgacggggacagagctatgtcaggactcgcaccgtggctggggtgatggatgtggacagaatagtgagggggcagacacagactccccctcctgcgatcagaggccacatcttcaaagtgtgataacaggacctctgcaggggttggaatcacacaggattcatattcctaaaagcaggttgaaactgcatctacctcaacattattttatttgagtagtgatgttattgcttaggatgatgctggagttaaatttttaagtgtgcttatctatagaaaatatattaaaatatgtattaaaataaacaacagtgcacacaatatacaaatatggccaaaattttggatatgagatattttggcaactcttggctagatcattctgagaccccctctgtttctgaggctctaccttctccatcaattacagctgttgtttgagtgtttatgtgatgggggccatctgcagggttttatgcaaatcacctccttgaattctcacaagcctggaagcaggccttgctgtttccactttacaaggctcagagagggcaagggactggcccggagccacacagctggtcatctgaaccttcctggccccccagcctgtgccctgccccagggttctttgatggctctgtgagggaggtcagagggaactatggatggggccagagtaggatctttgggaaccccggcacagaggaggaggatcttccccttgtggagtcagggatggcgtctggagaaagccatgcctgtgacttgggtcctgcatggggcatccctcttaggtttagctttagctccattcttgtctataggggctggtctgggaggggctcctgagtctgggcaggtggaccactgccctctggctggcacttcctcaaacagacacagagctggtgggtgaaacagacaagtcccaggagaagcctggcatcgccagactggtggggcattcctctgcccaagacagtagagggcactctttctggataaactcactctgctccccaaagaggttccttctccatcctggcccaaattaggaggtcaggttgtctctgtttggtcaggcctggatttcctagcatgctcccgagtgggctaatctgggctttgtgatggagtaaggagcctcattattgggctaaccttatcttaagtattcagcagtggttaactttgtgggttaactttggatttattattcagtaagaagccaatttattgatggctgggtgcagtggctcatgcctgtaattccagcactttgagaggctgaggtgggtggatcacctgtggccaggagttcgagaccagcctagtccacatggcaaaaccctgtctctactaaaaatacaaaaattagccaggcgtggtggcggccacctgtattcccagctacttgggaagctgaggcaggagaatcgcttgaacctgggaggtagaggttgcagtgagccaagatcgggccactgcactccagcctgggcgatagagtgagactttgtctaaaaaataaacataaaaaagccaatttactggcttttttttacaacatggatgtttataggaaggaagatccaaaattgctcctcagcagatccccctttccaaactagttttttctccttttctctctcccttcctctctttttccctccctctttctttgttagatagataaatacacaagtttaatttcacacacaatgctacatcaataggctcagcaagggcaaaatagtcagcagtctcctccctctttaaattcaccttgtgctgggcgtggtgactcatgcctgtcatcccagcactttgagaggccgaggtaggaggatcatgtgatcccaggagtttgagaccagcctgggcaacatagcaagatgccgtctctacaaaaatgttttaaaaattagccaggcgtggtggcacgtgcctttggtcccagctactcgggaggctgatgcaggaggatcgcttgagcccaggaggttgaggctgcagtgagccgtgattgcgccattgcactccagcctgggcaacagaacatgaccccatctctaaaaatattaaaataaaataataaaacaaattcactttgcatttgtgacgtgatggggcgggggcaggaagaaggtgggagaagggattcttggggtgaatctgccatttctaagaggtgggagttcttggggtcatccacaggcccctcgggatcttgcatttttcttaagacagttccaagaatcaggggcaagtctgcctgggaagagacaggatgagggggaggccgggggagccctgagcccgcctggctcaccctccactgtacgtctcttgcaggcccgtgggagtcagcatgccgcgtggctgggccgcccccttgctcctgctgctgctccagggaggtaagtggctgccccgtggtctgcgggtggggagggcccccatcacagagctgagccagggccgggctggctttctgggctcaaaaacacggctagagtccacagattcagaaaagatgacatccatgcccttgaggctgacacgagtccagtagccggctctccactaatcagaatccatccaccaaagggctccatgaaacagaagcggtagacatgagtctcaggtggcccagcccacaggcttgtgtcttcgggtgtcactggggggatgaaaggcttcgtccttcatttcccctgacctctgccttggctggctcccaactctctgagtgaggaagttctgccttccatctaacctcagtttctccttatgtaatgactctccttggaaatgtttttcaacaattgctgcaccgggtgcggtggctcctactggaatcccagccctttgggaggctgaggagggtaggtcgcttgagctcaggatctcaagaccagcctgggcaacatggtgaagccctgtctctacaaaagaaaaaaaattagccaggcataggagcgcatgcttgtagtctcagctttttgtggggctgaggcgggaggattgcttgagcctgggaggtggaggttacagtgagtcaaggtgacaactgtactccagcctgggcaacagagcgagaccctgtctcaaaacaacagcaacaacaacaacaataaacaaacaaaaaaatcgctagattcttagcaggcactggtggtccctgggctggggacaggaggaagagccaaaaggagactgaaccttggtaggcagcccccagaggaccagatgttgtggttagagggggtgacgttagaaagcagaactgggaagaccaggagtccgactgaaagggcactgcctaggactaagagatcctggagggcttcctggaggagggggccatgaggaggcgggatccagcacagacttgtgtggaggccggcctaggggcaggggaggaactcaacagctgctctgctgactcatgggcatttttctctggtttttaccagaagacccaggacctcaaatagctccttcaggaaacagatgtcaagctttgattttccctttctgagtggcaagcatcctcatcttggttctaaaaagcctttgggtcacccaccatggctccacatctggcgggtgcagataacaagccctggctgcatgcaaagctcggagcgtcatcccattccactgtcccaacagccccacaaggcgcatgttgtaatgacgcccagttttttggctgaggaggctcagagaggctaagagacaggtgcatggccacactacccggaagaggcagagctgggatcagtttgctcttggggtctgtcttagtctgtctgtgctgctgtaactgaatacgtgagactgggtaatttataaataatagacatttactgctcgcagttctggaggctgggaagtccaagatcaaggcaccagcagtagctttgattccggtgaggggcccatctttgctttttttttttgagactgagccttgctttctcacacaggctggagtgcaatggtgcaatcttggctcactgcaacctctgcctcccaggttcaagcaattctcatgcctcagcctcccgagcagctgggataacaggcacatgccatggctaattttcgtatttttagtagagttggggtttcaccatgttggccaggatggtcttgaactcctgacctcaaatgatccacccgcctcggcctcccaaaagtgctgggattaccgcacccagcccccatctttgcctttaagatgccacattgaacgctgcaccacccccagaggggacacacgctgcatcctcacatggcagaagggcaaaaagggtctgaatgttgggttcgtccagccctcttatagcatcaataattcattcaggggggctctgcccccatgacttaatcatctcctagagtccccaccttttaatatgatcacattggcaactgagtttctggggagacacagacgtcaaaccgtagcacggccttcaccatgctgtgctgctatctgtggagtgatagccatgtgcgggcagcatgcaggcacaggcatgatctcatctcaacacctcaacagcctctagggcaagcagtgtctccggcttacacatggggaggagaagcagttttgagtcacatgtttgcagtcacagagctactttgtgcacctctcactgcctcctgcacgctttcataaccccagacatgggatggccctggggctctctgccctgtggctggggtactgacagggcattttcccaccctctcatccctggtgccacctccctgccactcaggggctgccgttgcctccccaagtttggagacaaaccctgtcccttggtagctttgagcctggctaggaatggtagctcctctccaaattcccagagctctgagaaagaaccacgaggatacgaactcagagatgacacagctacttagaggctctgtgttgaggttttgccaaaatcagtcctgttttctccaccaagtgctggaactagctccttttcactccaccgacaagttctgtgtgtctccctgaggaaagccccctcctagagcaagatttacttccatgactcagatcccttggtagccactgcctcgagagaagttgagaagcattccgaggtcacacctaggggagggagtgctgtgatccattagcaatatctgtcatgtgtgcggctatgaaaaactagcacagactaggtatttccttccctgggtgagtgtctcagcagcccagaccaagagagacaagaggcatggtctagtcttggagcctcagtgttctcatctctacaatgaactaaaggatatttccagacacagtattcttggctccgcatataggttctgtcctagagtgagacccaggaagggaatctaccaccaccacctcaggggtcttcattagtccagggaaaataggaaaaagccaccaaaaatgaacctacttaaaaaggggaacaaggtcaggcacgatggctcattcttacaatcccagcactttgggaggctgaggcaggtggatcgcttgagctcaggagattgagaccagcctgggcaacatggtgaaaccctgtctctacaaaaacacaaaaattatccaggcatggtggtgcacaactgtagtctcagctactcaggaagttgaagtgggaggactgcttgagcccaggaggtggaggctgcagtgagctgagatcgcaccactgcattccagcctgggcaacagagcaagagatcctatctcaaaaagaggtgagcggtacaagtttctagtaaatagcagcaaaaaatagtggaattggcactcgaatatacaaaacaaagctacaaattattccattgattttgtccacatttaacaaaatgtagatgatgattgcacccctgttttagaacacagcgaaacaattaatgtttggggagcaggatggaaaggtgttaaatcttccaacaaaattgcctcatagggcaatacctagaagacttcttggtggcggtggcatttttggccgcaggatcacgcagacctttatgcaaaagtgtccgagggctttttaattctctcacggtttcctactccttgaagcacttcctgaatctccgagagtgggtgtcctgtggatccaacttctgtagagccgagtcctcttccttgtcagggttttgggacattttcagcatagctgtccttgactctatgaggtcctgaccctcttggggtgtgtgcgtgtgctctggctgggttcctaccacatctggggcatttaggatattgccattctgagtgggagcttggccaggagggacacagacctggtggccgggcgcagggctctggaggagggtgctgagctggggaccagctagttttatattatttgccatcacatgcatcctgtcttcatagccagccttgaaacattggtgctcaaacaaggaatttccaggtggtgaggccccctgggtgccaggcctacatctaagcagctcctgagtcctcatatttgtcccggcctggggacccctgcacccattcttcctccagccctcgaggggatggagaggaagctctgcagtcccaagccaccccccaccaaggcctctctccccactgaccctccaggctggggctgccccgacctcgtctgctacaccgattacctccagacggtcatctgcatcctggaaatgtggaacctccaccccagcacgctcacccttacctggtaagtagccgggcctcaccagtccccggggatgcaattcagggtgcctgctcagtgattcccccaggaggacactgtgcactgaggaccactgtgtccgcctttcagacaaccactcagggctcacaggacttgaaaagtcaggagcccgcagggttggtctatccaccagcttcaaaggccactctctcacccacacaggtcggccatggttttgagaccccgggatggctggtttcccgcatgatttttcaagcacttaggtaccaggcccccaactacacgcttcccatgaatggtcacccccaaccctcacaatgattactcccattttacagatgaggacattgaggttcagagaggttaagcaacttgcctaaggtcacacagccagtgaatgctggagctgggattcaaattcagaccgcccaactccaaagtccatgggtcccttttagaccctatgcagctcaggataaagaagagcttctgttatccatcagctcattcattcattcaaaaccatttataggccaggtgcagtggctcatgtttctaaccccagcactttgggaggccaaggaaggaggatcacttgagcccaggagtttgagaccagcctgggcaacatcacaaaaccctgtctctacaaaaaataaatcagtcgggcgtggtggcacaatcctgtaatcccagctacttgagagtctaaggcagggggaccaagctcaggaggtcgaggctgcagtgagctatgatcacgccactgcactccagcctgggcaaaaaagcaagatcccaactcaaaaacaaaacaaaacaaaacaaaacatgtattaagttcctgccagacactgttgcaggcactggggattcagcagagcaagactgaccaggccccagatgccttggaactgacgtaccacggtggggcggaggctgggggagacagacacacaaaacaaccaacaaggtgctttctcttttttattttattttattttattttattttatttttttgagacagggtcttgctctgttgcccaggctggagtgcagtggtgggatcagaactcactgtagccttgacctcctgggctcaagcaatccctccacctaagcctcctgagtagctgggactacaggcatgcatcaccatacctggataatttttgtagtttttgtaaagacagggttttgccatgttacccaggctggattcaaactcctgggctcaagcaatctgcccacctcagcctcccaaagtgctgggattacaggtgtgagccaccatgccaggcccaaacaggacactttctttctttcttttttttggagacggagtctcactctgttgcccaggctggagtgcggtggcatgatctcggctcactgcaacctccacctcctgggttcaagcaattctcctgcctcaacctcccaagtatctgggattgcatccaggtgtgcaccaccatgcctggctaatttttgtattttaagtagagacagggttttgtcatgttagcccacctggtctcgaactcctggcctcaagtgatccgcccactgtacccgcctttcagacaaccactcagggctcacaggacttgaaaagtcaggagcccgcagggttggtctatccaccagcttcaaagaccactctctcgcccacacaggtcgcccatggttttgagaccccgggatggccggtctgccgcatggccagcctcccaaagtgttgggattacaggcataagccaccgtgttctgccccaaacaggatactttctaataatactgggtgctatatcaaggacagaacactggacctcaggtaaagggaccacaactgctagtgagaaggaggaagccagggagctgggcagagggcactgccagtgcaaaggccctgtgggagaagagctggtgcgtttgaggaatagggaggaggtcagtgtggctggagtggagtgaggcagggtgagggggaataaggagcaagttcaggctgggaggcttggagagcatttattcagcaggaacttgtattccagcaaatttggcagagaactcagtccacacatccctactgggcctagagagtggtcatgttcagatcctgaacatctaggtagggaaattaatatccggtaaactactatacatacttcaaaacccatcatttttgtccagtgggagttaaaaagccacagcattttccctaatcccatcccaccaactttcccagaagtccacccagaggaggagatgaggttcatttagctcttttcctggccctcagcacaggctattattagatattcagtggatttggggactgggcgaggtggctcagtcctgtaatcccagcactttgggaggccaaggctggcagatcacttgagcccaggagtttgagaccagcctaagcaacatggtgggaccccatctctacaaaaaatacaaaaagttagctgggcatggtggtgcatgcatgtagtcccaggtactgaggaggctgaggtgggaggatcagctgagcctgggaaggtcgaggctgcagtaagccatgatcacactactatactccagcctggggccagagtgagaccctgtctcaaaaaaatggatgttggacagaaaggagagaaggaaacccaaaatgcctagcgcccttcctgcaggacagccatctggttgttgggaccaacagggacagatttaggcttagtccaagcaagaatggcccaaatttccaaaattgagagctgctgccctaaatgaggtagtgagttcctggcccctgggaggtgtgcaagctgagcccggacacaattcattgaggatgctgtaggggaggtgataccttccctgggaaaaggttggttggaccaggtgaccaccccccagccctgcctcaaatccctcccagccctgagagtctgggcttctgccctggccctgagcactgagcccaccaccatcccccctgcccctggcttccagccatgaccggctgctttgtccttgaaggcaagaccagtatgaagagctgaaggacgaggccacctcctgcagcctccacaggtcggcccacaatgccacgcatgccacctacacctgccacatggatgtattccacttcatggccgacgacattttcagtgtcaacatcacagaccagtctggcaactactcccaggagtgtggcagctttctcctggctgagagcagtgagtatcctgggaccccaggcttagggtggcactcaatcttagctcaccgcagccctgacctctctgggctcaggtgatcctcccacctcagcctcccgtgtagctgggacaacaggtgtacaccactacacccagctaatttttgtatttttagtagagacggggatcttgccatgttgcccaggccagtctcgaactcctgggctccagcgatccacttgccttggcctcccaaagtgctaggattataggtaggggctgggtcccctactccctgccctctgggccagctctcctccttccatcagatctgacctggcctatgtcctcactacaccttagagttctgttttgagttgcgctattttttactaaagtgtgaaaggttgataataggtttgagaggtattgaaggagctaggctgggacccgggacttctgggttcgtgttccggctcagctctgcccatctgtgtgaccatggatgaggcatacctacctctgggacagcttccctatttgtagagcaaatgtccttttaaccctgactttctgggatcctgaccccataatgaggcgaatggacgacactgagttacagaaaaaaaaaaccctcttgggttttttccccttcataagctccagggaggcctggaatttccctccaggctggaggtagaggggggtcccaggggcaggagggcctggttggtgggagcagttttatctgtgagttcagaattagggcaggtggcagggcgaggtggctcatgcctgtaattccaacactttggaaggctgaggcaggaggattgcttgaacctggggctttaagaccaacctgggcaatatagcgagacctcatctcaaaacacaaaacaagaaccagggcaggggccaggcactgtggctcacgcctctaatcccagcactttgggaagctgaggcaggtggatcgtttgaggtcaggtgttcgagaccagcctgggcaacatggtgaaaccccatctctactaaaaatacaaaaaaatttgccgggcgtggtggcacacgcccgtaatcccggctactcgggaggctgaggcaggagaattgtttgaacctgggagacagaggttgcaatgagccaagatcatgccaccgcactccagcctgggcgtcagagtgagactccgtctcaaacaaaacaaaacagaactaggcagggcatggaagggcctgggaggtggctttggcatggtgtgtgtgtgtgtgtgtgtgtgtgtatgtgtgtacccaaagcggccccagaggcaaacacaggctgcaaagggagcctgccctcaggaaggccccgcccatgagctcgggagtttctgccgctagattcccagcagaggggctggggtataagaggtgtctgtgattcacactctgggggtccaggtttgcacctctttgctgagtggatgtcacaccacagagcgtgagagtgaagcttcacacactcccagacacatgcacactcacgcaaattcccagggtcacagactcacgcacacacagactcatagatgcgccctcaaactcacagatgtctccccagccccagcctgcatggcatggacacagaggcccacactgcctctctctcttgctctctctcactctcatacacactcacacatacatacacacacacacacacacacacgtacacaatacacacacactcacacatatactctcacatcactcatacatgggcacacacacgcacacactcacacatgcattctcacacacgtgtagactcacacatgcacacacatatacactttctcacacgtgtgcacacacgcacatatacacatactcatacactctcacatcacacacgggcacacatatgcacacactcacacatgcattctcacacacgtgtacactcatgcacagacacacacattactcacgggcacacatgcacacactcacacatgcacagactcacaaggggaccctccttgccacttgtcttgcagcgtgaatccaagcatttctctctggcattccctccctccctgccaggatctgcagctagcctggtcccagctggggcaggaagtgattttctaaccacctcccgccgagggtcccttcctcctcctgggccctgggcctcgctgggctgagcagcccctcttcacgacccccaggctctgcaaacatctcccgagtacccacggggcagttctcagtaccctggtgtcttctgggactcatcctcacccagccacacagggaagccgagagccggcctccacctgccccggggaagacaaaagaggggttagaaacgatttcagtcaaaaacatcccattactggaacagcaacagcaacaacccagtgttcaccatggcattctgtaaaatgtgcacctctgtcacctcggggcgtggtgggagccctcagtgcgggtttcaggatcacaggcagccttagagctcctttctggaggccttgcaaggttcattagttaatctgacaaatatatatatatatatatatatatatagagagagagagagagagagagagagagagagcgagcaagcgcgcgccagggtgtagctttgtcctccagcctggggtgcagtggcacaaccatagctcattgcagcctggaactcctgggctcaagcgatcctcccacttcggcctcctgagtggttgggactacaggtgcacatcaccatcctggctaatttttaaattttttgtagagctgggatcttgctgtgttgtccaggctggtcttgaacacctggcctcaagcaatcctcccacctcagcctcccaaagtgctgagatttttggcatgagccaccttgcccagcctaatttgccaaatatttattgagggcctactgtgccccaggctgtgttctaggagctgtgggcacagactgaacctggaggacaaaacctctgccccaaggagctaagagcccagtgagggaggcacatagtaaacaaaatcacagggtgagaggtgcagagtgttagatggtggcagattgaaagtgaagaaggtggctgggtgtggtggctcacacctgtagtcccagcactttgggaggttgaggtgggtggatcacttgaggtcagaagatcaagaccagtctggccaacatggggaaactacttctctactaaaaatacaaaaattagccagtcatggtggtgcgcacctatggtcccagctacttgggaggctgaggccgtgtaatcgcttgggcttgggaggtggagactgcagtgagctgagatcacgccactgcactccagcctgggtgacagagattctgtctcaaaaaaaaaaaaaaaaaaaagaaagaagagaaaaaagaaagggagggagggagggaaggagggagaaaggaaggaaggaaggagaacaaaaaaagaaaaagtggagaaggtgagggcagaggcctgcaactcctctctgacactaatagacacttgtcactcagttcctctgaagttactgccttctgctaaatagcttcatccctttgaacttgaagccccatgatataggaactgagcccattttacaagagaggaatttaaggcccttaacatattgtgttctgctcaagttcatgaaatgtccttcgaatggagcaaaaacagaatgccggctttgaccttcacctggaggccgcccatgaaagcttgctgttatggctcagagctcggctcttgcacttgccaggagacgctgaaagatgaggaccatcagattggcctcccagggccactgtggggtgtcaaactgcccagagcagggcagccaggcaggctctgtgtaaatggcagccctcaccattagcattcatgctaagaagagtcatcaactgcttgaagtagctggggttgaaagaaaatgataccatcatttagaacagaaatggaaaatgaatggatttgccagcacgttgctgagaacatttttggatgggttgctaactttaaaacttaatataggccaggtgcagtggcttgttcttgcaatcccaggattttgggaggctgaggtgggagcatcacttgaggccaggagtttgagaccagcctgggcaaagatagtgagaccccatttctacaaaacagacaaataattagccaagtgtggtcgcatccacctgtagtctcagctacttgggaggctgaagtgggaggatggcttgagcccaggaggttgaggctgctagtgagctatgatcgcaccactgcactccagcctgggcaacacagtgagatcctgtctctagggggaaaaaacccttggagatttcacatgataattccaggggtctcccgtttcccattctgcacctcatattgaaacttgcccttcagtgcatagaaagcagggtttcagatttcatgtgtgtgcgtgtgcatttgtgtgtgtgcatgctgtgcgtgtgcatgtgtgttgcatgtgtaggcatgcgtttgggtgtgcatgtgtgggcatgcatgtgtgtgggtgtgcatgtgcacatgtgtttgtgtatgcgtgtgtgtaggcatgtgcgtgtgtgtttccctagaaaacttagaaaagctgaccactctgtgctgctggggccattcacttttaactcttttatttatttatttttgttcgtttttgagatggagtctcgctctgtcgcccgggctggagtgcagtggcgcaatcttggctcactccaagctctgcctcccgggttcacgccattctcctgcctcagcctcccgagtagatgggactacaggcgcccgccaccacgcccggctaatttttgtatttttagtaaagatggggtttcaccgtgttagccaggatggtctcgatctcctgacctcgtgacccacctgccttggccttccaaagtgctgggattacaggcatgagccactgcacccagccagactgttttatttcgtcacagtccctaaacctgcttcactcctctctgtgacctgcccgcccctgagtttgcaatcctgatcaggtctaaatctcccaggtcccagatgaataaactgaagcccagagttgggagtactttgcccaaagtcactcagggttgttggtcttcatctcatccatgatgggtcaggcatggaggcaggggtgggggcaggcaggacttcctcccatcaccaaatccttttcacctgcagcaaattctcaccccattttcttttcctgggtttttccaccaagtcaagccggctccccctttcaacgtgactgtgaccttctcaggacagtataatatctcctggcgctcagattacgaagaccctgccttctacatgctgaagggcaagcttcagtatgagctgcagtacaggaaccggggagacccctgggctgtggtgaggaatgtggggatcagtgcagctttgtgggaggggaggggagatgacggagtgcaaaggcatctgggtgggagagacgggtgaacaacatcattcatggccaagaacagagaccaagggcacgagcactcccttacagcgggccctcctcctcccctcacttctccccaaggtaggagacccctgaataatctgtcctccccaaactggtctcctcggcggtcagcatgccaaagagactgtcccttccccagactccaccccaggtctagcatagtcacaatagaagaagtttcagaaatggggcaacctggaagcttcccaattgcttagaatggccatagttggagagttccagaaatatcaattattaagaaggtccagccaggtgcggtggctcatgcctgtaatcccagcactttggaggccaaggcaggtggatctcttgaggtcaggagtttgagaccagccagggcaacatggtgaaactctgtttctactaaaaatacaaaaaattagccaggcgtggtgacatgcacctgtaatccagctattctggaggcttaggcaggagaatcacttgaatccaggaggcggaggttgcagtgagctgggatcgcgctactgcactctagcctgggcaacagagtgagactcgatctcaaaaaaaaaaaaaaggtccagtgttagagggcccattgtttcaaacatgaaggtgttgagtgatgtccttccagcccactatttagaacagtcacaagtgatgtactgtctctaaaaaataaaaaatagtaacaatgatagaacagtcacagctgaagagttctagaattgcccatcctttaggatagtcccagctgaagatgtccatgagtgccatactttagaaagtccccagtggaagacttccagaggtatccattgctaagatgtctgtagttagagttctagaaatgcctgctgttgggaatgtcagtatgtcaactcttggaattcttcaacagttgaagacattctccactgatgtactgagacttatatcagtagtacatcggttgagaatgtcctcaactgttgaagaattccaaaagtatgcattgcctggaatgctgccagaccattaccactcctgagatatgcccagtcctgcagggagagtccactgccaggactgtgagtggctgaattggatcaaagagaaatcaaacagagcatcctatcacatgcacgggccaggcagtgctggtgagtctgtgctccccatgcctgagtccagctactcaggcataggcttgattcttgtgggaagagaagagacactcagcccctttgatggaagctgggaaaagaggtggctctgctggaggcaggggctggcctggtttaaccctgacctggtgcatcctttccttgtactggcagagtccgaggagaaagctgatctcagtggactcaagaagtgtctccctcctccccctggagttccgcaaagactcgagctatgagctgcaggtgcgggcagggcccatgcctggctcctcctaccaggggacctggagtgaatggagtgacccggtcatctttcagacccagtcagagggtaggtgtgaagctgggatggacaccccactcctggtatcaaattttgtcctgttctagccaccctaagccctgagctttctggcacagctgggaggtattcagttgttcatcctcagatgtagcccttcaattacatttctagagcccctgctggccaggccctgttgggtgccagctgcttcttctgttaggcatttgatccccctaactctgaagtgggaatcagccctgtttttcagacgagataacttaggctcagagaaatgaagttacttgcctggggtgaggaatgagaacaagatttgaacccagatccatctcacttcaagacactagcagtaacagcctctcctaccctcttccactctaccccagacccatttcccaccatgcccaccccatatggcctctggtagagttggtgccatttaaccctttctttgcttccttcccagagttaaaggaaggctggaaccctcacctgctgcttctcctcctgcttgtcatagtcttcattcctgccttctggagcctgaagacccatccattgtggaggtgaggccaggggatgaggaaggcagggaggtggtcagcctgggccactgcccctgtatgatacatgcagggttggaaaacatgactgtcatcatggtaacaatgatgatgatgggataataaccaactcacagccaccatgtgctggacactgtggagggcactcccttcacccccatggctgccctatgagcttgagacactgcagttgcccttattttacaaatggagaaactgaggcaaggagatgtcaaggacaaagtcacacagctccaaggtggagaaattgggattgaaaatctgtgcccttaaacagggacctcagctgtgatcttgtccagtggattttaagctttgaggcttaatgggcttaaggggccactaggtggtggtgaagaggtggctgtaatagtccacacctctgaaatggcctctctgcgcacccctggttgcagataaagaagttgaggctcagaaggggcaacatttgcccagcacgcaacaggcagccaagaacataaccacgatatcccttcaggagcctgtgagggagacttacttctcccattttacagaaggggaaaccaagccccagggaaggagggaggcgcctgggctgagtcttgggatgctcggaagctcctgtaggatgaagctggggagcgtccgaatgggaggccaggctgccctctggtgatgtcagggtcctcacccctctctgccccctcaggctatggaagaagatatgggccgtccccagccctgagcggttcttcatgcccctgtacaagggctgcagcggagacttcaaggtgagctcccgaccctgtgatgagctcctcggagcccctcctcctcttcaggagccccacctcccctcaccccaggctccccagcctcaccccacaggcctagagcatccaggtctcagccaagccacaagccaggcctcagtttccccatgtgcaaagtgtagacagtcattcttgtggtgcagaattggcagaagaattaaacaagatttgaccaggtgtggtggctgacatctgcaatcccagcactttgggaggccaaagcaagtggactgcttgaggccaggagttcaaaaacagcctgggcaacatagggagaccctcaccaccactccgcctccccatctctaccaaaaacttaaaaatcattcaagtgaggtggtgcacgcctgtagtcccagcaactcgggaggctgaggcaggacgatcgttcagaggctgccgtgagctatgatcacaccactgccctccagcctggccaacagacagagactatatcttaaaaaaaaaaaaatcaaaaagaaaaagtaaacaaaataatgcagcattggcccagcccaaggaaccagactgggatagggggtgaggctggtggtctcctgagtcacagattgccccactggtcctttcttaggtgtccttaatctgggttggagagggaataggttctggaaagagcctggcccacggggcaaaacacactaacatttgccaagcctccaactcaccaccacccgccagcacccacaggttgtctgtgcccatttacagccgtgtcacccaccctgcagcagtgggagtggctgccacagagaggatgtggtgacagaggtgggagggccagccccacctgctgcagcccagcctgaaagtcagacagtgtagacctagaccattgattgagctcctgctgtctgcctggtgctgcgctggacacccttcctgcctcactcattctcatattcacagcagcccctgcagagtggatgttccactgcccccagggcacccatgaggaggccaaagagtgggcagggaggaacatggaccccaacccacataagacccaccctttcctcttccctaaagctcaaatatcacattgattttgggttgatttttaccaatactcatatagcacttgctatataccaggcagtcccctaggagcatcacaaacagtgactcatttaatcctcacgacggccctacgggtgggtgctattattaggtccattttacagatgaggaaactgaggcaccgagagggtaagtaattggcttaagggcacacagctgagaagcgactttgaatcagtggtggtggccacatcacagttctgagatgagtttttgaggaagatgagctcaaaacagggagatacccattcctggggattttccttgccaattgcatgaggattctggtgtcgtgagtgggagtcctggcaggggagggaaggggagggtccttcaagtttaagggccaccgcctcagccagcatcacccacatcctttatcctcaaagtgtacaaaggcctttccaagtggcttttcattgatccactccacccattcatttcgttaataaacatttattgagcacctactttgtgctaggcactggggctacagccatggacagaagagacaagacttatgtccgggggccaagtgtctgtctggtggggacacataaaccaggagagtgctaggtttcaagaagcatcaaggaggcgggaaagcaggagatggctcaggggtacctcagacctcaggccctcctgcccccatgtctccttgactcaggaatcttggtccctgcctggactatggggccaccagttgtctgactggtcacactactaagggtagcaactcccttctacaagtagggaaactgaggcccagagtaggagggggatccactagggtgggagcacattgtggtcctgattcctctctctctctctgtctctcggtgtctttgtctatcttcatgtctctgtctgtctctcttgatgtctctttgtcttgtctctgtgtctgtgtctgtctttctgtctgtttaaaccctcaccttggctgggcacagtgactcacgcctgtaatcccaacactttgggaggctgaggcgggtggatcacctgacgtcaggagttcaagatcagtctggccaacatggtgaaaccacgtctctactaaaaatacaaaaattagccgggtgtggtgacaggcgcctgtagtcccagctacttgggaggctgaggcaggagaatcacttgatcctgggaggcagaggttgcagtgaaccgagatggcaccactgcattccagcctgggcagcagagccagactgtctcaaaagaataaaagtaaaagaaaaataaaccctcaccttaccctcatcctgtgctatgactctctctttttctctctcacagaaatgggtgggtgcacccttcactggctccagcctggagctgggaccctggagcccagaggtgccctccaccctggaggtgtacagctgccacccaccacggagcccggccaagaggctgcagctcacggagctacaagaaccagcagagctggtggagtctgacggtgtgcccaagcccagcttctggccgacagcccagaactcggggggctcagcttacagtgaggagagggatcggccatacggcctggtgtccattgacacagtgactgtgctagatgcagaggggccatgcacctggccctgcagctgtgaggatgacggctacccagccctggacctggatgctggcctggagcccagcccaggcctagaggacccactcttggatgcagggaccacagtcctgtcctgtggctgtgtctcagctggcagccctgggctaggagggcccctgggaagcctcctggacagactaaagccaccccttgcagatggggaggactgggctgggggactgccctggggtggccggtcacctggaggggtctcagagagtgaggcgggctcacccctggccggcctggatatggacacgtttgacagtggctttgtgggctctgactgcagcagccctgtggagtgtgacttcaccagccccggggacgaaggacccccccggagctacctccgccagtgggtggtcattcctccgccactttcgagccctggaccccaggccagctaatgaggctgactggatgtccagagctggccaggccactgggccctgagccagagacaaggtcacctgggctgtgatgtgaagacacctgcagcctttggtctcctggatgggcctttgagcctgatgtttacagtgtctgtgtgtgtgtgtgcatatgtgtgtgtgtgcatatgcatgtgtgtgtgtgtgtgtgtcttaggtgcgcagtggcatgtccacgtgtgtgtgtgattgcacgtgcctgtgggcctgggataatgcccatggtactccatgcattcacctgccctgtgcatgtctggactcacggagctcacccatgtgcacaagtgtgcacagtaaacgtgtttgtggtcaacagatgacaacagccgtcctccctcctagggtcttgtgttgcaagttggtccacagcatctccggggctttgtgggatcagggcattgcctgtgactgaggcggagcccagccctccagcgtctgcctccaggagctgcaagaagtccatattgttccttatcacctgccaacaggaagcgaaaggggatggagtgagcccatggtgacctcgggaatggcaattttttgggcggcccctggacgaaggtctgaatcccgactctgataccttctggctgtgctacctgagccaagtcgcctcccctctctgggctagagtttccttatccagacagtggggaaggcatgacacacctgggggaaattggcgatgtcacccgtgtacggtacgcagcccagagcagaccctcaataaacgtcagcttccttccttctgcggccagagccgaggcgggcgggggtgagaacatcaatcgtcagcgacagcctgggcacccgcggggccgtcccgcctgcagagggccactcgggggggtttccaggcttaaaatcagtccgtttcgtctcttggaaacagctccccaccaaccaagatttctttttctaacttctgctactaagtttttaaaaattccctttatgcacccaagagatatttattaaacaccaattacgtagcaggccatggctcatgggacccaccccccgtggcactcatggagggggctgcaggttggaactatgcagtgtgctccggccacacatcctgctgggccccctaccctgccccaattcaatcctgccaataaatcctgtcttatttgttcatcctggagaattgaagggaggtcaagttgtttgtcaatgatttgtcagagaacctgttgaaatgtgaattaagaagctaagaaaatatttcttagcaacattttctttttcttttttttttttttcttttgagacagagtctcactctcgtcgcccaggctggaatgcagtggtgcgatctcggctctctgcaacctctgtctcccgggttcaagcgatttcctgcgtcagccccagagtagctggaattacaggcacacaccaccacgcctggctaatttttgtatttttagtagagctggggccaccctggcccggccccgtcttcctccccaaaggtcagactgcaggctgcagggctgtgctggaggagccagctctagctcacccatgcttttgcaacagggtcgggttggaagtcagcacaggtcagtcctgcggaaggttccttcgtgactcatctgtgaagtggggtggttgggagaggtagctgagagaatgcatgagagtcctcggtgcctggcaggaggctggaaggttctagaacactgatggttataagagtgggactgtgagcctgggatcggggggtgtgagacttggatgggagcacaagagtggaaacacagcttctgcacggagcaggcgcagccctcaacaccccgtgcacctgcaccctagggactcttgggtccagatgtgctgtggttttcacaccttcttgggggcaacaggttccaggagccacctgtgggtgccacctgagccacaggctcccaggaaagcagcacagctctcctgcacccagagcttgctgggtggcggaggggaacacagatggttggggaaggcctgaggccagattgggggactctggactggggcagatgaggctcctcagaatcccacctttgaagggaactcagcttataaacacagaggagcaaagttggagggccgggcgtagtggctcacacctgtgatctcagcactttgggaggccaaggaaggtggatcacttgaggccaggagttcgagaccagcctgggcaacatagcaaggccccatctctacaaaaattattattttttaaaaaaattagccaggtgtggtggtgcttgcctatagtcccagctactcgggaggctaaggtgggaggatcgctggagcccaggaatttgaggctgcagtgagctgtgattacaccgttgcactccagcctgggtcacagatcaagaccctgtctcttaaaaataaaagttggagacaagagctggctcacctgaaaggagggattagtaggtaggagggtggatggaggatggatggatgtgtgggtggataggaagatggtattaagttggtgcaaaagtctttgatattactcttaatggctttaataaaaagcttgaaggaagaatgattggttggatagacagagataaatgcatactggaaacaaagataaagataaaacacaagttataccaggccagcaactctattttgttcactgcctttagtcccagcctggcacatagtaggcactcaataaagcctgatttgtagca

SEQ ID NO: 1797 - DNA, 49881 bp, Homo sapiens; identical to SEQ ID NO: 1796

SEQ ID NO: 1798 - DNA, 24785 bp, Homo sapiens
ctagaggcagctcagatagaggagctctttgggaagagacgccgggcaggcagaagcagcaggtaccccctccacatccctagggctctgtgatgtaggcagaggtaagaaattaggagggatgaggagttttttgtttgtctgtttgtttttttaaagacagggtctcactctttcattcaggctggagtgcaatagtgcaatcatggctcactgcagcctggacctccggcactcaagtgatcctccttcctcagtctcccgaatagctgggaccacaggcacacagcacccggctaacttatttttacttctatttttatttttggtagagacaaggtcttgctatgttggtcaagctggagatgaggaatattgaatctgggcaaaggagtttgcactttttgctgtgctgtggtcaagataaaaccatcagggagtgacggggacagagctatgtcaggactcgcaccgtggctggggtgatggatgtggacagaatagtgagggggcagacacagactccccctcctgcgatcagaggccacatcttcaaagtgtgataacaggacctctgcaggggttggaatcacacaggattcatattcctaaaagcaggttgaaactgcatctacctcaacattattttatttgagtagtgatgttattgcttaggatgatgctggagttaaatttttaagtgtgcttatctatagaaaatatattaaaatatgtattaaaataaacaacagtgcacacaatatacaaatatggccaaaattttggatatgagatattttggcaactcttggctagatcattctgagaccccctctgtttctgaggctctaccttctccatcaattacagctgttgtttgagtgtttatgtgatgggggccatctgcagggttttatgcaaatcacctccttgaattctcacaagcctggaagcaggccttgctgtttccactttacaaggctcagagagggcaagggactggcccggagccacacagctggtcatctgaaccttcctggccccccagcctgtgccctgccccagggttctttgatggctctgtgagggaggtcagagggaactatggatggggccagagtaggatctttgggaaccccggcacagaggaggaggatcttccccttgtggagtcagggatggcgtctggagaaagccatgcctgtgacttgggtcctgcatggggcatccctcttaggtttagctttagctccattcttgtctataggggctggtctgggaggggctcctgagtctgggcaggtggaccactgccctctggctggcacttcctcaaacagacacagagctggtgggtgaaacagacaagtcccaggagaagcctggcatcgccagactggtggggcattcctctgcccaagacagtagagggcactctttctggataaactcactctgctccccaaagaggttccttctccatcctggcccaaattaggaggtcaggttgtctctgtttggtcaggcctggatttcctagcatgctcccgagtgggctaatctgggctttgtgatggagtaaggagcctcattattgggctaaccttatcttaagtattcagcagtggttaactttgtgggttaactttggatttattattcagtaagaagccaatttattgatggctgggtgcagtggctcatgcctgtaattccagcactttgagaggctgaggtgggtggatcacctgtggccaggagttcgagaccagcctagtccacatggcaaaaccctgtctctactaaaaatacaaaaattagccaggcgtggtggcggccacctgtattcccagctacttgggaagctgaggcaggagaatcgcttgaacctgggaggtagaggttgcagtgagccaagatcgggccactgcactccagcctgggcgatagagtgagactttgtctaaaaaataaacataaaaaagccaatttactggcttttttttacaacatggatgtttataggaaggaagatccaaaattgctcctcagcagatccccctttccaaactagttttttctccttttctctctcccttcctctctttttccctccctctttctttgttagatagataaatacacaagtttaatttcacacacaatgctacatcaataggctcagcaagggcaaaatagtcagcagtctcctccctctttaaattcaccttgtgctgggcgtggtgactcatgcctgtcatcccagcactttgagaggccgaggtaggaggatcatgtgatcccaggagtttgagaccagcctgggcaacatagcaagatgccgtctctacaaaaatgttttaaaaattagccaggcgtggtggcacgtgcctttggtcccagctactcgggaggctgatgcaggaggatcgcttgagcccaggaggttgaggctgcagtgagccgtgattgcgccattgcactccagcctgggcaacagaacatgaccccatctctaaaaatattaaaataaaataataaaacaaattcactttgcatttgtgacgtgatggggcgggggcaggaagaaggtgggagaagggattcttggggtgaatctgccatttctaagaggtgggagttcttggggtcatccacaggcccctcgggatcttgcatttttcttaagacagttccaagaatcaggggcaagtctgcctgggaagagacaggatgagggggaggccgggggagccctgagcccgcctggctcaccctccactgtacgtctcttgcaggcccgtgggagtcagcatgccgcgtggctgggccgcccccttgctcctgctgctgctccagggaggtaagtggctgccccgtggtctgcgggtggggagggcccccatcacagagctgagccagggccgggctggctttctgggctcaaaaacacggctagagtccacagattcagaaaagatgacatccatgcccttgaggctgacacgagtccagtagccggctctccactaatcagaatccatccaccaaagggctccatgaaacagaagcggtagacatgagtctcaggtggcccagcccacaggcttgtgtcttcgggtgtcactggggggatgaaaggcttcgtccttcatttcccctgacctctgccttggctggctcccaactctctgagtgaggaagttctgccttccatctaacctcagtttctccttatgtaatgactctccttggaaatgtttttcaacaattgctgcaccgggtgcggtggctcctactggaatcccagccctttgggaggctgaggagggtaggtcgcttgagctcaggatctcaagaccagcctgggcaacatggtgaagccctgtctctacaaaagaaaaaaaattagccaggcataggagcgcatgcttgtagtctcagctttttgtggggctgaggcgggaggattgcttgagcctgggaggtggaggttacagtgagtcaaggtgacaactgtactccagcctgggcaacagagcgagaccctgtctcaaaacaacagcaacaacaacaacaataaacaaacaaaaaaatcgctagattcttagcaggcactggtggtccctgggctggggacaggaggaagagccaaaaggagactgaaccttggtaggcagcccccagaggaccagatgttgtggttagagggggtgacgttagaaagcagaactgggaagaccaggagtccgactgaaagggcactgcctaggactaagagatcctggagggcttcctggaggagggggccatgaggaggcgggatccagcacagacttgtgtggaggccggcctaggggcaggggaggaactcaacagctgctctgctgactcatgggcatttttctctggtttttaccagaagacccaggacctcaaatagctccttcaggaaacagatgtcaagctttgattttccctttctgagtggcaagcatcctcatcttggttctaaaaagcctttgggtcacccaccatggctccacatctggcgggtgcagataacaagccctggctgcatgcaaagctcggagcgtcatcccattccactgtcccaacagccccacaaggcgcatgttgtaatgacgcccagttttttggctgaggaggctcagagaggctaagagacaggtgcatggccacactacccggaagaggcagagctgggatcagtttgctcttggggtctgtcttagtctgtctgtgctgctgtaactgaatacgtgagactgggtaatttataaataatagacatttactgctcgcagttctggaggctgggaagtccaagatcaaggcaccagcagtagctttgattccggtgaggggcccatctttgctttttttttttgagactgagccttgctttctcacacaggctggagtgcaatggtgcaatcttggctcactgcaacctctgcctcccaggttcaagcaattctcatgcctcagcctcccgagcagctgggataacaggcacatgccatggctaattttcgtatttttagtagagttggggtttcaccatgttggccaggatggtcttgaactcctgacctcaaatgatccacccgcctcggcctcccaaaagtgctgggattaccgcacccagcccccatctttgcctttaagatgccacattgaacgctgcaccacccccagaggggacacacgctgcatcctcacatggcagaagggcaaaaagggtctgaatgttgggttcgtccagccctcttatagcatcaataattcattcaggggggctctgcccccatgacttaatcatctcctagagtccccaccttttaatatgatcacattggcaactgagtttctggggagacacagacgtcaaaccgtagcacggccttcaccatgctgtgctgctatctgtggagtgatagccatgtgcgggcagcatgcaggcacaggcatgatctcatctcaacacctcaacagcctctagggcaagcagtgtctccggcttacacatggggaggagaagcagttttgagtcacatgtttgcagtcacagagctactttgtgcacctctcactgcctcctgcacgctttcataaccccagacatgggatggccctggggctctctgccctgtggctggggtactgacagggcattttcccaccctctcatccctggtgccacctccctgccactcaggggctgccgttgcctccccaagtttggagacaaaccctgtcccttggtagctttgagcctggctaggaatggtagctcctctccaaattcccagagctctgagaaagaaccacgaggatacgaactcagagatgacacagctacttagaggctctgtgttgaggttttgccaaaatcagtcctgttttctccaccaagtgctggaactagctccttttcactccaccgacaagttctgtgtgtctccctgaggaaagccccctcctagagcaagatttacttccatgactcagatcccttggtagccactgcctcgagagaagttgagaagcattccgaggtcacacctaggggagggagtgctgtgatccattagcaatatctgtcatgtgtgcggctatgaaaaactagcacagactaggtatttccttccctgggtgagtgtctcagcagcccagaccaagagagacaagaggcatggtctagtcttggagcctcagtgttctcatctctacaatgaactaaaggatatttccagacacagtattcttggctccgcatataggttctgtcctagagtgagacccaggaagggaatctaccaccaccacctcaggggtcttcattagtccagggaaaataggaaaaagccaccaaaaatgaacctacttaaaaaggggaacaaggtcaggcacgatggctcattcttacaatcccagcactttgggaggctgaggcaggtggatcgcttgagctcaggagattgagaccagcctgggcaacatggtgaaaccctgtctctacaaaaacacaaaaattatccaggcatggtggtgcacaactgtagtctcagctactcaggaagttgaagtgggaggactgcttgagcccaggaggtggaggctgcagtgagctgagatcgcaccactgcattccagcctgggcaacagagcaagagatcctatctcaaaaagaggtgagcggtacaagtttctagtaaatagcagcaaaaaatagtggaattggcactcgaatatacaaaacaaagctacaaattattccattgattttgtccacatttaacaaaatgtagatgatgattgcacccctgttttagaacacagcgaaacaattaatgtttggggagcaggatggaaaggtgttaaatcttccaacaaaattgcctcatagggcaatacctagaagacttcttggtggcggtggcatttttggccgcaggatcacgcagacctttatgcaaaagtgtccgagggctttttaattctctcacggtttcctactccttgaagcacttcctgaatctccgagagtgggtgtcctgtggatccaacttctgtagagccgagtcctcttccttgtcagggttttgggacattttcagcatagctgtccttgactctatgaggtcctgaccctcttggggtgtgtgcgtgtgctctggctgggttcctaccacatctggggcatttaggatattgccattctgagtgggagcttggccaggagggacacagacctggtggccgggcgcagggctctggaggagggtgctgagctggggaccagctagttttatattatttgccatcacatgcatcctgtcttcatagccagccttgaaacattggtgctcaaacaaggaatttccaggtggtgaggccccctgggtgccaggcctacatctaagcagctcctgagtcctcatatttgtcccggcctggggacccctgcacccattcttcctccagccctcgaggggatggagaggaagctctgcagtcccaagccaccccccaccaaggcctctctccccactgaccctccaggctggggctgccccgacctcgtctgctacaccgattacctccagacggtcatctgcatcctggaaatgtggaacctccaccccagcacgctcacccttacctggtaagtagccgggcctcaccagtccccggggatgcaattcagggtgcctgctcagtgattcccccaggaggacactgtgcactgaggaccactgtgtccgcctttcagacaaccactcagggctcacaggacttgaaaagtcaggagcccgcagggttggtctatccaccagcttcaaaggccactctctcacccacacaggtcggccatggttttgagaccccgggatggctggtttcccgcatgatttttcaagcacttaggtaccaggcccccaactacacgcttcccatgaatggtcacccccaaccctcacaatgattactcccattttacagatgaggacattgaggttcagagaggttaagcaacttgcctaaggtcacacagccagtgaatgctggagctgggattcaaattcagaccgcccaactccaaagtccatgggtcccttttagaccctatgcagctcaggataaagaagagcttctgttatccatcagctcattcattcattcaaaaccatttataggccaggtgcagtggctcatgtttctaaccccagcactttgggaggccaaggaaggaggatcacttgagcccaggagtttgagaccagcctgggcaacatcacaaaaccctgtctctacaaaaaataaatcagtcgggcgtggtggcacaatcctgtaatcccagctacttgagagtctaaggcagggggaccaagctcaggaggtcgaggctgcagtgagctatgatcacgccactgcactccagcctgggcaaaaaagcaagatcccaactcaaaaacaaaacaaaacaaaacaaaacatgtattaagttcctgccagacactgttgcaggcactggggattcagcagagcaagactgaccaggccccagatgccttggaactgacgtaccacggtggggcggaggctgggggagacagacacacaaaacaaccaacaaggtgctttctcttttttattttattttattttattttattttatttttttgagacagggtcttgctctgttgcccaggctggagtgcagtggtgggatcagaactcactgtagccttgacctcctgggctcaagcaatccctccacctaagcctcctgagtagctgggactacaggcatgcatcaccatacctggataatttttgtagtttttgtaaagacagggttttgccatgttacccaggctggattcaaactcctgggctcaagcaatctgcccacctcagcctcccaaagtgctgggattacaggtgtgagccaccatgccaggcccaaacaggacactttctttctttcttttttttggagacggagtctcactctgttgcccaggctggagtgcggtggcatgatctcggctcactgcaacctccacctcctgggttcaagcaattctcctgcctcaacctcccaagtatctgggattgcatccaggtgtgcaccaccatgcctggctaatttttgtattttaagtagagacagggttttgtcatgttagcccacctggtctcgaactcctggcctcaagtgatccgcccactgtacccgcctttcagacaaccactcagggctcacaggacttgaaaagtcaggagcccgcagggttggtctatccaccagcttcaaagaccactctctcgcccacacaggtcgcccatggttttgagaccccgggatggccggtctgccgcatggccagcctcccaaagtgttgggattacaggcataagccaccgtgttctgccccaaacaggatactttctaataatactgggtgctatatcaaggacagaacactggacctcaggtaaagggaccacaactgctagtgagaaggaggaagccagggagctgggcagagggcactgccagtgcaaaggccctgtgggagaagagctggtgcgtttgaggaatagggaggaggtcagtgtggctggagtggagtgaggcagggtgagggggaataaggagcaagttcaggctgggaggcttggagagcatttattcagcaggaacttgtattccagcaaatttggcagagaactcagtccacacatccctactgggcctagagagtggtcatgttcagatcctgaacatctaggtagggaaattaatatccggtaaactactatacatacttcaaaacccatcatttttgtccagtgggagttaaaaagccacagcattttccctaatcccatcccaccaactttcccagaagtccacccagaggaggagatgaggttcatttagctcttttcctggccctcagcacaggctattattagatattcagtggatttggggactgggcgaggtggctcagtcctgtaatcccagcactttgggaggccaaggctggcagatcacttgagcccaggagtttgagaccagcctaagcaacatggtgggaccccatctctacaaaaaatacaaaaagttagctgggcatggtggtgcatgcatgtagtcccaggtactgaggaggctgaggtgggaggatcagctgagcctgggaaggtcgaggctgcagtaagccatgatcacactactatactccagcctggggccagagtgagaccctgtctcaaaaaaatggatgttggacagaaaggagagaaggaaacccaaaatgcctagcgcccttcctgcaggacagccatctggttgttgggaccaacagggacagatttaggcttagtccaagcaagaatggcccaaatttccaaaattgagagctgctgccctaaatgaggtagtgagttcctggcccctgggaggtgtgcaagctgagcccggacacaattcattgaggatgctgtaggggaggtgataccttccctgggaaaaggttggttggaccaggtgaccaccccccagccctgcctcaaatccctcccagccctgagagtctgggcttctgccctggccctgagcactgagcccaccaccatcccccctgcccctggcttccagccatgaccggctgctttgtccttgaaggcaagaccagtatgaagagctgaaggacgaggccacctcctgcagcctccacaggtcggcccacaatgccacgcatgccacctacacctgccacatggatgtattccacttcatggccgacgacattttcagtgtcaacatcacagaccagtctggcaactactcccaggagtgtggcagctttctcctggctgagagcagtgagtatcctgggaccccaggcttagggtggcactcaatcttagctcaccgcagccctgacctctctgggctcaggtgatcctcccacctcagcctcccgtgtagctgggacaacaggtgtacaccactacacccagctaatttttgtatttttagtagagacggggatcttgccatgttgcccaggccagtctcgaactcctgggctccagcgatccacttgccttggcctcccaaagtgctaggattataggtaggggctgggtcccctactccctgccctctgggccagctctcctccttccatcagatctgacctggcctatgtcctcactacaccttagagttctgttttgagttgcgctattttttactaaagtgtgaaaggttgataataggtttgagaggtattgaaggagctaggctgggacccgggacttctgggttcgtgttccggctcagctctgcccatctgtgtgaccatggatgaggcatacctacctctgggacagcttccctatttgtagagcaaatgtccttttaaccctgactttctgggatcctgaccccataatgaggcgaatggacgacactgagttacagaaaaaaaaaaccctcttgggttttttccccttcataagctccagggaggcctggaatttccctccaggctggaggtagaggggggtcccaggggcaggagggcctggttggtgggagcagttttatctgtgagttcagaattagggcaggtggcagggcgaggtggctcatgcctgtaattccaacactttggaaggctgaggcaggaggattgcttgaacctggggctttaagaccaacctgggcaatatagcgagacctcatctcaaaacacaaaacaagaaccagggcaggggccaggcactgtggctcacgcctctaatcccagcactttgggaagctgaggcaggtggatcgtttgaggtcaggtgttcgagaccagcctgggcaacatggtgaaaccccatctctactaaaaatacaaaaaaatttgccgggcgtggtggcacacgcccgtaatcccggctactcgggaggctgaggcaggagaattgtttgaacctgggagacagaggttgcaatgagccaagatcatgccaccgcactccagcctgggcgtcagagtgagactccgtctcaaacaaaacaaaacagaactaggcagggcatggaagggcctgggaggtggctttggcatggtgtgtgtgtgtgtgtgtgtgtgtgtatgtgtgtacccaaagcggccccagaggcaaacacaggctgcaaagggagcctgccctcaggaaggccccgcccatgagctcgggagtttctgccgctagattcccagcagaggggctggggtataagaggtgtctgtgattcacactctgggggtccaggtttgcacctctttgctgagtggatgtcacaccacagagcgtgagagtgaagcttcacacactcccagacacatgcacactcacgcaaattcccagggtcacagactcacgcacacacagactcatagatgcgccctcaaactcacagatgtctccccagccccagcctgcatggcatggacacagaggcccacactgcctctctctcttgctctctctcactctcatacacactcacacatacatacacacacacacacacacacacgtacacaatacacacacactcacacatatactctcacatcactcatacatgggcacacacacgcacacactcacacatgcattctcacacacgtgtagactcacacatgcacacacatatacactttctcacacgtgtgcacacacgcacatatacacatactcatacactctcacatcacacacgggcacacatatgcacacactcacacatgcattctcacacacgtgtacactcatgcacagacacacacattactcacgggcacacatgcacacactcacacatgcacagactcacaaggggaccctccttgccacttgtcttgcagcgtgaatccaagcatttctctctggcattccctccctccctgccaggatctgcagctagcctggtcccagctggggcaggaagtgattttctaaccacctcccgccgagggtcccttcctcctcctgggccctgggcctcgctgggctgagcagcccctcttcacgacccccaggctctgcaaacatctcccgagtacccacggggcagttctcagtaccctggtgtcttctgggactcatcctcacccagccacacagggaagccgagagccggcctccacctgccccggggaagacaaaagaggggttagaaacgatttcagtcaaaaacatcccattactggaacagcaacagcaacaacccagtgttcaccatggcattctgtaaaatgtgcacctctgtcacctcggggcgtggtgggagccctcagtgcgggtttcaggatcacaggcagccttagagctcctttctggaggccttgcaaggttcattagttaatctgacaaatatatatatatatatatatatatatagagagagagagagagagagagagagagagagcgagcaagcgcgcgccagggtgtagctttgtcctccagcctggggtgcagtggcacaaccatagctcattgcagcctggaactcctgggctcaagcgatcctcccacttcggcctcctgagtggttgggactacaggtgcacatcaccatcctggctaatttttaaattttttgtagagctgggatcttgctgtgttgtccaggctggtcttgaacacctggcctcaagcaatcctcccacctcagcctcccaaagtgctgagatttttggcatgagccaccttgcccagcctaatttgccaaatatttattgagggcctactgtgccccaggctgtgttctaggagctgtgggcacagactgaacctggaggacaaaacctctgccccaaggagctaagagcccagtgagggaggcacatagtaaacaaaatcacagggtgagaggtgcagagtgttagatggtggcagattgaaagtgaagaaggtggctgggtgtggtggctcacacctgtagtcccagcactttgggaggttgaggtgggtggatcacttgaggtcagaagatcaagaccagtctggccaacatggggaaactacttctctactaaaaatacaaaaattagccagtcatggtggtgcgcacctatggtcccagctacttgggaggctgaggccgtgtaatcgcttgggcttgggaggtggagactgcagtgagctgagatcacgccactgcactccagcctgggtgacagagattctgtctcaaaaaaaaaaaaaaaaaaaagaaagaagagaaaaaagaaagggagggagggagggaaggagggagaaaggaaggaaggaaggagaacaaaaaaagaaaaagtggagaaggtgagggcagaggcctgcaactcctctctgacactaatagacacttgtcactcagttcctctgaagttactgccttctgctaaatagcttcatccctttgaacttgaagccccatgatataggaactgagcccattttacaagagaggaatttaaggcccttaacatattgtgttctgctcaagttcatgaaatgtccttcgaatggagcaaaaacagaatgccggctttgaccttcacctggaggccgcccatgaaagcttgctgttatggctcagagctcggctcttgcacttgccaggagacgctgaaagatgaggaccatcagattggcctcccagggccactgtggggtgtcaaactgcccagagcagggcagccaggcaggctctgtgtaaatggcagccctcaccattagcattcatgctaagaagagtcatcaactgcttgaagtagctggggttgaaagaaaatgataccatcatttagaacagaaatggaaaatgaatggatttgccagcacgttgctgagaacatttttggatgggttgctaactttaaaacttaatataggccaggtgcagtggcttgttcttgcaatcccaggattttgggaggctgaggtgggagcatcacttgaggccaggagtttgagaccagcctgggcaaagatagtgagaccccatttctacaaaacagacaaataattagccaagtgtggtcgcatccacctgtagtctcagctacttgggaggctgaagtgggaggatggcttgagcccaggaggttgaggctgctagtgagctatgatcgcaccactgcactccagcctgggcaacacagtgagatcctgtctctagggggaaaaaacccttggagatttcacatgataattccaggggtctcccgtttcccattctgcacctcatattgaaacttgcccttcagtgcatagaaagcagggtttcagatttcatgtgtgtgcgtgtgcatttgtgtgtgtgcatgctgtgcgtgtgcatgtgtgttgcatgtgtaggcatgcgtttgggtgtgcatgtgtgggcatgcatgtgtgtgggtgtgcatgtgcacatgtgtttgtgtatgcgtgtgtgtaggcatgtgcgtgtgtgtttccctagaaaacttagaaaagctgaccactctgtgctgctggggccattcacttttaactcttttatttatttatttttgttcgtttttgagatggagtctcgctctgtcgcccgggctggagtgcagtggcgcaatcttggctcactccaagctctgcctcccgggttcacgccattctcctgcctcagcctcccgagtagatgggactacaggcgcccgccaccacgcccggctaatttttgtatttttagtaaagatggggtttcaccgtgttagccaggatggtctcgatctcctgacctcgtgacccacctgccttggccttccaaagtgctgggattacaggcatgagccactgcacccagccagactgttttatttcgtcacagtccctaaacctgcttcactcctctctgtgacctgcccgcccctgagtttgcaatcctgatcaggtctaaatctcccaggtcccagatgaataaactgaagcccagagttgggagtactttgcccaaagtcactcagggttgttggtcttcatctcatccatgatgggtcaggcatggaggcaggggtgggggcaggcaggacttcctcccatcaccaaatccttttcacctgcagcaaattctcaccccattttcttttcctgggtttttccaccaagtcaagccggctccccctttcaacgtgactgtgaccttctcaggacagtataatatctcctggcgctcagattacgaagaccctgccttctacatgctgaagggcaagcttcagtatgagctgcagtacaggaaccggggagacccctgggctgtggtgaggaatgtggggatcagtgcagctttgtgggaggggaggggagatgacggagtgcaaaggcatctgggtgggagagacgggtgaacaacatcattcatggccaagaacagagaccaagggcacgagcactcccttacagcgggccctcctcctcccctcacttctccccaaggtaggagacccctgaataatctgtcctccccaaactggtctcctcggcggtcagcatgccaaagagactgtcccttccccagactccaccccaggtctagcatagtcacaatagaagaagtttcagaaatggggcaacctggaagcttcccaattgcttagaatggccatagttggagagttccagaaatatcaattattaagaaggtccagccaggtgcggtggctcatgcctgtaatcccagcactttggaggccaaggcaggtggatctcttgaggtcaggagtttgagaccagccagggcaacatggtgaaactctgtttctactaaaaatacaaaaaattagccaggcgtggtgacatgcacctgtaatccagctattctggaggcttaggcaggagaatcacttgaatccaggaggcggaggttgcagtgagctgggatcgcgctactgcactctagcctgggcaacagagtgagactcgatctcaaaaaaaaaaaaaaggtccagtgttagagggcccattgtttcaaacatgaaggtgttgagtgatgtccttccagcccactatttagaacagtcacaagtgatgtactgtctctaaaaaataaaaaatagtaacaatgatagaacagtcacagctgaagagttctagaattgcccatcctttaggatagtcccagctgaagatgtccatgagtgccatactttagaaagtccccagtggaagacttccagaggtatccattgctaagatgtctgtagttagagttctagaaatgcctgctgttgggaatgtcagtatgtcaactcttggaattcttcaacagttgaagacattctccactgatgtactgagacttatatcagtagtacatcggttgagaatgtcctcaactgttgaagaattccaaaagtatgcattgcctggaatgctgccagaccattaccactcctgagatatgcccagtcctgcagggagagtccactgccaggactgtgagtggctgaattggatcaaagagaaatcaaacagagcatcctatcacatgcacgggccaggcagtgctggtgagtctgtgctccccatgcctgagtccagctactcaggcataggcttgattcttgtgggaagagaagagacactcagcccctttgatggaagctgggaaaagaggtggctctgctggaggcaggggctggcctggtttaaccctgacctggtgcatcctttccttgtactggcagagtccgaggagaaagctgatctcagtggactcaagaagtgtctccctcctccccctggagttccgcaaagactcgagctatgagctgcaggtgcgggcagggcccatgcctggctcctcctaccaggggacctggagtgaatggagtgacccggtcatctttcagacccagtcagagggtaggtgtgaagctgggatggacaccccactcctggtatcaaattttgtcctgttctagccaccctaagccctgagctttctggcacagctgggaggtattcagttgttcatcctcagatgtagcccttcaattacatttctagagcccctgctggccaggccctgttgggtgccagctgcttcttctgttaggcatttgatccccctaactctgaagtgggaatcagccctgtttttcagacgagataacttaggctcagagaaatgaagttacttgcctggggtgaggaatgagaacaagatttgaacccagatccatctcacttcaagacactagcagtaacagcctctcctaccctcttccactctaccccagacccatttcccaccatgcccaccccatatggcctctggtagagttggtgccatttaaccctttctttgcttccttcccagagttaaaggaaggctggaaccctcacctgctgcttctcctcctgcttgtcatagtcttcattcctgccttctggagcctgaagacccatccattgtggaggtgaggccaggggatgaggaaggcagggaggtggtcagcctgggccactgcccctgtatgatacatgcagggttggaaaacatgactgtcatcatggtaacaatgatgatgatgggataataaccaactcacagccaccatgtgctggacactgtggagggcactcccttcacccccatggctgccctatgagcttgagacactgcagttgcccttattttacaaatggagaaactgaggcaaggagatgtcaaggacaaagtcacacagctccaaggtggagaaattgggattgaaaatctgtgcccttaaacagggacctcagctgtgatcttgtccagtggattttaagctttgaggcttaatgggcttaaggggccactaggtggtggtgaagaggtggctgtaatagtccacacctctgaaatggcctctctgcgcacccctggttgcagataaagaagttgaggctcagaaggggcaacatttgcccagcacgcaacaggcagccaagaacataaccacgatatcccttcaggagcctgtgagggagacttacttctcccattttacagaaggggaaaccaagccccagggaaggagggaggcgcctgggctgagtcttgggatgctcggaagctcctgtaggatgaagctggggagcgtccgaatgggaggccaggctgccctctggtgatgtcagggtcctcacccctctctgccccctcaggctatggaagaagatatgggccgtccccagccctgagcggttcttcatgcccctgtacaagggctgcagcggagacttcaaggtgagctcccgaccctgtgatgagctcctcggagcccctcctcctcttcaggagccccacctcccctcaccccaggctccccagcctcaccccacaggcctagagcatccaggtctcagccaagccacaagccaggcctcagtttccccatgtgcaaagtgtagacagtcattcttgtggtgcagaattggcagaagaattaaacaagatttgaccaggtgtggtggctgacatctgcaatcccagcactttgggaggccaaagcaagtggactgcttgaggccaggagttcaaaaacagcctgggcaacatagggagaccctcaccaccactccgcctccccatctctaccaaaaacttaaaaatcattcaagtgaggtggtgcacgcctgtagtcccagcaactcgggaggctgaggcaggacgatcgttcagaggctgccgtgagctatgatcacaccactgccctccagcctggccaacagacagagactatatcttaaaaaaaaaaaaatcaaaaagaaaaagtaaacaaaataatgcagcattggcccagcccaaggaaccagactgggatagggggtgaggctggtggtctcctgagtcacagattgccccactggtcctttcttaggtgtccttaatctgggttggagagggaataggttctggaaagagcctggcccacggggcaaaacacactaacatttgccaagcctccaactcaccaccacccgccagcacccacaggttgtctgtgcccatttacagccgtgtcacccaccctgcagcagtgggagtggctgccacagagaggatgtggtgacagaggtgggagggccagccccacctgctgcagcccagcctgaaagtcagacagtgtagacctagaccattgattgagctcctgctgtctgcctggtgctgcgctggacacccttcctgcctcactcattctcatattcacagcagcccctgcagagtggatgttccactgcccccagggcacccatgaggaggccaaagagtgggcagggaggaacatggaccccaacccacataagacccaccctttcctcttccctaaagctcaaatatcacattgattttgggttgatttttaccaatactcatatagcacttgctatataccaggcagtcccctaggagcatcacaaacagtgactcatttaatcctcacgacggccctacgggtgggtgctattattaggtccattttacagatgaggaaactgaggcaccgagagggtaagtaattggcttaagggcacacagctgagaagcgactttgaatcagtggtggtggccacatcacagttctgagatgagtttttgaggaagatgagctcaaaacagggagatacccattcctggggattttccttgccaattgcatgaggattctggtgtcgtgagtgggagtcctggcaggggagggaaggggagggtccttcaagtttaagggccaccgcctcagccagcatcacccacatcctttatcctcaaagtgtacaaaggcctttccaagtggcttttcattgatccactccacccattcatttcgttaataaacatttattgagcacctactttgtgctaggcactggggctacagccatggacagaagagacaagacttatgtccgggggccaagtgtctgtctggtggggacacataaaccaggagagtgctaggtttcaagaagcatcaaggaggcgggaaagcaggagatggctcaggggtacctcagacctcaggccctcctgcccccatgtctccttgactcaggaatcttggtccctgcctggactatggggccaccagttgtctgactggtcacactactaagggtagcaactcccttctacaagtagggaaactgaggcccagagtaggagggggatccactagggtgggagcacattgtggtcctgattcctctctctctctctgtctctcggtgtctttgtctatcttcatgtctctgtctgtctctcttgatgtctctttgtcttgtctctgtgtctgtgtctgtctttctgtctgtttaaaccctcaccttggctgggcacagtgactcacgcctgtaatcccaacactttgggaggctgaggcgggtggatcacctgacgtcaggagttcaagatcagtctggccaacatggtgaaaccacgtctctactaaaaatacaaaaattagccgggtgtggtgacaggcgcctgtagtcccagctacttgggaggctgaggcaggagaatcacttgatcctgggaggcagaggttgcagtgaaccgagatggcaccactgcattccagcctgggcagcagagccagactgtctcaaaagaataaaagtaaaagaaaaataaaccctcaccttaccctcatcctgtgctatgactctctctttttctctctcacagaaatgggtgggtgcacccttcactggctccagcctggagctgggaccctggagcccagaggtgccctccaccctggaggtgtacagctgccacccaccacggagcccggccaagaggctgcagctcacggagctacaagaaccagcagagctggtggagtctgacggtgtgcccaagcccagcttctggccgacagcccagaactcggggggctcagcttacagtgaggagagggatcggccatacggcctggtgtccattgacacagtgactgtgctagatgcagaggggccatgcacctggccctgcagctgtgaggatgacggctacccagccctggacctggatgctggcctggagcccagcccaggcctagaggacccactcttggatgcagggaccacagtcctgtcctgtggctgtgtctcagctggcagccctgggctaggagggcccctgggaagcctcctggacagactaaagccaccccttgcagatggggaggactgggctgggggactgccctggggtggccggtcacctggaggggtctcagagagtgaggcgggctcacccctggccggcctggatatggacacgtttgacagtggctttgtgggctctgactgcagcagccctgtggagtgtgacttcaccagccccggggacgaaggacccccccggagctacctccgccagtgggtggtcattcctccgccactttcgagccctggaccccaggccagctaatgaggctgactggatgtccagagctggccaggccactgggccctgagccagagacaaggtcacctgggctgtgatgtgaagacacctgcagcctttggtctcctggatgggcctttgagcctgatgtttacagtgtctgtgtgtgtgtgtgcatatgtgtgtgtgtgcatatgcatgtgtgtgtgtgtgtgtgtcttaggtgcgcagtggcatgtccacgtgtgtgtgtgattgcacgtgcctgtgggcctgggataatgcccatggtactccatgcattcacctgccctgtgcatgtctggactcacggagctcacccatgtgcacaagtgtgcacagtaaacgtgtttgtggtcaacagatgacaacagccgtcctccctcctagggtcttgtgttgcaagttggtccacagcatctccggggctttgtgggatcagggcattgcctgtgactgaggcggagcccagccctccagcgtctgcctccaggagctgcaagaagtccatattgttccttatcacctgccaacaggaagcgaaaggggatggagtgagcccatggtgacctcgggaatggcaattttttgggcggcccctggacgaaggtctgaatcccgactctgataccttctggctgtgctacctgagccaagtcgcctcccctctctgggctagagtttccttatccagacagtggggaaggcatgacacacctgggggaaattggcgatgtcacccgtgtacggtacgcagcccagagcagaccctcaataaacgtcagcttccttccttctgcggccagagccgaggcgggcgggggtgagaacatcaatcgtcagcgacagcctgggcacccgcggggccgtcccgcctgcagagggccactcgggggggtttccaggcttaaaatcagtccgtttcgtctcttggaaacagctccccaccaaccaagatttctttttctaacttctgctactaagtttttaaaaattccctttatgcacccaagagatatttattaaacaccaattacgtagcaggccatggctcatgggacccaccccccgtggcactcatggagggggctgcaggttggaactatgcagtgtgctccggccacacatcctgctgggccccctaccctgccccaattcaatcctgccaataaatcctgtcttatttgttcatcctggagaattgaagggaggtcaagttgtttgtcaatgatttgtcagagaacctgttgaaatgtgaattaagaagctaagaaaatatttcttagcaacattttctttttcttttttttttttttcttttgagacagagtctcactctcgtcgcccaggctggaatgcagtggtgcgatctcggctctctgcaacctctgtctcccgggttcaagcgatttcctgcgtcagccccagagtagctggaattacaggcacacaccaccacgcctggctaatttttgtatttttagtagagctggggccaccctggcccggccccgtcttcctccccaaaggtcagactgcaggctgcagggctgtgctggaggagccagctctagctcacccatgcttttgcaacagggtcgggttggaagtcagcacaggtcagtcctgcggaaggttccttcgtgactcatctgtgaagtggggtggttgggagaggtagctgagagaatgcatgagagtcctcggtgcctggcaggaggctggaaggttctagaacactgatggttataagagtgggactgtgagcctgggatcggggggtgtgagacttggatgggagcacaagagtggaaacacagcttctgcacggagcaggcgcagccctcaacaccccgtgcacctgcaccctagggactcttgggtccagatgtgctgtggttttcacaccttcttgggggcaacaggttccaggagccacctgtgggtgccacctgagccacaggctcccaggaaagcagcacagctctcctgcacccagagcttgctgggtggcggaggggaacacagatggttggggaaggcctgaggccagattgggggactctggactggggcagatgaggctcctcagaatcccacctttgaagggaactcagcttataaacacagaggagcaaagttggagggccgggcgtagtggctcacacctgtgatctcagcactttgggaggccaaggaaggtggatcacttgaggccaggagttcgagaccagcctgggcaacatagcaaggccccatctctacaaaaattattattttttaaaaaaattagccaggtgtggtggtgcttgcctatagtcccagctactcgggaggctaaggtgggaggatcgctggagcccaggaatttgaggctgcagtgagctgtgattacaccgttgcactccagcctgggtcacagatcaagaccctgtctcttaaaaataaaagttggagacaagagctggctcacctgaaaggagggattagtaggtaggagggtggatggaggatggatggatgtgtgggtggataggaagatggtattaagttggtgcaaaagtctttgatattactcttaatggctttaataaaaagcttgaaggaagaatgattggttggatagacagagataaatgcatactggaaacaaagataaagataaaacacaagttataccaggccagcaactctattttgttcactgcctttagtcccagcctggcacatagtaggcactcaataaagcctgatttgtagca

SEQ ID NO: 1799 - DNA, 51677 bp, Homo sapiens
aaaaaatatcatttattcttttataaacaatagcaataaatttattatatgttaacagcagagtgatgacatcatcacgtatcacatagcttctggaaaattccaccatacacttttgagagaaggacagataaatggtcgataacatcttagtattatcatggaaaagttttgatcttatagacccctcaacacccaaaagtcgtaatcagttctactcaagtaagatttaaatatatatctatattttctggtctgagattcttttcaactttactcagaaaacatatacctgaagggggagggggagagtgcacagatgagtctgtttgtatgtggttggtcacagaaatgacagaaaatagttatttaatctgaatctggaccctgctgaaaactgccgtgatttctcataacactctcctgccccttcagaagtgaaaactggctgatagtttcccaaatgaataattttcgttaatgttaatcgtgtgatgttgttgagctagaatgttgactcaactgattcgtgaggggagatcttgcaccagatatggaaccaggacttccaccgaaatcttagctctggaagttgatttttttcgtgggagttgagagtgggtgggcgtgcagagcaataacacaatggttctcaaagtgtgttcctggaatagtagcagcagcaacagcacctgggaattgttagacacacaaaacatttggctctattccagaccaacaactcagagactctgaagatgggcccagcgaactcttttaacaaggcctcccggtgattctaatatgctgaactttttgataatgttcaaggactgctggtatgctcatcttgtctttttttccttaaagacaggatcttgctctgttgcccaggctggagtgcagtggtgccatcatgactgactgcagcctcgaactcctgggctcaagcaatcctcctgcctcagcctcctgagtggctaggactacaggcgtatgccaccacatccagccaatttctaattttttgtagggatgtgtcttgctatgctgcccaggctggtctcaaactcctggcctcaagagatgctcccgccttggtctcctagggagctggggttataggcctgagccaccgtgccaggcctgatgcgctcttttccgtggttacgttctaccagtgtgacctccatcccttctccctcttcacttccttctttctttccttccttgcataaacattgaatgtacggatccctttttggtgtttttagacacttctcaggaaacgtacgcattgatttgcaccttgtgtgtccacctgtaaacatcaaattagtgcaggccaaattcagggtatcattcatagcaatcccaaagaaactaactcttaaagaggccaattagtaacgcacaggtaaaactttgctaagtatgattctctgcctgggacctcattcatccttctgttcctgacattgcctcatgggtttggctgccccgttttgaagttacccaaagattattctgccatggcctctgttttttagaaattcaagactgaaggctcagtagaagggggttagcttagaggattgagccaagggtaaaatgatttctgggtagcagcccagagttcttgaaggatgtttattaggcaacgtgaacgggagaatcagcagtcagaagcggctgagaaaggaaccacgcagacaatgtccagttgtatagggtagagtgtgtgtgttgtgtatttacgttagtgctggggctttccttgggactcctgaactgggaagttggaatgagatgaatgtaaacctacttttctttatactacatatagggtggagagagttccataccattcatgctttaatgaacacatatacatgaaaataagatggagagttctagtggttttgcccttcctcttcaacggcgaaattgctatttagaagtgggtagcgctcgctctctgatgggactgagctggcatagagacaaggttgccactgccccgtgtcctgtgatgtgacttcagagcttccaaaacgcaggcaagcacaacggatgtctcctgggcgaccatttagcacctttgatttcacttgggcttcatgacttctgttgtctgttcccggcttcttaccaagaaattcttgttcttttggttttctagattgttcttctactcttcctcctgtagtggtgtaacaaagtcacggtcatatgtgtaacacggcaccaaaaaaatgtggtcctcactctaaaccagtgcacacgccaccatgcctggctaatttttgtatttttagtagagatggggttttgctatgttggccaggctggtctcgaactcctgaccttgtgatctgcctgcctcggccttccaaagtgctgggattacaggtgtgagccactgtgcctggcctaagtttttatatggcagacaatagctgtggaacaggaataataaacagcaactaactgtgctaaatgatgtgcatgcagtaaagcacttggtttctagccagcactgtgctatagaactttctgagatgatggaaatcttttgcagttgtgctgtccgataacacagacacctgtggctagggaacgcttgaaatgtggctagtgcaaccgaggaactgaatttttaattgtatttaatttatttgagtttaaatacacttaagtatccacaggtggctagtggctactgtattggacaatacggtcttagccttttcccagttcttatttggctcatgggaatttctaattactccctactttgcacagagttcccatagcacaagactccaagcagaggtgtgctggtgatgtttaacaagcagctctctgatgacggttgcctgtcttccctggtgtcaatcctccctccacacacagcttccagctggcaatgtgacatcactgatcacgcggttgggaagagatgcgcggtagccaccgtcaaacggtatttccaccatgcggacacaatagatgtaaaccacccagcgaacaaagataacagtaaaaggtagcaaataattaggaagtgatcagttgtaagtaattcttgcctttgtttttaatataatttattaaattgtaaatttaaatattttaatttttttttttttttttgagacagcgtctcaatctgtcacccaggctgcagtgcagtggcatggtcacagctcactgcaatcttgaactgctggactcaagggattctcccacctcgcccttaccagtagctgggactacaggtatgtgccacctcgcctagctaagtttaaaatgtttttgtagagacaaggtctcactttgttgcccaggctggtctcaagcgagcctctcaccttagtctcccgaagtgcaggaattacaggcaggagctactgctcccagcctaaatactttaattttccataatggctatgcttaaaaaccagtttgcagaagtcccgaaaatttaaccgctggctctcacaagccactgtgagccttctgtagcacatcacgggctcctggtcattgcccgaaacaaacaaaaaatatttccccaaccaaaactctctggctgggctacagtgatctttcggtaattcaaatgcagcatttctgttgccacaagagggcaccatgggttgatatcagattctaggaaggcttttggacaaactgactagaggggtcatttctagatgtatgtttgagtctccccaaagattgtagttctgggagaccttgtgggaactcacataggttcacacagttatttgtttcacaacataaacactgaaccattcctacttccaaatagctttgtcctctgggcccgaaggcttttgatcttcaaactaacaaatgaaaaaaatccttgcaaggtgttaaggcttgtcaggtgttcagcctgaggaaggagaggatgcaagtactgagtacacgtacaacatgtcagccacgtcacatccttcccctcctggaagcctaaaatgacaccttaggagtcagctaaccccttagagaaactggtagactgccgggtatatgaatcattcctgctacaataaccctagggggcttatcatttgcactgcagtaatttatactttttaattcccatgaggaaaattaggagtatgttatggacctgatgacccatataagaagggaagagatattttatttttctctctggctgggctaagggctttggttttgggggagtggatctgtattttctcagggtcttactgtggagtttgtatcagggttggccagagtggatgctggcaggggtcagggaggccctggataatcaagagagagacagagggagtttctagagtttactttttctttttctttcttttcttttttctttctttctttttttttttaaacagagtcttgctgtgtcacccagggtggagtgcagtggtacgatctcagctcactgcagcctctgcctcctgggttcaagcgattctcctgcatcagcctcccgagtagctaagattataggtgcgcaccatgacagccagctaatttttgtatttttagaagagacagggtttctccatgttggccaggctggtctcaaactcctgacctcaagtaatccgcctgcctcggcctcccaaagtgctgggattacaagcgtgagtctggccagcttccctgattcttaatgctgttagcctagtgcggtgatcctcagagtctgctccctggaacggcagcgtcagtatcacctgggaacctgatagaaatacagattcctggacctaagcaagacgactgcgtcagaaactccacaggtgggacccagcaatctgtgctttaacaaggcctccagatgattctttcaacaaatgtttttaagttgacacataatagttatatatatttatgaggtatgtagggatgctttgatacctacaaggtacagtgatcagatcatggtatttagcatatccatcatctcaaacatttatcgtttctttatgttcctacagatgattctggtgctagttcaagtttgaaaaccaatggccgggtgtagggttgtcaaacctggatgcatatgtattagatacatctgaggggctttaaaacgtacgactatcccagacataaaaggccacgtgattccatttacacgaaatgtccagaataggcaaatccatagagacggaacatagagtggtggtttcccggggctggggagaatggggaacttggcagtgtggggcttctcttgggaatgatggaagtattctggaatcagtggggatggctgtacaacattgcaaacatactaaataccacttactgtggtttgaatacatcccccagagctcaggtgttggaaacttaatccctaatccagcaatgttgacaggtgagatcttgaagaggtgatcaggtcgcgagggctctgcctcatgaatggattaatgttgttattgcaggagtgggtttgtgataaaagctgagttcagcccctcctgctgtctctcactctcttgcccttctgccttctgccacaggatgacgtagcacaaacgcccttgatacatgggggcccctcgacctcagacttcccagcctccagaatggtaagaaatctctgttctttataagttataaatctctgttctttataaatctctgttctttataagttacccagtctcaggcattctgttacagtagcacaaaatgggctaagacaccactgaactgtacattttatgatggttaaatgatgaattttatctcaattaaaaatacgtactgatgtcttgggctcaccccagacattctgactggagcccaatcattgatatcttttacctttttcttttttttttttgagacagagtttcactcttgttgcccaggctggagtgtagtggcgcgatcttggctcactgcaacctccgcctcctgggttcaagtgattctcctgtctcagcctcgcaagtagctgggattacaggcacccaccaccacgcctggcttatttttgtattttttagtagaaacagggtttcagcatgttgtccagcctggtcctgaactcctgacctcaggtaaccacctgcctcagcctcccaaagtgctgggattacaggcatgagccacaactcctgggctatcttttaactttttaaattattatgctgttttggctgaacaacctacataagctacaaaaatatttcctattgcaacaaatttgttcttctattgttgcaaatgaagattccccccaaattcaaagtgggtcacaatggttttggtgacaggatttccctcttgtaaacctctcttaaaagatgtcacagctatgaataacactgagccacaggagaagcacagccctttggactgccttccttttcctgtggaatttactcatatcttgccactcactggtattttagaagactgtctcctggatgttctaagatgcatgcagggttgaaaatctgagttaatgcaaaaagaccacacatggtttacattcctggtcaaggggatgccggtgtgagcttctgtggacgggagggtggggagcacaggataggcaaagctcagcatagatgctgccctgggtcctctataggtaggggctgggtgggaaaatcatgggctctagattcatgttgcagtgctggcctctgctgtgccatcttctccaagctgttgcatctctctaggccacagctattccaaaggtttctgagaaggtagatttcaataatgtttataaaacaagcatcaagcctggtgtatagtgggtgctcaatgaatgtgaggctcctttgccttcccatttccctggtcgtttaatttttttttttttttttttttgagacagagtcttgctctgtcacccaggctggagtgcagtggtgagatttctgttcactgcaacctccgcctcccaggttcaagcaatcttcctgcctcagccgcccaagtagctgggattacaggcacctgccaccatgcccaactgattttttgtatttttagtagagatggggttttgccatgttggccaggcttgtctcaaactcctgacctcaggtgatccactcagccttggcctcccaaagtgttgtgattaccagcgtgagccactgcacccggcggtgctttaattctttttaactgactctttccgaggcatggattggcctctccctttgccactccctgaactgcaggtgattagagagagcatggagggggtaggggggaggcagggtggggctgggtacaggactttgatctgaccaagggctgccttggtgatgccacacttactgtctccgctgccaggtgagcccactcaggaggaggacgctgatcagcaggaaaacacagccggccactgtcaatagagagagggagttcagcaaagggccctgggcttggcatgggggcagcaggagccagggccacagggcaggctgaggacatccccaaagagcaaggcggaggctgcagcctctcttccctgtctcaggaagtaggtccctccccatgggatttcctaggagtcttgaggaacagggcagggaggacagggtgagggtggagggagcttcccctcaggaggcacccttctctcacaaaagcccctcagaaaggctcagaggccaggcctcgtttaaggacaccgagagcgcctggtaaaagaaatgttgaaatatgaagatgatgagaagcacattaacatctcctgaaagaggtcgggttttccagatgctgctctgctgaggttttggaggctgacatttgtttactttctaggcagatgcagactcagagtctgtttttccctcctaccaggaaacaatggcagtgtttctggaagcctgtcctctctgactggctacgtggctccttcctcccactcttgacccctggcagaggcccggggtacagcccttccagatcagcttgagaggagctgatagggctgacttgagactttgctcacagcatcctgtaactggttcatgcgaattctgagttacgtcagtatctggattagtctttcactcacacattctgcagtgtaaggaaggggtcctttcagtcaaccaaccaacctaccaatcaactaaccaactaacaaacctactaacctaccaacaaactaaccaaccaaccaatctaccaatctatctaccaaccaactcactaaccaaccaaccagctaaccaaccaaactaccaacaaaactaccaaccaacctgccaatctaccaccctaacaaccaacctaccaaccaacctatcaacttatcaaccaacccaccaaccaacctatcaacttaccaaccaacctatcaacttatcaaccaacccaccaaccaacctatcaacttgccaaccaacctaccaaccaactaaccaactaacccaccaacctgccaatctaccaacctaccaaccaatcaactaacctaccaacatacaaaccaacctgccaaccaagcaaccaaccaactaaccaactaacctcccaacctacgaaccaacttaccaatcaactagccaacctacctatcaacctaccagtcaaccaactaaccaacctaccagccaaccaactaaccaacctactaaccagtcaacctgtccatatctcagcctggtgtacattttgtccacaaagccagtgccccactcacctgctacctggtactctgttgtaaatatggacgtctccatggttgcagccatttctgtctgtatttgaaaatctgtgaaaaagagataaagagagacactcctgctaccgtgactttaggacagcacgaggctaaaggaagtcagggtgtctctgtgaatgagaagctcagaggctggtgggagacacgtggtggtggtgagggaaggtgttccatctctgcctggggaccgtgcttggtcctggtcctgggttccctctttctgacacttgctttggggcctgcaggttgctgaggccctgtccctgctcagagggagaggaggctgctgtgggcttctcccctacaggtcacctccgcctatctccctgagcctggctcctggtcacctctgcccttttggactaggcctctgtggtccagcgtttgtcttctcccgcacctgttgttgtgacgaggcaggaagtctcactctcaggacggccttcggggcttgcctgaggcttctcttcacctgggggagagagtaagtgatgctggtggagctaaacacaggagtcagggcctcactcccaccccgcctgccccaggcagccggccccagacacgcccgaggaggcaggaatcctggtgtgggcacttcgccagggatgccacccctcatggttccacagcaggggcactgggaagcggtgaagtggtctcagcagagcagacgaggctgaattctaactctgaccctagctgtccccaaaactctgagcaatgctttctccccagcctccctccccagtcctggtttccatctgtgacttggaaacaggtcataataatacgaatgccattgaaccactggatggagcagagatgcactaagggacagctgcttctgtgccaggctctccacttctcctgaggggtcagcaaccctggctctgccctgcctctcaccctcttccaaggaagcagcaagcattccctggctgtcagggtggcccagggaagcagctaagggaacaaaacagcctccctagggaacccaagagaaggacatggagtatgagaagtgcagtgagcaagaaaaccaggaatacttgtggttgaatgtaagtcactttttttttttgagacggagtcttgctgttgcccaggctggagtgcagtggtgtgatctcagctcactgcaactccacctcctgggttcaagtgattctcctgcctcagcctcccaagtagctgggattacaggcacccaccaccacgcccagataatttttgtatttttagtagagacggggtttcaccatgttggccaggctggtctcgaactcctgacctaaagtgatctgcccgccttggcctcccagagtgctgggattacaggtgtgagccactgtgcccagcctgcatgtaagtcacttttgattgtcgtgatactaataagatttcagaaggaagacagcaggagacctcgacatcggtgggctgagcatttgcatgagtatgtgtgtgtgtgtgtgtgtgtgcgcgcatgtgcactgagtaagtcccgactctgcacattttatgtttatttttacaagctcagctggggaatggcacaaggggaaggaacatgctgaccgtggagggctgttcagatcatgcatttacacgatcaccagtaagaggaaaaatgtgtgagtgggaaactggacttgcccttggagccagaggaggccttggtggcttagagaagtagtggacttaggaccaactacgaggcagcatctagggtgcttaggagagggctttccttctcttctgtctccaacctttctccccactcagggcacagggggaccttcattgaaggagcccttagagtccatctgatctggtctatttaaatttttttttttttctcagaatgagaaaaaatggaagcccagggagatcaagggtcttgtccaaggaccactcttgtccagcaggagtggtcagggattccactctggtcagcctgatggagcaaagcaacattgtggaccccagaagggagccaccctacctggaaactgactggtctccatttcacctgtgcatatgagctggggctgggtccaccttgtcttcccgtgggtcattttgcagacgctctcagcaggacctctgtgtagagccctgtatccctggacgcactgataataaaccatctgccccaccacgaaatgataaattctctctgtggcttcattttcccatggtggaggttccctgcagtgacctggaagatggaaggaatgctctgaaggcaagttggggacagcaccgcgagtgagtccaggttgcctcttgctagggactggaccttggttcttactctcttgactgcttgctcatcctttcattcaaccaatatatgttgagaacgtctgagcgtggggaagtttgctaggccctgtaggaaggcacgaagaccctgtcactcctgcaaggggtggacagtggattgggtaagaaaggcatgtgaaggatagcagacgttggcaatgggaacacagaggaatgagcgattcattctggttggtgcggccccgagacaggaacgccacaactgcctcttggaagacagtgcaggtgttgacagtggacaggagtgggcggggcagtctcagctgagacacaagggtaggctcaagcctatttgggccaatggagcatgaagaccaccttggatttctgctggacaagtgaggaagtgcattcttgggggcagcggctgggcatcttgggatgatgtcggaaggattggggacaacaccaaagccaggaggagggacgggctgagggaacctcagagaaatggagcaccatctctgatcaagccacacctgaaggttgacacacatgcgccctttcaagacgtctcaaaatttcccatccccagaactttccactcacccaactacatcccaggcctgacggacctgtggcctgagaccatgtcttgttctgattaaatctctgaattccccacccacagcccccaacctggacatatggaattgtatgtgccctctaaccccagcctgtgaaactgcgcacgtgctctgaacttccagactctccccaaccctgcatacccaacagagcctctgtaaatatcctccagagcctcttccccagcaggaagctgggtggccctgtcccaggctggctcctgccatgtggcaccttgaacatcacgactgaacttgtgttttggtctcaggataaaaggttgtttgacagccagtacaattcgtaactgtctgaacatgtttgaattgggtttgcttctttccaatgaaaacacccaaactgagacaatctttgaaacatccctcaggcagagccagccttcgagaaaggacaacaagcattggcctctttgaagccttccaataactgtgcagggtgatatgggggaagtagaacaaaacaaacaaatgtgcttggaaacaccattccaggacaaagtcggaaggggaaggagtaagagcatcatgttgcaactgtgcccctagattagtctgttttaaaaaataaaataatggaagctgtaagtaaattcaaactcttttaaaataagtaatcagcagaaagtttcctcatctaatctgggagacctgaggtctgattccagccctactatgtgagcttaaccaaatctttttatcttttgtgcatctcagtttcttcagtaagttgaagtaacccttcctggtcctgactcattgtatagccaggctcaaatgggatggtatctgatacagttctttgtaaggttgtaaaatcagcaaagggctctgaagtctcctaaggctagcctgaccttagaaagctcaattcttcctagcaggttctgtgggttttttttcttttttgttttgtttttttgaggggggacagagtcttcctctgtcactcaggctggagtgcagtgatgcaatctctgctcactgcaacctccacctcctgatttcaagcaattctcatgccttggcctcctgagtagctgggactacaggcatccaccaccatgcccagcttaatttttgtatgattgtagagacaaggtttcaccatgttggccaggctggtctcgaactcctgacctcaagtgatctgcctgcctcagactcccacagtgctgggattacaggcgtgagccactgcgcccagcccattttcttgacaccataactgaatcccaattcagtcgtgggaaagcagagggcagacaagggacagccacagtgcccactcatgcacagactgctggccaggacacacgcatctggagcttttgagactcacaagtgtggcatgcacattttacaaccttgccctggaagaaatactgggaagcaagtaatttttttgcggtgcgttgtcttgtgcttaaggggaagacgcagagcgtttccttgagggcagggatcgttgtcacactcttgtttgtgtcttctatcagcagggcctggcacacagacccaacagacgcttttaagttgagttgaatttgggttgaattctatttggccagttaccaaaccagggagtaagcccagacctggattggctgccgtcagattggctttagttgctgagcaaacagcctctgagcaactctgcactaattcttgtctgcaatgatgtcttgggaggacggagccacatgcatgtgtttatagaaggcagggcagaccttcttcctttgggtacacatcatctgcctgcaggagaagggtgcgctagcaggagttagctggaggacagattcatctctcacctggaaggctcgcttggtccactggctgcattggactttgcatttctgtggttttcctttctttctgttcttcaggttgaggtgtcacttgtttcgttgtgttccgagtggctagaaaatatagatggaatgatgcagataatttcacaaatgcttcatagaaaacactgttcatgtattcattcacttgagaagcacacctgtccagggcccacgatgtgtctggtggtgtctggctgctgagcttacaaatacgaaaccagagtatgccctcccagcaccggcctctgggtattcaagtgcatatggcaatgcccacgacatgtttttgagcgtgtgtatacgtgtctgtgcatgtcatgtatgttacgtgtctgtgtatgccatgtatgttacgtgtctgtgtatgtcatgtatgttatgtgtgcatgtgtgtgtctctcaccaaaagggactccttgcttgctgtcaattgtctctgtgttgtttgacagcagcaggagtggtctcactccacaacacactgatcctttgctccctaaggctgttcagaatgcttgaagttagagacgccatcttaacacaatgacaaggaaacttctagaacagccctctctattgtgaagagtttggcaaaggagttgagtctgagtgccccagtgaggggggtgatcagtattccagctcaggataaaagagggtgtctaggtcaggtgtggtggctcacacctataattccagcacattgggaggctgaggcaggaggactgcttgagcccaggagtttaagaccagcctggacaacatggggaaaccccatcactaacaaaaaatacaaaatattagccaggcatggtggtgtgcgcctataaggcccaggcaggagaatcacttgaggccaggagttcgagaccagcctggccaacatggcgaaaccccatctttgctaaaaataaaaaaattagccaggcatggtggtgcacacctgtagtcccagctacttgggcagctgtggcacaagattcacttgaacccaggaggtggaggttgcagtgatctgagattgtaccaccgcaccccagcctgggcaacagagcgagactgtctcaaaaataaaaataaaattgtgtggccgggcactgtgactcatgcctgtaatcccagcattttgggtggctgagatgggcagattactcaaggtcaggagtttgagaccagcctggccaacatggtgaaaccccatctctactaaaaatgcaaaaattagccaggcatggtggagggtgcctgtaatcccagctactcaggaggctgaggcaggagaatcacttgaagccaggaggcggaagttgcagtgagccgagatcgcgtgccattgcactccagcctaggcaacagagtgagagtctgtctccaaaaaaaaaaaaaattgtgtttagtgaatgacttttcaggaaccactaaaattagttatcctgtagactggactggcccatttgtgtctatagggctgagtgaacaaaagctgggctctgtctcactctttgctgcagttcttttgttcttggtagtcacagaagggacacttaccagagcttgtgcattgacattggttgtcccaggacgagtggctagagtttcctgtacagagcatatagagtgacccgctttttattctgcggaaacctctcttgcattcacagttcaacatggttccttccttgtaggccatggctttgaatgtggcgtgtgggatctctggcgggtcatcgtcacagagctctgcaaagcaaaagaagcctattaggaactcaagaggccccaggcaagtactcacatatttaatcctataatgacttaatcacatatttcttcactttatttaaaagatggtatgccctactttttgtgagaaagcaactaaggctgctaccattgttctttagaaagctttgtatcagagctggctcaaaaattaactacaaccaagctcctctccaaagcacaatgtatttcaaactagatgagtagaaattaacaaggttttattccgaatatgcctcatgtcaagcaagtatggagagaggagggtcaaggaatgtgaagaaaggaagaagcaaagttacgtacatttaattgaggggcaaaatatgtctgtgcaagatacttttaaggatatacgagttgttagactttctataattaatgactgtgcgccattttttgagaaatatacagaaagtgcttcactcaatgtctggcaaataggaaatgtgtatttctcacccacctgcccacctctgagttcaccaaataccttcttatattatgaagaccttagcctccctcagcctgaaaaatggactctggtatctcactaaaggcaccagaagcagtggtcaaacatcaaactattaaaaggaaaagtggcacaggtctaatcagaaaaataattccattgcctactttgcaacaagttctctgctctaagagattagattttggggggaaatatcacatgctggataaaggaagtggacggggagatgacagggacaggaagaggcaggaaagcaggagtctgtggcctctccgtcaatggaagcccacacggaggctgatcagggctgctggctgtacttatggctgtgggttggccggttgtgtattggtcattcaggttaagtgaagcttctctgtgcccttagactctgcccagcaccttgtcctccggaagaccatccccatccaatggctcaggactctcctgtctcccctaagaactgaaggtagggaggctgggtgcaatggctcatgcctgtaattccagcactttgggaggccaaggcgggtagatcacatgaggtcagcagttcaaaaccagcctggccagcatggtgaaaaccacagtctctactaaaaatacaaaaaaattagccgggcgtggtggcatgtgcctgtggtcccagttacttgggaggctgaggcaggagaatcacttgaacccaggaggcagaggttgcagtgggccgagatcacgccactgcactccagcctgggaaacccagcaagactctgtctcaaaaaaaaaaacgaagatagggagaaatcagacagcttggcccatctctaaccaacaagggactaagcaaaagcaatttaaatgggctccatgggccagaaattacagtggaacaggcaacataagtgctcaataaatgctggtaatctcatgataaggcaagagcagcagcatggtgggaaggagaaagatgggtttctaacttctagctccagcagcttacaagctacatagttttattattttacttctctaaggctcagcttcgtgctgtaataattattattttattgatttaatgattatagcaaataatatactaaggtaacttgaagaaagcctggaaaataacaggtatggaatagatggtagttctgttcctttcctttttctcactgtccagaagaagagaatggtaattcagatagagactggactgaagtttaccttaacctttaactcctgcaaaagtttgtctctctgtacttctcatatcactggtaccatttgttggcacttattatggatcaacaccaaccaatattttaagtatcagaagataaatctgttactaaagcaagacatggataataatcagaaaaaccagtgaagacttctgcttccagccatcacagagtaactgggaccaaaacttacgtttctgctgaaacagctgtaaaaccagtccaaatgtatacagcaagtgctttcaggtgctgaacaacaggcagctcagggctacatgattttggaggagggaaacacgtgagaggcgcccacagttgccctggcttccttcctggggtgctttccttcccggcagcacccaggtggaacccaagcagagtggtttcattgacgtgacatgactgggatttgtggggtggggctctggagaggacactgcatgaaggtcgccccaaaattatgtataggggtccacctcaggttcttagccaagagctggtctgaacctgaacagggcagaactcagtgaaacttagccctgattgtccattgtgagggctgagagaagaagagttatgctaagttttatttataaaaacaggtgtctgagctgtgggttgtagttttccaatcctgctttagagaaagaggcatccctaggatgaatttcaaaaccaaaatagacctgcccttacaaagattaaaaccaagcctaatagacaagaggatgcgctagtcatttaactgcctggcagagcaaaatgcattaccttttaaaggaccataagataatctagaccctttataatgtatagctcataatatccagcaaattaaaagaaaatctagacatgtgaagaaacaggaaaatgtgacatacttgacctactcaaaaaagtgctcaatagaaacagacccgtaaaattgggtgtggtggctcatgcctgtaatcccagcactttggggcgacaaggcaggcggatcatctgaggtcaggagttccagaccagcctggccagcatggtgacatcccatctatactaaaaatacaaaagatcagccgagtgtggcagcgcatgtctgtagtcccaggtacttgggaggctgaggcaggagaattgcttgagcctgggaggtggaggttgcagtcagccgagcaccccagcctgggttacagagtgagtgagagtctgtctcaaaaaaaaaaaaaaaagacccctaaaatgacctagattttggaattagcacaaaaggaatttaaaacagttgtaattacactcaatgacttaaagcagaggtcagtaaactatgacctgcagatttgctgccatttattttatttatttatttatttatttatttatttatttatttatttatttatttttgagacagagtttcgctcttgttgcccaggctggagtgcaatggtgcaatcttgactcactgcaacctctgccccccgggttcaagcgattctcctgcctcagcctcccaagtagctgggattataggtgtgcgccaacacgtctggctactttttgtgtttttagtagagatgaggtttcaccacgtttgccaggctggtctcgaactcctgacctcaggtgatccacctgcctcggcctcccaaagtgctaggattacaggagtgagacactgtgttcagtggtttatttttataaataaagttttattggaagaaagacacacccatttatttacattttgtctatggctgcttttctgctataatggcagagttgagtagttgcagtggagtaacatcgccaggtagcctaaaatatttactctctggccctttcagaaaaaaaattgccaactgctaatttaaagaaaaaatggttataatgagtgaaacaacaggatatctcagtagataaatgaaaacttgtaatttttttttttgagatggagtcttgctctgttgcccaggctggagtgcagtggcacaatcttggctcactgaaacctctgcctcccagattcaagtgattcttctgcctcagcctcccaaatagcttggattacgggcacatgccatcatacatggctaatttttgtatttttagtagagatggggtttcaccatgttgaccaggctggtctcgaattcctgacctcagatgatccacctgccttggcctcccaaagtgctgggattacaggtgtgagccaccgtgcccagccaatatttttaaacataaaaaattaaaactaaaagttacaatatctgaaatgagcctagccggggcttgaaggcaaatcaatagaaattatccaaactgatgaacacaagaaatctgaaaaagaatggacctttggcatgctgtaagacaatattaaatagcctaacctacatttaattgaattcccaatgatagagaagagaaagaatggagcagaaaaaatatatgaagaaataatggccaaaaatttttgaaatttgatgacagatactgatttacagatccagatgttcacggcaccaagcaagatacgtataaagaaaagcccatctatatacatcgtagctaaactgctgaaaaccaaagataatgagaaaatcttaaaagtggccagagggaaaggacacgtacctacagcggaacgatgatgaataacaactgacttctcaacagaaacaatagaagcagaaaataatggcacaacatattcaaagttttaaaagaaaaaaacccgtcaaccttgaaatctacctagagacaatatcctctaaaaatgagggtgaatttagtatattttcagataaaagaaagcttagagaatttattatggcacatctgcattacactaaagaaaaattttcaagcaaaagagaaattacactagctagaaacataaatcgacatgaagtaataaagaacacgtaaatatttagataagtgaaaaggccactttttgtttttaacatctttgaaagacaactgtttaaaacaaaaataataatatggtatggtgggttctgttgaacatgtaaatgtaaaatatacagcagtcctagtataaaagttagggagaatggaattgtactgttttaggtttttatatcatatagaaaatggtacaatattaagtaagtagatagtgataagttaaggattcatgctgaatagcctagagaaaccaccaaataataccacaaagagtgtagctaaaaagaatattaaatttgtttggttagccaaactgaagagagaaaaggaagaatagagtaataaaaatagaaaaggaacagctaagaaacagatagcaagaaggtagacttgaagccaaccctatcagtaattacattaaatataaatggacaaaaatccatactttaagagatagaaactttcagactggattaaacagcagggcccaactatatgctgtcttcaagagaacacactttaaatacaataaaaatgatgggttgagaaaacaggatagaaaaagatataatctacaaagataagcataaggaagctggtatggttatattaatatcaggaagtagatttcaagataaggaacattattctcagataacatgattgtttacataaaattactgagggatctgcaaaatggctaccagaatttagcaagttagcaatttcagtatatatatatacatatatatatatatatatatatatatatatatatatatgtatatatatatatatatgtatatatatgtatatatatatcacttgtagttagttctatatactgacacaaccaattagaaaattaaaaatttaaaaacaattgtatttacaattacatcaaaaaacataaaatgtttgtaaataagcctaccaaaaacttgtaataccactaaactgaaaactctgaaatattgctgagacatattttaaaagaattaagcaaatggaaaaatatactatctttatagattgtaacattcatttaaaaaatctattcaccttaaattgatcaattaattcaaggcaactacagtttaaaaatccaacacaattttttagtacaaatttggaagttatttctaaaagctccttagaaacacaaaagacctagaatatctaagacaatcgtaaagatgtatacatttggaggattcatgacatctgatattcaggctttctataaaactatggaaatcaaggcagcgtagtattagcataaggacaaacagtaatgaaacagagcagaaagtcctgaaatggactcaactcatgtttgttcaactgctttttttttaaacaaataaatgtgccaaggaaattcaatgagaaaggaaaaatcttttcgacaaatgcttctggagcaaatggataaatgtatgagaaaaaaactcacatcttatgcaagaattaattttattatatatataaagataaagatctatgtactaggtctatatcttatagatgtaaccataaaaggcaaaactaaaaagatttcagaagaaaattaaggcaaatgactttgcaagttggagataggcaaagattgctcatagaggatgcaaaagcactgactataaaagaaaaaaattgagaatgtctactcatccagagacattaagaaaatgaaaaagtaggcagggtgtggtggctcacgcctgtaatcccagcactttgggaggccggggcgggcagatcacaaggtcaggagatggagaccatcctggctaacacggtgaaaccctgtctctactaaaaatacaaaaaaattagccgggtgtggtggtgtgcgcctgtagtcccacctgctggggaggctgaggcaggagaatggcgtgaacttgggaggtggagcttgcagtgagcccagatcgcgtcactgcactccagcctgggtgacagagcgagactccatctcaaaaaaaaaaaaaagaaaaaaatgaaaaagtaaatgatagactgagagaaaatatttgcaatatatatatttgtcacaaatacttgtgtccagaatatataaagaaaaacaaagcaagagtaaaaggcaaacagcccaataaatgggcaaagacttgaacaatcacttccccaaagaagatacacgactatcaataaacacttgaaagtgtatttaacatcagatatcaataaaatgcaagttgaaaacaatgatgagatagcccattggggaaatggaggaaatggataaaagactgatacgtcaaatactggggaggaagtagaactaccagaactctcttatgttactggtggcagtgtaagtaatgtaattactttggaacactatctgaaagtatttggccaggcatggtggctcacgcctgtaatctcagcactttaggaggctgagacaggtggatcattttaagtcaggagtttgagaccagcccggtcaacatggcgaaaccctttctctactaaggaggcagaggttgcagtgagctgagatcacgccactgccctccagcctgggcaacagagtgagactctgtctcaaaaacaaacaaagaaacaaacaaacaacaacaaaaaaaaaacaaaaaaagaaagtatttttattgacgttaaatatatacctgccctacaattcagcaattctacttctaggtatttatctaagaggaatgaagggatgtgtctacagaaagacttttataaaatatttatagtaacttctttcttttattaagccccttccattctagtacatagtagctttattaataataaccaactcaataattcaaacatccatcattgggagaacagacaagtagcttatgatatagtcatactatagaaaccattcaaaaataaaaaataatgaactattgatacaggcaatattgataaatctcaaaaatgttatgttgaacaaaataagctaaacacgaaatagtgcatacactttgctttcatttatatgaagttcacaaaaagacaaaagttatatccagagatagaaagcagacagtggtttcttgtggtaggtgggtattgaccagaaggcagaagtgatgaaaacgtttttgcagctgtacacatttgtcaaaactcatcaaattgtatgccgcagatctatgcatttctttataagtaattttagctcaacaaaatgagcgagaagcatatttagctactcttttgtaattattcattagcacaaataaccaggattgacctcagatgtttttggaatctgagatgtcaatcacaagccaagaacatttctaaacacatcaatttgaaaagaaggaaacaaattgtcttggaagctattttgtgcccttagaaactcttgaattccatgagagtgcgtttttctagatgaggtcatgggcattttcagagtcatcataaattagcccgagtgtctgaagaggtcatgcggggacaaggggaagttccagaacttcttattctcacagactttcctttcataaagaatctttcctggaatttaggatcttgacacctccaggtctgtagctcagtaaccactaaagagcttggctataatccttttccctgaaaggccttgtcaggaagtgccaaacatcacctgaaggcagcaggaggtagaagagtgtgtggaaaggtacgctggagggttgctctttttcaatctaataggaataaatttgggattttttttttagcccttctcagtgtagtgttataaaagcagcaacagaacaacatccaaaaaaagaataaaaaataatttgtctaaaagtcttgcacagtaataacaggaggattccacttatatgactccaaaatgttgaaatcatctttccctatattatcattcttttattttttaagacagcatacaactgtcctcattctctagttttactcactaacaatgccaaaaattacttctcaaaattcagctaacaagggcttttctctgcctttacacttcctcctgtctttccagacccacttcctgcttctcccaatgggtcttctcaacataaatcattctctcccggaatattttccaattcctagctctacgcactcccccagctcacaccaagggacctgggagcttgggaggcagacagaattttccttagaagaggggaaggggaatatttttctccctgtaattttaaagtattggcacgattctggatgtagacatcaccttcttttctgagattatttgaagtgtctggtgcctatggactgtgggaaaatttgagatgatcaattcgggagttggaggtgggggtgtagggtggtaaacactcaaggcttagaaattggggctccccaccctgcactagggtctcacacaaaggggttggcacagggctgagaagcagtggggctcctgtccaccctgcccagcacctactcccaccaggcaactgagtggtatttagtctgcaagactagcccagaaacttgaatgggaccctgagagagccaggggttccttgggcccccgctaggggactttctgtttgccctgggtctccctgtgtgggcagggatggagagtgagggcctgccttcatggcagtaggctctgagtgggtgactggcgccaggccaagttctaggtgggcttcccaaagccacattcaggcaggacggagctgctcttgcacacggtttcgtgggctggattttctctgttgcacacatgcttagtatctgtctctccctttgttcctgagtggtgggccgcacatgaggctctgagcaggctatatctctattctggcaataaaagtactctggacactgttaaggtgagaaaagaaaagaaatcggggctcccaggaggagaatcctgaaccacgggctctgcggtgatgtggccttcctctttagtttttgtgccttttatgtgggcagagggaaaaagagacagccagcagtgatcattaatcctgaaaatgccgagggctttggcctgggacccacaccaagacagagtcaaaccgagttcttctagtgttgagcgtgtttcacatcttccgttggagtttgctgtggatgctcattagacagacatgggcagaatcccacttgttcctcgtccttttccacctcacctccatcattgtggctgaaatacacgatcatgggtgtatctttccttgtggatttgttgcctctaggagttctgtatgcagctgaagggtaacatcccttgggagcttttgccttgtctggctgacgccttggcaatcgcaagtgacagtgacggagagccacctcctctggaatgcatcatggaacaggtctgggagaacagagggtgcaggtgaagggccctcgacaatgcttctctttgcattgtggggtttccccttcaatggattgctaaagattcaacttctctgtctctttgtgtgcccgctagaaagggaaaagccaggcatttgtagtcctcctgccacagatgaccagaatgacctcacccaggacaaacggcgacagatttaggaattcaagccagcttttctgactcccaggcacctgctctctcctttcgagtgttcgactccactctcagtcactcgtcactcttcccagaaggacaaatgtgcagcttctatgtcttggatttcaaataaaagacgaggaacttggtgaaatgaggtggtctttgccttccgcgtcactctctgctcctcctggcaagaggccccatttttcttgccactgaggttaagtgaaaacaaaacaaaacaaacaaacaaaaaagaggccccattcacagtaaagataaacagcagcctgggcaggccagcggctcttccctgacgtggaattatgagccctctttcttcgattttgccacatacccgcagctgcactcccataatctgaaagctgtccctttaatttttaccacttcattattagaattggagtagaatgaaaattaatttttccctgagctatttttgtgtcccttgagttaaccagaaataccaaccctggaaagagatgtgggggacagtcattttagagagcggacaccactgctgaagaagaaggatatcccggttggctgctctagagccggcaggacggatgctgaggttgttcgcagcagcgtgtgtgcagagcccccgggatcttgcagactgggatttgtcagggcaggtgtggacattgaggctatttctaacaagctcctacatgatgctggggctgcagagccccaggccgcacttggagtatgagagtttccagggagtgaagccccggctgctctctctgccccctctccatctgccccctgggtgaggacaggactcccatccctccagtgcacagtgagtgctgctcaatctgcatccacagcggtttgtgcccagatgcttcctcactcagcgtctaacagggtgcagtggaaacgtcattgactggaggaaaggtgtgtgggtgagaaacgtttgtcggttgagtaactttttgtcgttattttttttctctgatgttcaaagtaagagaaaactcatctggcccctggagcccatgtgagcaacatgaaagataaagggaaaagggggctgataaagatgtggaccgagtctgagataagattctttgccccttgggtgaatccaggtgaagttgttttactcttagcccagccagccctggataaaggcttcatccctcttctctttcctgtccatatatcagaactttaagctctacttgtacccagtgaagattagaataacgcacggagcacaggaaatgtctaggtgatgatttcactgagctttacaagggacacaggtacgcatcaagagcttgggccactgggtaaagagggatctggttcttgctctaacgcggttcatcttctgtgtcagaatcagatagattctgggtgtcagagacccgaatcttcctcttgttccgctcactgcccccctgtggccccttctcatttcaaatgctctgtctgtaatatgaaatgaaaagaattcctcccagacccctagccaaatttcaccttaagctcgttgactcccagaggaaatctctgtgggagactggaaagaggacgctggagccagaggctatctttgatagtgaggtgaggtttactgtttaataagaactccaaagatatgcctaatattgaaggttgtctctcgcttccttgggaaacccaaaccagaagtttaggccgtatagaaagtaagtggtttgggtgcaaaagggatgtagaacatcccttttaatggtatcatagaatatgagaactagaagagagctcaaagatcatttaggccaacctctacattttatagataagaacactgggcctgtggtcattccacaagtttgtggcaagccttggattacaacagatcaccaggttccctgactcctagttcagtgcttttccaacacccagaatcataatcttcaggaaggagcgtgcttttcacctatctgttgaaggttatctcttacaaagaggtggagctatgtctaaactatctgggtgctgggaggtgtttgtgtgatgttgtggtttagttcagattattatctttgaagaagtcagagggcccaggccctccatttggggttatctatataataataactatgatgtctgagccctgcctatgtgctgcttctttgcatatattaccttcaatgctcaccatggctctggaaggtagatactgtcatccccactttagaaagcaagagattgaggttcagagagattaagtaagttggctaaaccacacagctcaaggtggtgggacaggagtcacgtgaaagtctactattgctgccctcatgtcagccttctaaaaaatctcacttttactttcaggaaattctttcaaatagcaaacataaatgcgcacaaagaagcaaggaggaagaggagggaactgtgtagaaaaggtttgtggaggcaatttgttctaaggttatttattatttgagaggaaggctatgatattggttaaatctaggctttgtaaagtctggattcatgttaagatgttaaaaattacatctaaaatgacagagtaaagtgaataacttacaagctattggaagaaaataaaataggataaaaacttacttaaatcaaaagaagggggaaatgcatagaaagagaaggtaaaaaataaagaacaaaataagacagtggaaattcatcaaactatatcagtaataattatcaatgtggatagattaaccctgcagttacagaatgttggactgcatatatttttaaaaatatgcagttatatgatgtttataagagacatgcttaaagcataaatgctccaaaagtttgaaactaaaagaatggacaattgaatccaaggagttatattaacatcagacttcaaggcagaagcattaatagaaatacagaagtcagtacgtattgctaaagattcaattcaccaggaaaacataaaaatgctatatgtgtatgcactcaaaaacatcacttcaaaatatacaaatcaagaatcaggaaaacataacacttacgtacttctatgcacccaataacataacttcaaaatacacaaagcaaatattgacaaaacaaggataaatttagaaatctactatcataatgagaaattttaacagtgtcttcctttatgatggataggacagacagaaaatcagtaagaacaatcaaatgtgataaccacaattaacaaatttgattccaacaatagcagagcccactcttttttcaagcacacatgggacatttacaaggcagtagaggagttgaaggcaagttaggggcaaagagtgggtatctatggggtaggaaaatggaagtctagataaggaataaacagaaggaaatgttgaaggtaaagctctgggtgtcagaatcttcctcctctttcactcactggctcactgtggtcccttctcatttcagatgctccgtctgtaacacgaaatgaaaagaattcctcccaatcatgtaaccataggagcttctcatacaccccaagccatttccttttaccatgctgatatgtccttttaggcctcttgacatagtaccccttgctgggaatcctgcccctgcccatgagccaggcaacagaatgaaggctgctcttaactataaggtgcctgaaaggtgggtgggagttcaactggaaggttaggcacgtcaggccattctggcagagaatgtgtaaaagtgtaaaacagcatcatcatatggaagatacaagagactacaggtagaatgttttgctgaagcatgaatcgtgagggtatgaaggatggaaatatgaggatcagttgaaataacataagtgacattgaaatctgtaaaatgctccacaaattttgattgttgctacaatgacctcttgagcggtgttgtttttagaacccaatgataaaatatatagttactttctaagctgaaaaacaataattaaagcgttcattgcttaaagcttgattgtgtcacaacgaggaaatagagtttcttttgaattcatattctaagaactatttatgagaatgctgtattcggttgtttcctgtcacctgtattcacattaatagattataacggatttcaatctactgaagcatagtcaattctctgattgctgccaaccaaatcaccatggttgaatttgaatatttccagtcatttttgatggttgttgcctgcccacattacctgttatttatttaaactaccttatatacgaatacacttttatatataatttagaattttttcttagccatcattaaatcacacctaaatttgcaatacatggtattgtcttagttgttcactttgccttttgtctctcttttcctaaacctaccttttcttccccaaagacactcaaggacttaatggcatctttgggtttttctcactccaattgactttaaaagaaccctcgttattagtgatctgataaaactggtaacatagataaggcatacaattgttggaaaaagagaagataaaaataatcattctatgtgaggaatttaattaagtacttagaaaacccaagacggttaaagtattagaactattaagagtttcataaggtggccagatagaaaattcatttataaaattcaacattttttatatatcagcaacaaccaatccaaaaatataatgggaaatgatattttttaacagttgtcaatccttagttgccagaaatgtgctaagttctgaacagaagatcctggaactgggagagatgttaattaactgtggacttttaacatcacgagtactttgagaacttaaagggtgagttaattctttttttttttttttttttgagacggagtctcgctttgtctcccaggctggagtgcagtggtgcaatcttggctcactgcaagctccgcctctcgggttcaggccattctgcctcagtctcccgagtagctgggactgcaggcgcccacgatcacgcccagctaatttttttgtatttttagtagagacggggtttcactgtgttagccaggatggtctcaatctcctgacctcgtgatccacccgcctcggcctcccaaaatgctgggattacaggggggagccactgcgcccggccaatggtgacttaattctaaaagtagaattaaaacatataatacacaaaccagtagaaggaaaagagaaaataaaggaaactcaatcaatttaacagaagacaagaaaagataaatacaacagtaaaagaaaaataatggttaataaaagttcaaagtaaaatagcataaataagtccaaatgtagtacaataaatataaatcaattaagcttgcttgtaaaagacagaggtattctgattgagggggaaaaatttcccccaaagtcctgcacaaggtctatttttgttatgtcaagagacgtctttaaaatacagtgacatgtgaaggttgaactaaagggctggaaaacacattatatgcagatatttagcaaccaaaagaaagctcgatagctttagtaacaggagaaactagaccaaaaaagtattttcacagataaatatcactgtggaagttataataatcttgaccctgtaaacactcaacaatacatattgttgataaggtagccagatataagaaagctccatagctacaataacataagagaaactagatcaaaaaggcattttcacaaataaaaattattctggaagttatgataatcttgaacatgtatacactcaacaatacatatggttgataaggtgaagaattacaaaaagaaattaattctacagtcaaactggagaatgttaacacatttgcacctgatgctagcaatgtattaagcaaaaaaaaaaaaaaaaaaaattctgatcagtcagagtttatcccagcaatagtgaatggtttaacgttagaaaatctctcaatgtacttaaatacttttatggtataaaggaagaaaacctacacaatcattttaatagatgaagaagagcatctaatgatgatgaaaagaatatccattattgattaaaagaaaaaaaacttttaaggtagtagaaataaaaagaaacttatttaaccaatagacagtagacactgaaagcttacagaaaataacatgtacgtgataccttaaaagccttctatttaatggtggaaacatatacaattcctgcttttattctatactgtattgaacaccccagctaatgcaatggaacaagcaaaagaaattagaggaataagaagtggataacaaaaaataaaattgtcatttataagtaataacgtctacttagaagatccaagaatctatacttatccaaagactcagtatccgtaatacataaggaagacttacaaatcaataagttaaaggccaacaacccaataaaaatagggacaaaggatatgaacaaggaggccacagagatgaccaaaaaaacatgtggaagcattctcaatatcaccaggtatcaatgaaacttaagatagtaatgagattttattttatattatcagattggcaaaaaatgttaaaatttccctatggtaagtgatgatgaggaatatgtgaggaattcaggaaatttcataaattgctgatgaggattataaattagcatagcgatttcaaagagaacattttaaatatagcagtaaaattgaagctgtccatgttctaggatcagtgatctcacttctaggtatattcctagagaaattcttgcatatgtgcacacattcaaggctgtttattagagcattgcttgtaatagggaaaaatcagatacaatctaattgtccatcaaaagaaggttagattaataaacttggcattatcaagaactctgtattattatacaatgtaataatgtacagttgttaaaaagaataaacatcaaaaatgaatctcagaaacactgctgagtgaaaaaagcaaagttgcaaatagaaacagtatattatgcatttatgtataaaataaaaaacaaaccagtagtgtatattgcatcatgagatacagcccagattcaagagagcaattactggaggggaagaatgagattgggttggaccgagagggagctccactgtatctacagcatgtatttatttgtttttgtttgtgtttgttttgtttttttttgagatggagtcttgctctgtcacccaggctgcagtgcaatggcgagatctgggctcactgcaacctctgcctccaaggtttaagtgattctcctgcctcagccccccaagaagctgggattacaagcgcctgcatcacatcaggctaatttttgtatttttagtagaaatggggtttcaccatgttggccaggctagtcttgaactcctgacctcaggtgatctacctgcctcggcctcccaaggtgctgggattacaggcatcagccatcacgcacgacaagagcatgtatttaaaataaacaaaaaggacatgaaacaaccaaggtaaactgtaaacatttactgaatcctgatgatgggcacatgttggttatattaatctttgtgtttttctgtattggttgaaattttaataatttttaaatatttatagaacaaataggtttttcttgacaacctcccaaatgttaattctttaccaaagcttcttccaaaggaagtgattagttcagggccttttccttctgtctgtggatgtggaactttatcagagaaagaaacccccctctccccaaactcagtggcaagtccacagcggggaaagtctaactcccaattttatttatgaagtcaatcatccaaatcacctctcagtcctcagcagctgaattcaacacaatgattaagcctagagcatcttcctagagaaggtggtagtgatgcaggacaagcgagccccgaggtggggcttagcccgcaagggttcttggctttgcccaggaaggaattcaggggcaagccagtggtagaataaaagaaaacagctttattgaagtggcaatgttatagttccggctgtgctacagctccgtgactgcttctgtagagcagggcgaccacataggcagagagtagtaggtcagggcagttttgcattcatatttatatctgcttttaattacacgcagtttaaggggcagtttgcagaaatttctagggaaggggtagtaacttttgggtcatccggtcactgctatggaaaggagcaggaacgcctgggtgttgccatggcaatggtaaactgacatggcacactcatgagcatgtcttatggaaagctgcttctgccccaatcctgtttttgctagtcctcaattttgtccgatgtctgagccctgcctcgggggttgagtcccaacttctacctcagtaggaagatttttaaatggcataattacagagatataaaatttatgtatgcatgtgaccagaggaaaaaataagacagtgcaaaatataagtggtggtatagggacttcacctcccactccccctccacccactctttgctggatcagcacccaagagcagagcacaagccttgggccatggtaggttctgaatgagtagttgagtgtattagcattagcactggtgctgttacccattgattggttcattcaagcaaacattcaccttccttgtttcattcagcaagcacaaatgttgaaggaaatgtgggagaagtaaagtgcctgtctcagggcttgggggatttaaggaagttgctgtcatcaaagaaaagttgcctgattccctcgggaaaggagaagaaggcggtgtggttcaaggaggagaccttggcttcaaggaggagatctccgagcacttggacacatctctgcagtaattagcacagaagcaccatgagttatttgttatctgacccacagtttctgaggcctggttgactgggtcaaatagtcagagtttccgtaaccctaaaatgagtaactcacagggtaagacccttttggagaacaactgtgccttactcaacacttgttaaacaacaacgaaatgatggggtggtggggtggagggatctagttattttgtctttacttagaagggaaaaaagaagcaggaaaccaaaaatacccctacaagcagctgccgctaaaccatcacattttgggacctcagatgcttctgcaaatgaaatgttgggcgctggttatgttctaatcctgggagtcttctcggtcgacaacaggcttccgggcatgaaagagttaaccacaagctcaccacagaatgtcaacctgattaaaataaaagttatcagatttaaaagggggaagtagaaacacactctttttctttctctgaaatctaaaagcagtttttcctcaaatctttaaaaccaatttcttgggatggagtcatatttttagtagaaatatgctaaattggtgactcccacccacagtcttttctgcaaggagagagactcttctgagaaactggagcgaggagctgaggaaattttcaactcaacggaatttcccctgagactgtaaagaaacacagaataagtaagtataacttacaggtagaaacttgacaagagggaaacagaaaagaaggaaaaagaaaaagtcatcaaaaatgatggcaacctccaaagtcatgatgctaagagtttctcctgggaacctcagtccagttggtgtcaggtgagggccggtcctgttaacacaaatcctaattgtcaggctgaccaagcccacgtgtccagaaccctctccagagctctcctcaggggttcccagcagccaggctcactctgccctgctcctcacccatctcgcaggggaacctcttgtaccccttttccttcctgctctcaagaattcacactccgttttacacaagacacacattgcatacactgtgtgttgttgacagggatcatgccttttcacagacaatgacaatccaaatgtggaaacacagggagaaaaccatgggaagtggggagcactgattgaggttctggggtcctggcgctttcagatactaccatgatctgctagtctactgtgattttgcttaagaagggttcagtagagacaaacagcatcataaaagtgtcaaatccgtgtgttcacagatgctaccccagacatcgggtaagacaatgacatttcaggcactgtgggattgatggagtggacagcatagagcagagagcttacggttgtaggttacgtggtaccaaaagcccatgcctgtgctccagggactgttctcagacacataaatgcaacctcaaggcttttgctgagtttagtctttgtattcatctgtgagtgggtcaaaatgcctgtctgctgccctggccctcttctgcagccatgctgagaggaaatacaggcttgcatttctccagagttccttgaaagcattggtgctcaactatccctgccttaacacaaattcttagtcaacacacaacatttgatctctgatagtttcagtgggtgggttctattcttttcaacagatacctcagggttagtgggggtgagctcagatgctcctgcaatgggcattcacactgggcttcttggagagctgaattccaaggtggccacgtttcctaaggacatgggaacttaagatgcaggcagggatcccatgtcctactggaaggtttaaagacttcctcagcacagtgctgagaagatcctgctttttactcgggtgtgggacaagtagttatgaagccacagaatgttaggactgaaagggacaaagaccctctccatgtctctgcatgcttgcatggagaacatgcattgtccaaggaccctcaaatccctgcatgccctgcgcatgccctaaccctgaggaggtgctgaacccttgctgatgtgcagaaggggttaatcagaccatgtggacacaggtagcccaaggaacaacccccatgccaacagcactccatcccgacctcataccatgtgcacagcacctgatgctggtggggtcaggagtgtggcctgtgccacactcagaacgcgggatgaacatagaggaaacactagaatggcaaaggctggttgtcacctgggggcctcagaagccacggcaccagaggagagctcaggagtcagcctgctccaaagctcttcctgcctgtagcatgcaccctgtgcctccgggccaccaaaaacagcaatcacgtcagctgagacgcaacacactgcatgccgaacacacaggagagctcacacgcacaaatgttctcggcttcccagacaccaatgaaggagcttattatgaatatgaaggataattaacgtatctattattttattagacatcacaattcaaatacaataaagtatataaatataaatatataataaatgaaatatataaaataccatcttagcttatgaaattatcttatatgataaaataattatacagatatataataagcaattagggtatgttatataaaatactatagtatactcattaatataattagtatattatatgataaatatatataataaaagacatcatacactaatagagtataatagtcaatataattaaaattattacttatgcagtaattaattatgaggtgatgtgttcttctcatctccgttctctagaggcaggaactaaggcacagagaggcccagtgacttgcccagagacacacagcccctcagtggtggagctaggacttggacccaggcagcctgacaagtgcgtgctcttacgcacaagtgtctgcctgtcctcccgcctatcctccctcatgtgctggctgcatcctgctcccgtggcccctgaccctcaactgcccttgtcatgtgcccgtcatgcatcacaggaaggctgtcatgggagtcctgaggtgggtggtgataagtaagcaagaagaggggttgctggcgttaagagattttagaagttggaattgccaaaaattgaggctggattattaggtgcatggaggacagcaaggaagaaatgaggattttgcccagatttcctgggcgatggggaggatggggtgccattcattgagatagcaaagagaggagaaagagtaggttccagggagggaggacagttctggatgtgtagactgagcagcctgtgaggcatccacacggaaaggtccgagggaagggcctttggccatgcagactagaagcccagcaagtcacatttagtgagcacctactgtgtgctctggtcactctaggcaggctagcttatgtagccttacagcacccagcagggtctgtgttattcccattttatacgaacagaagctgaggcccaccgaggttaaaaccctaccctcatggacttccatggaggttactcaatgccctatgggtttgcctttctgcttcccttcattcttcacataaacccagtgctttctcttcttccttcattcttcacataaacccaatgctgtctctccaaagtacaagccatgccctgactgagacccctctgggatgttctgttccttccaggacacagtttaagcccagtgacatggggagactccaagacacagctcatgcccaacttcaaaatctctgcttccactatgtgcctgagctctcctgccttgcgggactctgcgtggctcttggagctcaccatgtgttttgtcttgggccttggtcattgtattattcagggaaacagaatttctctagagaaacaaaaccaataggatgtatgtagataaataagagaatatttataatgggagttggctcactcaattatggaggctgagaagtcccacaatatgccagctggagctggataactaggaaagctggtggtgtggctcagtctaagactgaaggcctgaggagcagaggggccctgctgtaagtcccagagtccaaaagctggagaaccaggagtgcaaatgtccaagagcagacgacggatgtcccagcttgaacagagagaatgcaaccttcctctgccttcttgttctattctggtcctctatggttggatgatccccaccacactggtgagggtgattttctttactcagtctaccaacaagaaatttacccagtctattcaattcaaatgctagtgtctcctggaaataccctcacagacacccccagagagactgtttagccagctatctgggcatcccttagcccaggcaagtggacacattgaaattgaccatcatgctcatgccacacttccctaatgcatttctaccttcttaactcctgctttccctggaggtctcccattggctgtcatctttctctgggaagcctccgggactcttctgtctgtgctttgtggcatttctctgcagtcccagactttgctcccttttctttacacggcactcaccctactgtatccatctccctcccaccaccttgctagtgcctgcacagaatggcatgcaaaggttttcgtaaaggaaagtagaaattcacaagttcaagctaggatttgaattcaagctgtcaactttccaaattcataagacttttccattctctcaagacgcttttctggttgggaaaaattccggtaggcagacaagatggggaagattgttccagtaagggaggagggtgttcctgggagtccagctttgaaatcacaaatgaggaggttccctttgaaggacaggaggagacctgctggccaaggcgtgctatgtgctgagggaacagtcttggctggggagcatgttgtgtgccaggcagaggaggtagcaaagtgcccctgaggcaatggaaatgactggagctcttgcagccgaaagggcatcacgacaggtgctttcaggggagattaacttggggatgaataacagggtgactgaaaaccagagcttcagggcctgcctaggcagcccaggagatgaacagtgcctgttgacagcttgcttcctgtgtcggcctgaatgcatgggttctgctcagatctactggctccttgctttcttgggagagtgaattactgcctcatggtctcagtttcctcatccgtaaaatgggaatggtggcagggcgtggtggctcaagcctgtaatcccagcactttgggaggctgagactggtggatcaattgaggtcaggagtttgagaccagcctggccaacatggtctctactaacctgtctctactaaaaatacaaaaattagtcaggcatggcgatggggcatgcctgtaatcccagctactggggaggctgaggcatgagaatctcttgaacccgggaggcagaggttgcagtgagccgagatcataccactgcactccagtctgggcaacagagtgagactctgtctcaaaaaaaaggtggttggggtgggggaatagtgctaacagtccccatctcctatggtggccatgaggaatctgtaagatcacagaagcagagcacgcagcaaggcctccctggcccgggagtgctcagagctgggatcccagtgcaggacgaggaggaggaggatgggtgccctggctacaggtcctcttgcactagattgaaaacggggccagagaagcagagcttgagagacgctgggagagggaaagtgaaactgatggtccggtgggtgaaaggtagtgaaagcccgaagtgcagtaaaccagggatcaacatctccagccaaaaggctcaccctgtggtctcagcgccacctgggcgtcagacagatgtctggagagacggctcttttattctgaaacacccctccaacttttttttttttttggtaattgtttgttttgctttccatttaatataaggagttttctcctttacaaaagttctttttgttctaaatcaggctgtaaacagaggtgctaccacaaggaccggaagcagagaccacactggtgctcagctgggttgcaggctctgcctggtttcattgtcggggaagccaccaggcctgcccccagccagcgagatgtcacgcatgcagccgggtgtcatccccaaaactcccgggaaactctcggggcaccagggcaggaagaggctgacgtcaactttaactccggggacttcaaacgaaacttttagaaatgattcctttgccctttacttggtgacgtaataaactgatctttctctgaaaagatgggccgatttgcttcaaggagctcatttcatgaggagaaaatacacacaaatatatatatatatatatatatattttttttctttttttttttgagacggagtttccctctgtcacccaggctggagtgcagtggctcaatctcggctcactgcaacctcagcctccaggttcaggggattctcctgcctcagcctccctgagtagctgggattacaggcatgtgccaccacacctggctaacttttgtatttttagtagagacggggtttcaccatgttggtcagctgttctcgaactcctgacctcaggtgatctgcccgcctcagcctcccaaagtgctgggattacagacgtgagccatcatgcccagctatatatatatatatatatatatatagaattttttaaggaaacattgctgctttgctacaaagtatataataatgtaaactggactaatacgattccttcctcctttccttggagaagtcacagacttttaggattggagaacggttcacatgcatgtgtgtggggcagttggtcagagctgtccattatgaaaggtgcttctagaatacttggggaatgtgggagctagaaaacaggttgttattaaaggaattgaaatactcccacttgaaatgttcccattttctctgtaaaggaatttcttgagcaaaggaaaactctacatcctctgtctacctgaagttcaaaattagtggtgtttggttttaataattttagtagttgatgacaaaacaacgctctctgctgtcctctctgtcacatctaacatgatgtgaatgaggcagtccctgatgtgagatgtgctgggttttgcaggggtaatgaacatcgatctgtgtgttccatcgactccttctttaaacttgtatctcagcacttagcctgtgtcataattgtctgtgcagaggtcaaggatgggctcttattcatctctgtgtctcaaaccctgtgcctgacacatagcagttcctcaatgaacatttgctgaatgaatgaatgaacaaaggaatgaacaaaccaatagccggaagtcctaccacacaagaggttgtctccaatctccctgactttccctcttcctcctgtaccctcaacccatcagctgcctgtactgctgtagcaacaacttctctctgaaaaccttcccaggggagaaaacgcgccccccctcacgcctcagaggcacacacctatcctagcctttgtttttttattgctgagagtacagaaagcagcggcttctgaaggaggtatctattttggtcccaaacagaaaagagtgggtgattctgtgggcagaggtggcaattcctgaatgtggtatggtgactcacgcccggaggtgctcagaatttcctctgttttgtggctgctggggcaggtgcgacactgccgctttctctaaagatgcccccaagctgctctgggggtagaaggaaggctgcagggaacagcaggacccggagaacccagaccccaaggaccaggtggtccttaagccatcctgcaggaggccggctgctctagcaggttgaggagtgccacgcggctctgtgggtaccgcctcactgcatgtacctggggctgaaggagcagtgggcattactcacagcctattacttcacctttgtaaaaaacaaaaataacttccctgctcacatggcacctttgtctttgacctttagcagcagtttagacaggaggaaaaaaggcaggttctggaatgagagcgcctgcttcctatcctagccccttcctcgttgggctacatcaggcaacccatttaatctctgtaagcccatttaaccacagttcaccaggcagaaaatggggataatcatatgacctactttattttgagaattaaccaaagtaatactatgtctgaacataatacctgaaagatagcatttaggcaatggatattcactgtggtggttctagctagtgttcaaatgttttctggaacaaagcttgaagcaaataagaacgaaaggaaacataactatcagtatcggagttggtgcatgggccggctttaaccagtcatgtttcctagtctatagctttgctcattttcttaccaaaggaaatcagggcctgttggagactgtcctattttccacgctctttagaataaagaaaccaatggctttcacaaacttccttatttaaaattaattatcattttaaaaaatagaggtggggtctcactatgttgcccaggctggtctcaaactcctgggctccagggatcctcccctcttggccccccaaagtgctgggattacaggaatgagccactgcacctggctgcagcttcctttttattcttttgaaacattgctctttcttcttcttttgggtaaaaggactcaattgctgctagtccaattgcaccagcttgttcttgcactgcatacagcgtgggaggaaaaagcctgggaaacggggggacatgggccagcgagctcatccggccacaccttccaccatggggcaggcccctctactggcacaggatgtcaatactcctgatccgtatcttgccttccctccacccgttcctcttcctcccagcacagtgaccttccggtcaaccccacccatgccacccacactttgttgccctggagtttcctgccacctgaacccctccttaagcaggatgcctggatccgggtcgagggctgcaggcggagctgctggtcaaaaaccccccggggaactggttgggtgtgggagtgggagaatgggctgtcaggacaaaagcactgggactccagccctgtggtgtgcacgtggctcgggctgggtcaggaaaaaaatgtggaggtagggaaacaagacccaggaactctttggctgccatccagggtcatgtggtgctggtgataagtgatcagtgacccattgaaccgaggacgtctaccggggaccaatgacacctgtagacactgcagggttgaagctgggggagaagcactcacatgctgtctgtctgagcaaaagtattcgtttttgtccgagaatctgagactcatttgcttggcacacacacacaaaacttcatgtatgttgaaatatggctcattatgtagttgtcctggcaaacccctcatctctctaattggtcagctcactactcatggaacacggtccatgtacacgactccagcagcatcactagaaaacaccattctccagcccctctcctgatattcagaaccaccattcagagccaggaggtcccagggccaccttctctgagaattttttttctagttctccaggtagcatgttactctccctattctgatcatttatggcattatttgcaatgtttgatcaatatttgatctttcccagattggttttccctttttctaatttttttttaagaggcagagtctcactatgttgcccaggctggttttgaactcctgggctcatgggatcctcctgccttggcctcccaaagtgcaggtattacaggcatgagctatcacactcagcctattttctcatttcagtcgcaagttctgtgtgggtaaaagcaatgcgtatttattctctgacttgatagccttgttactcaaaatggggttcatgcacccacaacataggcctcctgtggaacctgtttgcaccagaatcttaggcggtaacccctgacctcccgagtcagaatttgctccgtgacaagatccctggatgatttctaaatgcattaaaggttgagaagtactgcttgagcatacctgttcctagtgaatcagaccaaccatggaaatcattattccatctctctaatttggtgagtttcaatcctaagtgcgatttggaagtattcaaggaactggaagggaaggtattgtgatgttcggttctgttccccagagagtccgcttaattcatcttatgagtcttggccatcactttttttttttttttttttttttttttttttttttcaccgcccttaatccatttaatcctgagtggacacagcacatgtttcagagagcacagggttgggggtaaggtcacagatcaacaggatcccaaggcagaggaatttttcttagtgcagaacaaaatgaaaagtctcccatgtctacctctctctacacagacacggcaaccatccgatttctcaatcttttccccacctttcccgcctttccattccacaaagccgccattgtcatcctggcccgctctcaatgagctgttgggcacacctcccagacggggtggtggccgggcagaggggctcctcacttcccagtaggggcggccgggcagaggcgccccccacctcccggacggggcggctggccgggcgggggggccgactccccccacctccctcccggacggggcggctggccgggcagaggggctcctcacttcccagtaggggttggccatcactttttaaagcatcctggatatacactaatgtacagctggcgttttgaaccattactctccacacatttcccagtgggaactgtgttttctttttgacagaagcaaaccacggagtcgccttgagatcagtcaaaacactgagtaatcttagagtggagaatacctaaaatttctagagacaattatattattgttttcccctaaatgagtgagttacttgagaatatggtggggtattcagtgggggctattggcaaacactgttggctgacttcagaatgggagccattcagcagcagtttcatctcccgtgttaaactgtgagcacaagaggataagagctggaactttcttcatctctgtaatcctcatgcatgaatggatggatgaaggaatatcactgagaattcatgtaaagatgtgcagatgtgcagggaatattgaactgaaatttaagagggctggattcaagttcagcttctatgtgaactctttcagtgaagaaggtcttataacttttagaagtaatcaactgaattaagattctcttttcagctgggcacagtggctcatgcctgtaatcccagcactttggaaggcccatgcagatggatggcttgaggctcggagttcaagaccagcctacgcaacatagcaaaaaccccctctctactaaaattacaaaaaaggagccaggcatggtggtgcacacctgtaatcccagctactcaggagacagaggcaggagaatcacttgaacccaggagctgaaggttgcagtgagttgagattgcaccactgtgctctagcctgggcgacagagcgaaactgtccaaaaaaaaaaaagattcccctttctcttctctcagggaatggcctgggatagagaagagaaacaggttcccactcatgtaaaacttctcccatgggagacaaggacattgtttgaggggaaaattcctacacaagcaaacaaacagcagaggaccccgccctccctgtccagggcaggagcacagtggaccacctgctgcccctgtgtcttggggcctctctccctggaatgtcactgatggaaatttaccagtccctcagggctccctttccatgtcaccctcatgaagctttctctgatagccccatgctcagtagatcttaccacatatgacttgtgttaccatgactatatctatgcctttctcctcctcaccaacttatgactctcttaaggatcaggactatgtcgctcatttttacatttcctatagtattgaaaaggggcatgagagatattggatagattttgagaattgagtgagtggagtttttgcgttgacacctgcaactgcagcaattacagaagcagtgggtcatgctggctgccaggcagtacttcttcagagctggaaataacccacaatgagacatcaggcttgggtgcattgatacacaaaagtcgctcaaccctgaccgtgccagtatgtcttcatttgggaaactttttcatcccaaagttccccagcttgaaaatgccttttaagcagagcttattttatttcctttctggaatccttgacatagagtgaaggaactggaagggagtttcaagatccctgggtgacctcctcattttacagagagaaatctgtcaaaaactcacgccctccccgtgtcctctcctcagtgctttggcccactttctgcttcctgcaaggtttattttcctgctaattctattccctgtgacctcaagcaacatgcctcatttcctgagggaattctctctttttctgtaaagtttctgctcatccttgggcaagaagaggagcagggaagggtgggaacagctgccacgttgagggactgcctgccttgatgatatccatagctcgcagaagaatgactccaacaaaaaagtcacaaagaggactgggtgcggtggctcatgcctgtaatcccagtgctttgggaggccaaggtgggcagatcacctgaggtcaggagttcgagaccagcctggccaacttggtgaaaccccgtctctactaaaaatacaaaaattagccaggcgtggtggcaggtgcctgtaatcccagctacttggggaggctgaggcaggagaatcacttgaacccgggaggcagaggttgcagtgagccaatatctcgccactgcactccagcctgagtgacagagtgagaccctgtctcaaaaaggaagagaaaaaaaaatcacaaagaggtattcagaatacccaaggctttaggcaaaaaccagtctgggaatacttctctatcaggggagtggggtggagtagtggagttttagagctcagcaaccgttctatattagcacctctaactgacgcattcgtgaaactcattcttttggtgcagaattgtgaagtcaatttttttctttttcaattctcacatctaaaatgaagtatatgcacaggtgatttatcaaactgcctatttaaggcatgctgttttaaggaaagtagcaactgtcttatgaagagctcccaatgtttaggaaagcccttacagcctcaagacatgtcttgaagatgaatgaagtaacagtagcaataatactttgggatctcaagaagttgaaagattaaatgtgaagggttaaacattttgtgtttgactgacaaaggtgaagatgggaaattccattgtgggcagttgtctttacaagaatggataattacacaaacacattatctcaatgggtttccacactgtttttttaaagaattatttttgagtctagaggataaagatttgatcacagaattcctagaatgaaagaaagatgatcaagggacatacaagctctcagaatttccacagttctgagaaaggtgccttcaataacgtgccatattggtaataccaggagaattctctttctgaccacatcccagagcccagtaatatagagactaaaaacactcaagttgactaatatgtcctcataaacccttgccatgttaaatggtggctttggaaattttcagaatgaaaatctgcccttatgaatcagctagaaattgcatctgttgacagtctgatttcattagagaactcttaccctgaggaataaaaagtctgatttgtttcaagactaggttcctcttggagaaaaagtctgtgatgagatggtttcttaccctggagtgatgcctagaaattcctgttgattccagaaacttgacccctgtcattgtctttggccactgggtcctcatttgccttgtgattggactattttaagagcctcatgacctgtctctgtgcacctgatctctctccactctatgccagtatcatctccataaagcgctgaccctgtttgcaatgaacagaaacagaacaatccagggagaccaggttcaaaccctggcactctcactgcctgtgcgagtctgagttttgggttcttgcttcatctaggggttcatgatatccatactgcaaagtggctatgaagattacaataggacacatatctggcacatagaagttactttataaatggtagttttaaattttcttgtagttctttattgcctactaggtgaagttaagaagttatcactaggagaattctctttctgaccacatcccagggcccagcaatatacagactaaaaatgcctaatgccttagatgattcattttacctcatcctaactttccagtttgaattccccatatccccaccctccctgtccagggcaggagcacattggaccacctgctgctccctaaggcactcctgtgttttggctcattggggtctctctccctggaatctcattgatggaaatttactggtcccttggggctccctttacatgtcatcctcatgaagccttctctgatagcccaacgctccgtagatcttaccacactctgactggtattactatatttatatctatgtttttctcctcctcaccaggttataagttgcttaagtgtcaggactatatctccctcatttttgtatttcctatagtgttgaggggcagatggggtatggatagatgttgagaatggcgtgaaggagtccttatgggactctagttcccctgctccctccaagaccactcagacccttggataagtcaccaatagctagaaataacacgagtttacttgaaatgtgtcttccagaggcagagcatgattaattgtcaagattttcctgttcttggcttagactgagttagcaaagaccctgtggatgtagaaatcacattgaaaaaccttcctaaaagtatgccctctttataagaacggcacgatggactctgaggactcaggggaaagggtgcgaggtgggtgagggaaaagagactacgcactgggtacagcatacatgctcaggtgatgggtgcaccaaaatcttacaacgcattgggtacagcatacatgctcaggtgatgggtgcaccaaaatcttacaaatcaccactaaagaacttattcatgtaaccaaacaccacctgtcctccaaaacctattaaaataaaacacataggtcaggcgcgatggctcacacctgtaatcccagcactttgggaggccatggctggtggaccacaaggtcaggagtttgagaccagcctgaccaatatggtgaaaccccatctctactaaaaatacaaaaattagctggtcgtggtggtgcacgcacctgtaaacctagctactcaggagtctgaggcacgagaattacttgagcccatgaggtggaggttgcagtggactgagatcacgccactgcactccagcctgggcaacagagtgagactctgtctcaaaaagtaaaaaaaaaataaataaaaatgtaataagtaaataaaatgccctctttaaagacactcctacatctgggccagtacacagcccagcatgactgggcacttcccctaaacaagcaagcagactcctgaaatgcatcattatgtttcatttcttaataaattctttctacagccagttagcattctacttgttgccattatagactttcaaaaaacactataaactttcttatctgtcttcctgagtaagcaaagggaagacattattagaaaattcacactcaattaggaagagtggtttgaggtagaagttggtggttttttatttctttaaaaaaaaatattggccaggcacggtggttcatgcctgtagtaccagcagtatgggaggccagggtgagtggatcacttgagcccaggagttcaagaccagcttgggcaacatggcaaaaaccccatctctacaaaaaaataaattaaccaggtgtggtggcgtatgcctgtagtcccagctactcaggaggctgaggtgggaggatcgctaagcctgggaggcgaaggttgcagtaagccaatatcgcgccactgcactccagtctggctgacagagacagtgtcaaaaaaaaaaaatcttcgagaaaatccatttgaaacaaggaatgaaatttaaaatttgcatatataaacacgtatacatatacatatcatgtatatacataggattatgagaagtagtaatgttctaaaagtgagtatgcatatttttaaaaatttctgtaaagttgcacttgtaaggaaattcctaggtgttatttcctaagacgtaaaagcagtgtatacatccttgaagctaaacttttctgagatcttaaattctcccagtgtttgatatatgagtactcatgtctccagcaaattaacctgaacttaaagagcttcctgatagcttcttagttggggggtgggagtgcagagaataaaaggaaattcattgaagaataaaagataatttcttgagaaacctgctcatcgggaccctgttaacatccaaatatcccaaatatcatgccacactattcttcccagaattaattgtcaaggactgagaaggacaggagaacctaatgctatttcaggctctcttgacagaccaaggaacagtgaggcataaactggggtccccgtgggtcacaggcaagaggtggaacccaagattcaactcccttcttggaaccatctacctggggactccctctggttctgtggctgggaagagggatgcccatcagccttcccggaattccgggggcacccacaggcccttacctgcctggcagccaggcaccatgatgaacgtgagcagtccccacatcagcaggtatgaatccatcttcctgacccttgggaccagccggggcagtgaagcggaggtctttctctgcagaaggcccagttgccgtcagcctctttttggcatcgcgccggaggatgtgggatgggaagatcggtccgcctgggctgtcacccttgtgggtccatccagtctctatcggagtcaggagttgctctctttaagtattgggctggcgtgttcagccaggaaactgcc

SEQ ID NO: 1800 - DNA, 4228 bp, Homo sapiens
tttttgatgattatcaacagaaactttatttctcatcggttcaggaacaatcggagggtagatggaaagaggaagggagggaaagagggagggaggaagaatcctgcgaaaaggaagggccagactgagggagaagaaaaacatgttcggggcaaaagggtaattctcaagtggggaatgccaaatgaaggggtgcttacatgggggcacaaaattccaaatcagccacagtggggtgaggtgagtatgagacgcaggtgggttgaatgaaggaaagttagtaccacttagggctacaggaccctggggttcttctgtcagaggattggggttcaggtttcaggctttagggtgtaacatgggggggcccagtaggggctatgctggttgcatggggaggccccaggcccctccccaagggcccctccttttgggggaatctcactgacgaggcagagtcgttcactgtagtctggctgcagactctcagccagtcccttagacacaccactccaggcctaaagacagatatgtccaggtcaggggtcaattaggggcaggaagtaaaagaccgagctctgtgccaaaggagtactcatgatgtctgcaaccactgtaattgattacagaagggatacacaggctcctgggcccccaataccagttgccatctgcctcattcaatctataatctgcacttctgtgtgtgtctctctctgtatagtccatgccccatttggtcggccacatcctgacagttagtgcagggcctccttccctctcctctctgcccccacccccacactctgtctgtcttgctggcaggcagttggcagttgatagactgcagcatgcttatgacagcgttctcaccgaaaagttcccgtggtattcagtaacaagatcctctaggttcttcagggtgggaattcggggcatcgtcctgacaggggagaaagagggagcaggagcacataggttaaagcttttttatcacccttctcccagttgtcccatatgaaataaagtgattctgtgttctctgtgcctgtggcttccttccatcaccaaaccctcttgggtaatctctcattacttactgtctcatcctttactcctaaagaccctgcaaaaccctcctctgctattgtcagctaccgttcccctcatttttctgggcttctccaaatctcaccgttccagccagaaatacacacagagaaggctgataatcaatcccatggagccaacagagataaccacggcttccaatgcaaacaggaaaggattctctatagaaaaaagaaaagcaaagtggaccttatatttgttgtgcccctactacatgccaggcactggtgccaggcaccgcgctaaagacatactctctgtttaatcctcacaacagctcctgtgaggcaggaacaattacctccatcttacatcttaggaaacagaatccaagagtttagggatgtggccaaggccaaagaggtagtatgtggcacagcctagatccagctggttccaaagccatcttcaccttgcaggctctctaggaatgcttcagggaaatcctatacattctatagcccccttgagtacccctcagcctccttctcaatccactcccctactctaacaacacgctaacccaaccctacacagaaaaaccttgatttctagaggttggggttagacagtgtggagagatggggcaccaagtttaggggctttagtgacagggaagtggagcaaaagacagtggtgttagaaaggctggggtgttgggctcatggattgggtcatgtgggcccattttaccttttgaagtattgctcccccagtggattgggtggctccattcactccaatgctgagcacttccacagagtgggttaaagcggctccgaacacgaaacgtgtagcgtttctgcccatccacactaggcaaggagaacttatgtctataatccactgattgttccttgaggagaaagaggatgagggaaagtgggtgtctatgagagaagggagaattaaaacatactcctgaacacccaccagtgtcatctctgctactgcccagtttctctctcatctcttgactactcaagccacactgctcccttcactgacttgaatctaatgcctcccctctggatccccttaatggcttccttttgtttacttgtctatctggtatcaggaagagtatgggtagggaatccctaatgaaaactcactggtgtcaggaatggtggctcacgcctgtaatcccagcactttgggaggccgaggtgggcagatcacctgaggtcaggagttcaagaccagcctgaccaacatggcaaaaccctgtctttactaaaaatacaaaaattagccaggcatggttgtgcatgctcccagctacttgggaggctgaagcaggagaatcacttgaaccagggagacagaggtcgcagtgagcccaagatcgccccactgcactcaagcctgggcaacagagtgaggctctgtctcaaaaaaaaaaaaaaaagaaagaaagaaagaaaagaaaagaaaaaaagaaaactcactggagaaaataggggggaaaggagttggaggagggagggtagggggtgagcagagaagctgggaggcagagaacaggagcttgatattaggtccttctatctgtctggttgaatcctttagccctactttcttggccttagctgctacattcacgtccctagtcactcacagtccagctgtggtcccagtcagtccggtactgcaccaagtgctccaaacagtggttcaagaatctgttgttccagttcagttctagctgggattcactcagtttgtgaagtgttaggttctctggagcccaggggatcactggagatatgtgtgcatatgtggtcattcccctggcctagacaagtcaggatcctgaaggtagtgcccctaatacctcctcccttcccatcatgatcccctacctcctcttttctgcccatgtacccttatgataaaagaacactactctgtagactccaatgtcccacagtatccctggtctcttgaccctttctttccaaattacccagattctgcagttttagcatctgtgtggcctgtctcctgggttcccgtgggtcctggagctgaacaacaaatgtttggtagaggtggatctcctttttttgcaactgacagccagaagtgatttcttcagagaatagatagtggctgcacttctggactttatcattatccgagttcttgtacctagaggagaaaggttggaaggaagaggaacagtggggccaatctgggtactgcagatatccagagcctagcctcatctcccctcaaccgacttatgacttaccccaggagaaaacagtggggtacctgggagacttgctaccctctctcttggtctctgatccaacccacctcttcttcatcccctccccctcgtcccttctcataccaataatgcagagtgaggttggtaggctggggctcagagctgctgttccaagtgcaattcatgtactcgacattgaacacaaaacactgaacctctgggaggggcagagtggaaacactgagggagtcagtgggcatagtggtcaggaagaaatctagattggggagaaaatgaaggcagggagggaaagagaaatgatggtcagaaggaggaggccaagcacggtggctcatgtctgtaatcctggtgctttgaaaggctgaggcaggaggatcactagaggccaggagtttgagaccagcctaggcaacatagtgagaccctgcctcaaaagaaagaaagaaacaaacaaacaagaaagaaagaagaagtagcgtgaggcagggaaccctcccccttgcccttcccactccacttttcaattctgcccacatgattgtaatggccagtggcaggcaccagatctctgtacggccccttcccacagccacccttctcaccagccccctccagtcccagatttcccaccagctgtggtgtcttcattcccattgggcgtcagaattgtcgtgttcagccccactcccagcaggggcagctgcaggaataagagggatgtgaatggtaatgatggcttcaacatggcgcttgctcttcattccctgggtgtagtctgtctgtgtcaggaacctgggtccctcacccactacccctccccacccacacgtttcctct

SEQ ID NO: 1801 - DNA, 50870 bp, Homo sapiens
gggtctccgcgcccaggaaagccccgcgcggcgcgggccagggaagggccacccaggggtcccccacttcccgcttgggcgcccggacggcgaatggagcaggggcgcgcaggtaggatccggggcccgcgcgcggatcgggttgcgaaggtatcgcccgggcacgccggctgagggcgttcgggaagggctcggccgccggcggggaccacggggaccaccccgactccgagcggggcccgagcccgcgactctcggtgcgcgcggagcagcgcccggttccgtccttgccgccgaacggcagcggaggcgcgaggcccggggtacgtggacacccagcgctccccaaagccggtgctggcagtgagacctccgccgggacggcctgcgggggtggggggcttggggttaggctgtcggaggccacgcagcccctcttctccgggcagtggcgcccagccctgcgctcaggaagtcagtgaggacttcggagagagaaagggtggggaaagttctgagaactgtaaatttgagtagtaggtcagtgaatcggggcggtctccgcctccgaatatcagatggacccaataatcgcgatcattgactgggacttgttttactgaaaggatgccaagtgaaacctcccactaacttctctgtggccggtgctgtgcgtcatggacattgtacagatgaggtcaccaagaccccagccgctttagtaacttgccctaaggtgccgcccacttgggagtccgtggggcagcaggactagagcccaggcaatcccacgccagagccagctgctctccatctctcaatcacgtttgaggagcccccacaataaccagaatctccgggagatttgcttaaaatgcagattcccaggtccttgccctgagattcagattcagtaaacccaggaatctgatctttattttatttttaaaaatttattttataaagatggtgtctcactatgttgtccaggctggcctcaagtgatcctcccacctcggcctcccaaaatgctgggatgacaggtgtgagccactgagccctgattttttttttaaacaaaatctggatttcttagacttaagcaagataggggaccactagtttgtctgcttctggggttcaaggaatgcccccaggccagcgctaaccctgctccagttctagtctctccccttccccagccctctgggaggcatgacccactgcacttccctgcccccagtagcctatgaggagcccaaggcatttgctgggacctcagtgcctttatcaaaatcccaaagtccaatggggaaacaggctcaggtgtaggtttggccagggtgtcctgcacattagggcattccagggtcctgcaggggtttcttagaactcggctagcccagcccatgaatgggaggtgacctgctaagccactcattcactcactagcactcattcagctcctgcgaggccctgggtggtgttctgggcactggtgcttgcctcaaggagcaccccctctgcaggaagacagacgtgagggctgggagggtgcggatgcaccagcggctgcaggaccacaagccagaggggatcagctcttcaaaggtcactgggccaggcttcccagcacccagggaccctgagctagccttgtgagtagagcaggggagtctggcaggtagaggatgggaggtaaagggaggcacagagtgggcggaggctgggaagtgtgaaagggcactgtgtacagaacctagggagtaagcagaagccagagatggatggaaagttgggctgggctgcattgtggaaagccttgaatgccatgccaaggaacttgggccagtgtattcaccttggcttgagttgtaaaagcaacaatgcagattcctgggccccaccctgggcctctggatctgaatctggagggagacgctggggaggcagcagggaggaaaacctgcagtcactcaccccatttacaacacatgcagttaccggcaggtccgagataacctaagggtttccaaatgctaggaagtgactcaatgactgatatgtttaatacaatacaatcccggttgcaaaatgcccagggcaagggtgggggtgttcagttttctaatgctcccagttcaaaaaggagctgaaatgaattgtcaaagaagtgacaagctgggcgcagtgactcacacctgtaatcccagcactttgggaggctgagagaggatcgcttgaacccaggagtttgagaccagcctgggcaacatagtgagatcctgttcctacaaaaaaaatttaaaaacttagccaggcgtggtagcaggtgcctctagccccagctatttgggaggctgaggtgggaggatggcttgagcccaggtggtcaaggctgcagtgaactatgattgtgccactgcactgtagcctgggtgacagagcgagactctgtctcaaaataaacaaatacataaatacatgagaagagagaaccttttctacctcccccatctccctgccctcttccacccaccccatctgggacgatggaggagagcgtttgggattagatgccccacctctcgactgccctcactggtacctgggagtgaggccaggacagaagccgcctaagtactgttcttcctcacatttgtaaaagtgaactttcttgagggttgatgacatgttttataagctacttcacacaatgtccaacacccagtgggtccacaatcaatgtatatgtctgttgttacctgtcaaaacgtatagctggggagtgacagtatggacttgagccagatcacccagtgcaaatgctggctttgctgcttactgtgtaactgacttcccagagcctcagtttctgcatttatgagattatagtgactatgccattgtagtgatgactaaatgagttaatatatgtcaagcatacaaaacagtacctggtatgtagtacaaactatgtatttgttaaatgaataccttttttttttttttagagccatggtctctctctatttcccaggctggagcacagtggcacaatcatagctcactgtagcatccaatacctgggttcaagtaatccttccacctcagcctcctgagtagctgggactacaggtgtgtgccaccacggctggctaattgtttttatatttttagagacaggatcttgctatgttgcctaggctagtcttgaactgctggtctcaagcagtcctcctgcctcagcctcctaaagtgttggatttatagatgcgagcaaacgtgcctggcctaaatgaataaatctttactgttgcctcctttgagctttattggttgggatttagtccactcattttgcaggtgagaactgagacccggagatgaatgcagtagccttgcctcaggtccacatctgagggacagactccatcctacttttcttcccatgtattctttcctgcttgtaccagttcactggggtgaccaagaaagacatttctgagttttcctcctggctggcacagtggagacatgcccagccacgtttagctagacttaccatggctgggctagaagagaggccaggagcttgtctggaggttgcacagacctgcccttggtgaatgtggatcggagcgccccggcagaggcttgaggtgctacagaggctgggggatccactgtcagaccgggtgcatcaccactgttttatgatatccagcaaattgctctgcgtctctgagcttaaggcagagagaagggcctgagcttgaagaggggatcccaggtttaaatcggagctggctacttcccagctctccactgtgtaatctggaggaagttgtttaacctctctgagcctccctttgttttgtcatgggtgtttgcagggagagcattcatgagatagtttgtatagacattttgcccttggaaggcgctcagtgattgctgtttttctctgcattttggaccgagtcccttctgcgtatccagcacctggcttcctcctgcatttcttcctcaggaatttattgagcacctatatgtgccagagcatcggaccaagtcctttgctctcctggggtttagattctagttgagcatacaggcaatgtacaaccaatacatatgttcagatcggcagctttatctgttattctgaaatccacgatttctgaaaaccgaaagtttttcataactcattttgaagctaaacttgaggctttttagagtcttcatcctcttcggtgtgatgctcagatgtctttctgcagagatattagtgcaattgatctttgggtgctttcccgccctgcatgatgggcatgtcggtgggtattttatacaaggtgacctttctacagcctgagtcatcctgaattctgaactatgtctggcccccaggattttacaggagagaacatggacctgcaatatcctatcaggtggagactgtgctaggaaggaaagcaaagctgggtgcaagtggaatcagggagggcttccctgaggaggtgacatttgagagggatgaggaagagagggccaggtggagggactcacagaggacggaagactccacttcctgactggcctgtgcttacccctcattctgcatgcacagttctgtctaaatgcgtccgttcttgcctttccaagaagtgctgatgtctcttacgtttcaagtctagctctgactgactcattctctctttaggtgcccccacaggcctcctcacctcttctcgtttgcttaagaaatctgaggtctgcgctaaagccagcctgggtgctgtaacctctcggccgaggatggtgcccagctgggcttgcatctggagttggaggaagtgggtcccgggaggggaagaggagccgtggggccttccaagggtttggtggaattgagttcctggtggggaggggctgtgttctgggtcttagagcctctcgcctgcaaagcaaagttgaacgtaacacgcgctcacatatctcgagtgccagcccggggctaggtgcttaacgcttgcttagccaaagtgccaggggctggggacacgggaatgagtgacccagaaatgagggccctcatggagctgaaagcattctgggcttggtgactttgaggaagtggcttttgaactgagacctgaaataccaaggcatgtggatatctggggaaagagtgatcctggcagtgggaacagagagtgcaaaggcccagaggcatgaatgagcttggtgtgtttgacccacagcaaggaagctggtgtggttggatggaaccaaacaagaaagaggtctaggagcagaggtcagggagggagctggggccagatacctgcattgtctcatttaacttgtgtaataaccctaccagataggagctactctcatgcaaatgttacagatgaagtaacagaggcacagagaggttcagtgacttgtccagggtcacacacctgaaggtggcagagcagggctgtgaacctagaagctccagagtcctcagtcctcaccatggtgtttaaacacaataaaatctatgcctgagtgctgaagacacacctgccatttagatcgatccacttttttacattgtcggtgtactccctgccatccatctgcccagaaatactgtgaatgtgggcagcgcaggactggttcctccaagccccattttacagacagtccaatcattttacatattattttatgaatgagcaccttcctcagtgtctcagaccaggggtccccacacagcagggccacacagcaggaggtgagtggcgggtgagtgagcgaagttttatctgtatttacagctgctccccatcgctcgcattaccacccaagctcggccacctgtcaggtcagctgaggcattagatgattctcacaggagcacaaacccttttgtgaactgcacatgtgagggatctgggttgcgtactttttcttttttttttaagacggagtttcgctcttgtcgcccagactggagtgcaatggtgcgatcttggctcactgcaatctccacctccccatgttcaagtgattctcctgcctcagcctggtggctgggattacaggcctgtgctatcacacccagctaatttttgtatttttagtagagacagggtttcactgtgttggccaggctggtgtcgaactcctggcctcaggtgatccacctgcctcagtctcccaaagtgctgggattacaggcatgagccactgcacgcggccctgggtgcgtgcttcttatgagactctaatgcctgatgatctgtcactgtctcccatcgcccttggatgggaccatctaattgcaggaaaataagctcagggctcccactgattctgcattatggtgagttgtataattatttcattatatgttaccatataataataatagaaataaagtacgtaatacatgtaatgtgcttgaatcatcccgaagccatggccccaaccacggcctctggcagtggaggctggagtccacatcacgctctgtgctgggtgcaggaatggagatgagtgggtgtcctgctcatttccctgaggaggaacctgaggctcaggctagagacttacctgggtgacacggctcctaagtggcagagtccagattcaaacccagggctacagacccagaagcctgtgcatttaaccacggttctgagctatccagcccaaagaggagagtttaaaaggattacatttcttcgttggaaatcagtgagcatagtcgcccagaaccatttttgaaaaactcagagaaggcctatgttttcctgaagcggccagggaagtattctgcctttttaaaagggaagactgaattctagggaggagaggcaccagctctctgggctgggcaggtctccaagctggcagggccacagcctcccgacggtcttgcctctagcatatttcttccagaagccacatttccacaggtgggcagctctaactgggagaaaatcttcctgagatttagccaaattagctttctttctttctttttttttttttgagatggagtctcactctgctgcccaggctggagtgcagtggcgcaatctcagctcactgcaatctctgcctcccgggttcaagtgattctcctgcctcaacctcccgagtagctgggatttcaggcacacaccaccacgcctggctaatttttgtatttttattagcaatggggtttcaccatgctggccagactggtctcaaactcctgacctagggtgatccgcccacctcagcctcccaaagtgctggtattacaggtgtgagccaccgtgcccagcccaaattagctttctaggagcttccactttctgagtctgtttctgcctcttggaggtagtgaccatctccctccaaactcggatacttctcttattcagactacacaactgtagttatttcaggtattctccctgactcaggaaattataagtttggcctgccttggcacatgagtcaactggttggagtcccacgcaaagactgtttgtttggtcaaagaggaaggagactattacctccttggatctagagcttatacttctgttgatgcaacctggaatcatactgtgtagcagccatatcccacttggagtgcatattgggcttgtcagctaaaatctccatgtttctcttctatatgagctgctgttaatccaagtttcttctattctgagagtccttgtctaaagctaagaggttccagtttttcatgctctctaataaatctacttcaggctaacatgctatcattttttctttgagtactgctttggtttctttccacaacttgttacacaatgttattcactgcccagtttagaatttcccttttggttcccattttaagacttatttaattatatgctttttaaatttttgagacagatagaattttttaagttatctttttattgttgatttctaaatttggtcatcatggttgttgtggtcaatatatgtggttcctataatatcagtggtagagaatttgctgagatctttataggattttctggtcatttttttcctcttgtgtttgaaaagaatgtatattttctgttgggtataaggttctagaaatgtatctatttgatcaagctagctattatattatctatatttgttatgtcactatgtggtttttttttttttacctgatttacctcccaccgtaatacaattacaattcaccataatagaggctttgttaagttctccttttgagtctgtcagttttttgctttatttttgaagctatgttgttaagtgcatagccatatgagtagaataagggttcaggatttttatacctttttggtgaattgttgcattttcccgagtagctgggactacagatgtgcactaccacgcctagctgatgtttgtgttttttgtagagatgggatttcgctatgtttcccgggccagtctcaaactcctaggttcaagcagtctgcccacctcagcctcccaaagtgctgggattacaggcatgagccaccgcagctggctgaattgttcctttaatcagtataaaagagccaacttccagcctgggcagcatagtgagaccccatctctaccaaaaactaaaaattagctgggtgtggtggcgtgcacctgtagttccagctacttgggagggcgaggtgggagaatcacttgagaccaggaattcaaggccgcagtgagctatgattgctccactgcactccagtctaggtgacagagtgagacattctcaaaaaaacaaaaacaaaaaaaccatccaccttctctcttctaatacttactcaagacatcattgtcatgaattctattttattgatgtcagtactcctgtactaataagccagatgagttaaaaacaacagcagccttgcaaccagccatgaagcaagtgatcttattctcatttcacagatgaggagactgaggctctgagtggactccagcctgccacggtctcccaccgagtcaggttggagcctgcacttaggcccagagttatgcttctgtgtctcagatgcttgggggtccctgcccacaaaggtggcccccatgtctgtgtgtccccacccatccaggaatggtatggggtgagacaacaggaagagctccatgggtagtccccacccactgccttccatatgccagtctgcaagcagaaaatgaacgggaagctcttacctgtgcccatgtgttgtcctggctttgggtttgcccagggggcaaagtcctggtcattgttgagacaagttcactgctgctgagggccgagcaaatggtgacaaaggccagattctaaattcctacctggttacttcctgctccgtcaccatcacctcgggcaaattctgaacctccctcagcctcattcctccatctgtgcttgcagggagaatattttactgtatcttccatagtgagctttccaggagaagcaaaaaagagtggtgtataaaaaagcaagtttatgactgcttctgtgccaggcactgtgctgtgcactccagagccaaaggcctgggttcaaatcccagcccactcactagctgtgcatccttaggcaggttcctgaccctctctgggcctcggcttctccatctctgcaatggagatgatattaattgtatctgcaatgctccttggattgggtccatggttaagtgagtgagtgaggctcaagggcttctttttttttttttagagatagggtctcactctgttgcccaggctggagtgcagtggcatgatcacagttcactgcagctgcgacctcgtgggctcaagccatcctcctgcctcatctcccttagtagctgggactacaggcatgtgccaccatgcctggcaatttttttttgtatttttggtagagacggggtcttgccatgttacccaggctggtcttgaactcctggactcaagtgatctacctgcctcagcctcccaaatggctgtgattacaggtaggagccaccgcgcccagccttcaagtgcttttttttgttagtgagactggtacaaccaatgccaaggctggtgagcaaagttgcacccagttggggaggggcgaaaccaagggcagaagggcccagggcatggcctctcatggctgaaggaagaggggacacgtggccagtcacagtgacctctgcagacctcaagaaggaggccagctaggagccatagctgtcactaagacagtcaaaatctaatcagcaccctggcgccaagaggccattgtccgctgctcaggacagtgagtgatagtcgataaccagctctctggaggtcagggccccgaggtggctgagatctgtgcctgcattaggacatttaaggggactccaagccaggatttgctagtgtttgcccagcagggagaggtggaaaattggggatgaccaaccaggcctccctgctcacagccaggggaattcatcctgtcgttcttccattcagcaaatattcatggagcacctgctgtgtgccaggcaccgtgctaggctctggggagatggctgtgagcgggatcgacactggccttgtgtgagctggccttgcagtaggggatatgagcaccaaacacataaggcccgagtgtgcaatatgccacaaagattgcagagaaataaagcaagataacaggttgcagaaagatggaggccaggctggctgctgttcctgggtaggtggcttctggacacagtttcctcaggctctgtttcctcctttgggcctctggaatcttctgaagacaggcctggcttccaggatcccggatggagttgcctgttgactgtgtggactcaaagtgtccacagtgcgccggagcgcgtggtcttccccagcaaatctgcttctcttctcggctctccatcgtgggaagggtccctgggatcctccccaccaccccagcctgaggccactttccctctgtccccgctctccccagcctgctttccccaccaagcgccaccaagtccctgctgcctcctcctcccaaacaggctcaaacctgccccctcttcgccagctctcagctcagcccgctcctctcctgcttaagagccttcactggctccccactgccctagagacagagtttgagtctactgccatggcttggcagacggtgttgtccccggcctgccaaccttccagctgccatcccagccagtccttctcccccttgctccagccaagggccccgcttgtagggtgggaagtgggccgtgccctccctcctgcctgcctattcgctgggtcttccctcattccctccctcaccccgccctctcataagaaccttcagaatctgccagacgcagtggctcacgcctgtaatcccagcactttgggaggctgaggtgggtggatcacctgaggtcaggagtttgagaccagcttggccaacatggcaaaaccctgtgtctgctaaaaatacaaaaaaattagctgggcgttgttgtgggcacctgtagtcccagctactcgggagactgaggcaggagaactacttgaacctgggagacagaggttgcagtgaactgagatcccaccattgcactccagcctggactacacagtgagactctgtctcaaaaaaaaaaaaagaaccttcagaatcataaaatgggtttaataattatacttatctcatagggagggcttaaagcacctaggccagtgtctggcaccaaggaaacactgtatacctgttaaaataagaataaaataaaatacacatgctcacttattgagtgcctgctgtatgtcgggcccctccccgagagaactctggtgcatccccgataaagaaacctgaccctctaggatgagggagggtcttccctgagcgcctgctaacagcctcctctgctaatctgaagtcctgcagcttgcccagcaggctggcttgtcacacgggctacccccacaggccgccatcttggaaaaggccaatggctgtggaatcattcttgactcctattagccttcctgttctctctcccgccccacagcatccatcctgtcagcaaatcctgtgggctctgtcttcaacacagatctagaattcagccccttctcaacctccccatctccgcagcctggtgtgagccctggcacctctctctggggccagtgtggtagcctcctcactgctacccacttctacccgtgcccccaccacccaagcaagagaggtcttttttaaagtctcatcatgtcacttctttgctcaaaacgctctggcaacttcttccttgctcaaatatttgttaaaagaagaaaggaatgaatgaatgaatggcctgtttgcatctgtaatagccagcacataggcagtacttggaaaacacccacagcaagaataaatgaggagatggctggacacggcagctcatgcctgtagcatgttggaaggccgaggcaggaggtttgcttgaggccaggagtttgaggttgcagtgagctatgattgtgccatagcactccagcttgggccacagagagagatccccatctctacaaaaatttaaaaattattcgagcatggtggtgtgtgcctgtagtcacaactacttgggaggctaaggcaggaggatcacttgagcccaggagttcaaggctgcactgagccgtgacggtgcgactgcattctagccacagaatgagaccctgtctctaaagcaaaaaagagaaggagaataagtgaggtacttgagcaagtgggtgaggatggttgagccacagcaggcccacagggaggctggtgggtgctgttggtggagggggccgatttgtgttcctggtggctgcagagccagtctgttgcctcccctccctcccactggctgggctggggacggagccaaccaggcagatcccgggccattctggggccctggcctggcctgccttactatcccagtggggccaccgacgtggctgccatttctggaaaccccagttctaggtaggttactgtcccaggaagaagtgcatgcctagcttcctgccagcccagcccagctgtcccagaagccagaggaagctctgggctggtttcttataagtagcatgactaactgattgcgccacaggagctgaggtttcaggccagtttctgtcgtggagtttcaggggtcagcggctccaaagccccagcccccacccgaggcccctgctgtccctggattcctctccacatgccacctgtcacagaggtgcttgcatcctgtctgcagaaccagcccctcctccaagccaggtttcctgcccagagggaagaagagcagaaggcctgtaccgccccctgtgcgcccccagtcctccgccccctgcccccctgccacccgctgtgggttcgggaagagtcctgctgggtcgcttccaggctgctgctggcttctgacatttcaaggcttaatcacttaatctcccccgagttttttaaaaaaagtgagtcaagtgtgttctcctggtggcgggcgtgttttcccaggcccatgcttctgctcatttcctggctgcggccttcactgactttgctgcttcctaactctgtgaccttggccttgtcacttgctgtctctgggtctcaggccaatgggtctcaggccagtggggctccccggacaaagttccagggttttggggactgcatttcaagggtcagcaaccacagtccttaaacacgtggattttggagtgacaatgcctaggttatggttctgtgaccaccagcaagtgctctagcctttttgtgcctcagtcttctcatcagtaaaatgggaatgttaatggcacctacctcatagggtcgttgggagaaccaaattgattaatatattgtaagtacttagaacagggccaggcacaaaataagtactgcatatacagttaactatggacaaaagcttgggacctggttcatgtttaaaaatgattattgaggccaggtgcggtagctcatgcctgtaatcccagcactatgggaggctgaggcaggcggatcaggaggtcaagagatcgagaccatcctggccaacatggtgaaatcccgtttctactaaaaatacaaaaattagccaggtgtgatggcgtgctcctgtagtcccagctactcaggaggctgaggcaggagaatcacttgaacccacgcggaggttgcagtgagctgatatcgtgccactgcactccagactggtgacaaagctaggctccatctcaaaaaaaaaaaaaaaaaagattgttgaatttattattgctgaatttttttttttttgagacagaactttgctctattgcccgggctggagtgcaatggtgtgatctcaactcattgcagcctctgcctcttgggttcaagcgattctcctgcctcagcctctcagcctcccgagtagctgggaatacaggcacccaccatcatgcccggctaatttttgtatttttgtagagatgtggtttcaccatgttggtgaactcctgacctcaggtgatccacctgcctcggcctcccaaagtgctgggattacaggcgtgagccactgtgcccagcctattattgctgacttttaaaccattcattcatttaatatatgtttattgtacacatgctatgcctgtgtcaggcactgtttcaggcactggggataaagcagtgagcacagcagacataaagctctgccctcatggggcttgtggtctctcagagggaggcaaacaatgcatttatagacaaatacataatttaaatttgaggttacctattatactcccaacttgaaaaactagcagtatattgaggtggctatttcacatctgatggaggaatatgtcttttgtgaaccatttatgttctttgcctatttttcttaaagggatgtttgtcttattgatttgtaagaactcttcatatattaaggccattaaccgttcataatgtagattgctacctttttctagtcttttgcttgctgatatagttgggatgtcatcctctctaaatctcttgttgaaatgtgatccccagtgttggaggtgggtcctggtgggagatgttgggtcatggggacgggtccctcatggtttggttctgtccttgccatagtgagtgagttctcacaagatctggttgtttagaagtgtgcggcacctccctcctctctcttgccctggctgtcaccatgtacgcctgctcccctcttgccttccccgtgaataaaagctccctgaggcctccccagaagccaagtagatacgggtgctatgcttcctgtacagcctgcagagccataagccaattaaacctcttttctttgtaaattactcagtctcagatatttctttatagcaatgcaaaaatggactaacacacttgagttctgtctttttcttatggcatattttaatctaggccagacacagtggctcatgcctgtaatcccagcactttggaggccaaggcgggtggatcacttgaggtcaggagtttaagaccagcctggccaacatggggaaaccctgtctctactaaaaacacaaaaaattagttgggtgtggtggcacacacctgtaattccagctactcgagaggctgagacacaagaatcgcttgaacccgggaggtggaggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgattagagatagtgataagtactgggacagacataaacagggtgctgtgataagaagtcacagggagggcccgcattagttgaggggggtcagagaaggcttctgaagtgtttctggtgcaaatgcttggaaaagggagagctgggagtgtatcccagggctgaggccaatggaggattgcagaagagggagaggggataggaggggaatgttagagggataagcaggggaattggctcttttcttcattttcttaaattaaactttttattttcagataattaaagatttacacacagctggaagaaatcatagagaagccgggcgtggtggctcatgcctataatcccagcacttttggaggctgaggcgggcagatcacttgagatcaggagttcgagaccagcctggtcagtatgatgaaaccccatctctactaaaaatacaaaaattagttgggcatggtggcttgcctgtagtcccagctactggggaggctgaggcaggagaatcacttgagcctaggaggtagaggttgcagtgagccgagatcacaccactgcactccagcctgggcaacagagtgagactccatctcaaaaaaaaaaaaaagaaaagaaaaagaaaaagaaatcacagagagacccctgcttctatgctgttccccccgagggcaagattgtagaaatctgtaatacagtatcacagctgggatactgacactgatataagctactgaccttattgggatttcccgatttacttgtactcatttttgtgtttgcgtacgcatgtgtggtttagtgctatgcaattttatcacggcataggtttgtgtatgcagccaggatccagcacagttctatcatcacaaggatggctcaaattctccttttatagccacatccaactcccttcctgacccaccccctcagcccctggcacccactgatgtgttttccatttccatggttatgtgatttcaagtatgttacataaatggagtcacggggtgtgtactctgggaactggcttttttcactctagggcttggattttattctaagtcagagatgcttctctaatgagctgtgaaccccctggggatctgtggcccctgtgaagaagccctttaggagccagggggcattggatgtgtgagctggccctggtctcatttctgattttaaaatggctctggctgtgatgtggagaagaggcagggtgagcctcatctgcagcaactgctaactgcccacatccccccagacttctcaaaaatttgccactcccctgctcaaagaccctcaaaagctgcccactgcttagaggacaggcctttgacctgaggtcctcacttgggcttcagggattctgtgaacccctaaaatggaatgcagaattaagtgtatgcaccttgccagaaacagggtttggggtttacattagatgctcagataggtcattgatccccaaaacactaaggtctctgacttctagacagatagtagttaagaaccaaagctttggagcttgagtgctggatttaagacccatgactgtcacagctgtgcaacctcagacaaatcactcagcctttctgtgccttggtttcctcatctgaaaatggagaaaataatattacctatttcatagattattaaatgcattcttgtatgtaaaagatgtaaaagaaaacttggcatgtggtaaactctgtgtgtttaagtgaatggtgaggctgcccagtataggagggcagagctttccaggtaaagactttctaggcctcctgggattatcaggccctctctgtgttggttgttgtcatacatgacagcagtattccttccaaagggatgccaagttgtggttgcacactgcacttagatccagttgattgacagcactgttcaagtcaactgtgtccttactgatttctgcctgctggatctgtcgattaccaaaagagttgaagtaatagtaataatactattattatccaataatagtattattcagaataatcacacagatttctctatttctccttgctgctctcagtttttgccttacatattttgaccctttgttgttagttgcctacacattaaggattgttatttacatcttcttggagaattaactcccgaatcattatatagtgccacttttttttaatttaaaaattttattttttattttttgagacaggatctttctctgttgcccaggctggagttcagtggcatgaacacagcccactgcagccttaacctcctgggctcaagtgatcctcctgcctcagccttcccagtagctggggctacaggcatgtgccacctctaataacttttctttaatttacaatagtattagtttgttctcatgctgctctaaggacatgcccaagactgggtaatttataaaggaaagaggtttgactcacagttctgcagggctggggaggcttcaggaaacatattatcatggcggaaagggaagcaaagacatcctttttcacatgacgtcaggaaggagacacgccaaggaaagggggggaaagccctttataaaaccatcagatctcaggagaactcactcactgtcacgaaaacagcatgggggaactgctcccgtaatctaatcacctcccatgaggtccttcccccaacacgtggggattacaattcatattacaattcaaggtgagatttgggtggggacacagagccaggccatatcacattattattaattagtgccttctctctcatttttttgattcgcctaggtagagatttatcaatttcattgatcttttcgaagaaccaatttttgatttcattgattttcctcgattaattttctatttttaatttcattgatgtatgctccaattttgtatttttttcttctgcttgttttagacatatattgcttttctgtttctagtactctagatggaaacagattattgattttagaactttctttctaagatatacattcaataatataaatttccctctaagcactgcttttgctacgtctcaccgattttgataggctatattttcatttttatttagttaaaaatatttttagtttctcttgtgatttcttctttgatccatatgttattcggaagtgtgtttttaaatctccaaatacttggaaattttctggctttcttcctgctagtgacttctaatttgaatccattgtggcctaagagcatatgttgtgtgatttctaatgttttcaatctcttaaggttgttttatgtcccagaatgtggtctgtcttggtgattattccacatgaacctgaggagaatgtatattctgctgttgtgagatgtaacagtctataaatggatacctctgttaatatgacctcgggtgactctttttttttttttaagttgctgcttcaccattggcttttggagattttgcagatgataaaatcctcaggacttttctgctgctcagtcagattttcttatcctacacttgcggaactgttgtttgaaattgacaagcaggatggccaactctgcccggctcattttatttcatcttattgggttcagcctgcagttttaggagatgagattgaaggaactggtatactggaatccacggtgggctcggaagcaaacaaacgtgggttctgattctagctctgaccttttaccagctgtgggacctggtggatgggttatttggcctctctggcctcagtttccttagctagacagttgggataacagcctacctttcaggattcttgtgtggattcggtgaggtaatacttctaaagcacctagcaaagtgtcaagtacaaggtaagtgctgggcaagcagggattttgttcacacaaagccttgactcaacataaggaggctgtttccaatggctctgcttaactgagacctgagagtgattgctccatctgtggtggcatatgggctgaaactgcctagcagcatgtcagaagtggggtgttcgcaggacatccttgtccaggttggcagttgagcttggcaggtgaccgctgagaccccttccaactccaccacttcaggaatctcttttttttttttctgagacagtcttgctctgtcacccaggctggagtgcagtggctcaatcttggctcactgcaagctccgcctcccgggttcaagccattctcctgcctcagcctcctgagtagctgggactacaggcacccgccaccacgcccagctaattttttgtatttttagtagagactgagtttcaccatgttagccaggatggtctcgatctcctgacctcatgatctgcctgcctcagcctcccgaagtgctgggattacaggcgtgagccaccgcgcccagccaggagtctcttgatttagaatgggaacttgaaatcatctcctcttgccgtgtacttgaacgcgataacctggcacttatctttttaattcttttactcacctgcatctttgttctttttgcctctgatgttcagggaagcctcttctcccactgcatctgtgatctctcctgaaatgtagcacccacacatccctgagaagctagctgcggcacgtgtgtgtgcacatgggcatgcgtaagtctgggcgtgccttccacaacagattaaggatatcaatcctgacgccatgctgggatgttttagtgaatcttgacagggttgttgactcccctgtttccctggaggactttaccatgaaagtcttctgctgtgtgactttggacaggcgtcttggcctctctgtttctctttattcataattgaggctaaagtgacacctttgccatctctgccacaggatactgtgggcatctgtgtagttgtgagagtaaaagttactaggacttgccaaggaaatcagtgtcaggaacccaccaccccattcccgcccctcctttacttgagactttacttttgtaactctcagcaaggaagacgagttcaacctttgagccgatacagagccttcccctagagagagctttgcagcctcatgctgagccagttaggggccccacatcatgtccaaaatgaatttaatcaacaaacagttactgaacacgtcctatgtgccaggcaccgttgtagatactggggactcggcagtgaatgggacagaccctggctgtcaggatgacagacaatttaaaaagggacagatgtcccacgctggcttgtcctttgcacccctggcacttcgtgaggagcagcggccagttcttgtatatagactggcccttggtgtacatttgtctgacgtttccaaatgatgtatgcatccttggcaggaacccaggaaaagacatgctgtgctcttctcaggaattgtttcagggaggtgatgttggggatttgtcccattcttgttggtgagtttagatcacttggtgaaggtggtgtctgccaggtttctgtattgtaacgttcattgatatgtattttcactcattagttaatatacaatacaagttttgcagggagttactttgaggctgtcatagtaaaatagagctttcccttcttccctgtttatttatttattagagatgaagtctgactctgttgcccaggctggagtgcggtggtgcgatcatagctcactgcagcctccaactcccaggctcaagccatcctcctgcctcagcctcccaagaagttgggattacaggcacacaccacactgcacccggcctcctccatttattgatctatgtcaatacagactcctggactttaactccaagggttacaagtggataccataatattcattttgatgctcaaaatgtgcctgttttgtccaggtcaggctagctgctgagtacttccttattgtctggcacaagaattccaagcctatctggtacttttccttctcctggaatcagctatttctctaaggcgctctggttcctttcagtacagaatagtatttagaagccaagacctggtcactaggaaggcatgataatcaaatgtgatgaatgatcttggattgcatcctggacgtataaagggcattattgaggcaattagcaaaacataaataggggccgtggatgagatagtggtgatgcatcactgttaatttcctgatttcgatggttgtattgtgattatgcagagaatgtccttgtttttctgacatgcacactgaggtattggggtaatttattcattatggagatatgtgagtgtgtttatgtgtctcatacacagatgtttcttaatgatggggttttgtccccataaactcatcataagttgaaaatattattaagtcagaaatgtacttcatactcctaacctactgaacgttatagcttaacttagctcggaacacttgcattagcctacagttgggcaaagtcatctaacacaaagcctgttttgttataaagtgttgaatagcttgtgtagtttatggaatactgagagtgaaaaacagaatggtcgtatgggtgctccaagtactgcttctactgaacacccattgattttgcaccatcataaattaggggaagagaggaaaagcacgcgtaagggaggaagggccgggtacagtggctcacgcctgtaatcccagcactttgggagaccaaggtgggcagatcgcttgaactcaggagttcgagaccagcctgggcaacataatgagaccccatctctatcaaaaatacaaacacttagccaggcctcatggtgcacatctgtggtcccagctactcaggaggctgaggtgggaagattgcttgagcccgggaggtggaggttgcagggagtcgaggttgtgccactacactctagcttgggtaacagagtaaactctgtctcaaaaaaaaaaaaaaaaaaaaggaaagggaggaagggaaggtccctccaggtggaggggacagagagagaaaaggcatggaggtgggactgagtttggtgtgtttaagaagtgcaggtggcagccgggctcagtggctcacgcctgtaatcccagcactttgggaggctgaggcaggcggatcacctggggtcgggagttcaagaccagcctgaccagcatggagaaaccctgtctctactaaaaatacaaaattagttgggtgtgtggcccatgcctgtaatcccagctactcagaaggctgaggcaggagaatcgcttgaacctgggaggcggaggttgcagtgagccgagatcgcgccattgcactccagcctgggcaacaagagtgaaactctgtctcaaaaaaataaaatgaaataaaataaaataaaatgttaaaaaacaaaaaagaagaagtgtaggtggcaggcgtaggatgcatgggtgctgggcccaggtggagagggaggtggagccctgctggggggagggccttcaagtgtgcccaagtcactcggagagcatccagcaggggcctagagctcctgaggtggccttaagttcttatgatgccccagacactgcacacagtgcttcagaggcaacacctccgttcctgtttgctgcaagcctgtgaggttagccttggaaccattcctgtgccacagaaacacagccagagcaccaaaagagaaatgctgttaatggcaaagaactactcactagcagaacaaagcctgggagctgcttttttgaataagatcccaggagagagacccaagcgggaagtgaaggatgggcacttgaaatgttgcagggaatataacccagcgcgtgctgttttctttttttctttttcttttttttttttttctctttttgcaacagggtctcactgtgtcgcccagcctagagtgcagtggtgccatctcggctcaccacaacctccacctcctaggctcaagcgattttcctgcctcagcctcctgagtagctgggactacaggcacgcgccactaccgcccggctaatttttttttgtatttttggtagagacaggtttcaccatgttggccaggctggttgtgaactcctaaagtgctgggattacagatgtgagccaccacgcccggccccagtacacactttttggagggtatttgacgttatgtaccaggagtgctggggaaaagtacacacttgactccgtgagattctgcttcttagcatttttttcttttcctttttttttttttttgagacagagtctcactctgtcacccaggctggagtgcaatggcatggtctcggctcgctgcaacctccgcctcctgggttcaagcaattctcccacctcggcctcccgtgtagctgggactacaggtgtgcgccaccacacttggctaatttttgtatttttagtagagacagggtttcactatgttggccaggctggtctcaaactcctgacctcgtgatccgcccacctcagcctcccaaactttctgttttcttttcttttcttttttttttatgacagggtcttgctggagtgcagtggtacggtcttggcttactgcagccttgacatcccaggctcaaacgatcttcccacctcaacctcccaagtagctaggattacaggcatgcaccaccgtgcctggctgattttgtttaatttttgtagagataaggtctcactctgttgcccaggctggtcttgaactcctgggctcaagccatcctccctccttagcctcccaaagtgctgggattacaggtgtgagccaccacacctggcttctgaacatttttttcttaatgataatagctggtgctatgggctgaatgtgttcccccaaattcatatgttgaaacttcatcccattgtagtcatattaagagatggggcctttggagaagtgattaagtcatgagggctctgtggttggtcatgaatggggttagtgccctcatgaacgggctgaaggaagtgtgtttgccccttctgtcatatgaagacacagcagcatggcatcgtccgtgaggaatgggctctcaccagatctggatctcctagtgtcgtgatcttggacttcccagtctccagaactatgcattagaaaatttatttatttattatttatttattttgagatggagtcttgctcttgtcgcccaggctggagtacaatgacgcgatctcgactcactgcaacctctgcctaccccagttcaagcgattctcctgcctcagcctccagagtagctggaattacaggtgcccgccaccacactcggctagtttttgtatttttagtacagacggggtttctccatgttggccaggctgatctcgaactcctgacctcaggtgatccacccaccttggctccccaaagtgctggaaatacaggtgtgagctactgtgtctggcctgaataataaaatttaaaacaatttttcaaaaattcaccatgaggtctcactatattccctaggctggtctcaaacccctggactccaagtgatccaccccaccttcccgagtagctgggactagagatgcacaccattgcacccaatagagcaatacgtttctgttctttgtaaattacctgctctaaggtatttttgttatagcagcctatatggactaagctgacttgtaacgttacttgagactttaaagtgttccggtcactgttggagggctctgtctgtgttagctcatttaatccccacaacacctcaatcagatggggctattcttagtcccactttatagataaggaaactgaggcatggaagcacagcttgctcaaggttcacatctagtcagtgacagagcaggtatttaaacctcaggaaataatcagagaaacatgtgtagagggttgtccaaggaaggccacatccagaagcatctcccaggacagttgttgtgtagctcaccctctggactttgtgggtctgggtgttgtttcatgattatagagagagctctgtgaacgtggaggacctgttgtcggcagagacacaaatggccagggcatggctgggcagccgcagtggctcaggcctgtaatcccagcacttcgagaagaccagaggggcagatcatgaggtcagaagttcaagaccagcctggccaacatggtgaaaccccgtctctactaaaaatacaaaaattagccaggtgtggtggtgggcacctgtaatcccagctactcgggaggctgaggcagaagaatcgcttgaacccgggaggtggaggttgcagtgagctgagattgcaccactgcactccagccttggagacagagcgagactctgtctcggaaaaacaaacaaacaagcaaacaaacaaacaaataaatggccagggcaggggagggttgcatattgaataagatgagctctgctggaagcacaggtcagcactaacctgcttcctctctctctgcaggtgccttggcatctcccaatggggtggctttgctctgggctcctgttccctgtgagctgcctggtcctgctgcaggtggcaagctctggtaagtcaccacttctcaatcattcatttgttggctattaatggcgtgccagggtcctgcagtatgtcacctggccttatggagattacactgcagtgggaggggacagccaatgacaagtggccctgattatcagtaaattctaaagattgttagaaagtgatgggagccgggtgcagtggctcacacctgtaatcccagcacttcaggaggccgaggcaggaggatcgcttgagcccaggagttcgaggtcagcttgggcaacatagggagaccttgtctctacaaataataaaatattagccaggtgtggcagtgcacgcctgtagccccagctactcaggaggccgaggtgggaggatcccttgaactcaggaggtcaaggctgcagtgaactgtgatcgcgccactccactccagcctgcgtgagaaagtgagaccctgtcaaaaaaaaagagaaggtgatggggaaagaacacagaacagcataagagggggttggggaagctgggtggagtgggggggattgcagttgaaagtagggaagtcagggaaggcctcattgagctgacttggaggaagcgggaaccgtgcagatgtctggggaaggctcattcttggcagagaggccctgcactgagcctggcgggagggttgagcacaggagggaatgtggtggaggagagtgagcagcaggagggagcagtgaaggtcagcaaggtgacagagtggctgaatcaaaaaagaccttgcagtgtttgagcagaggatccatatcatccattatgttccaaaggactcttcaggatgccgtgtggagaaaggaagagggtggaagccaggaggtctggagggaggtctggagtggaggagatgagaggctccggatccctctgggaggtagatttgaggacagattggaattgaggtgaaagacagagaaagagaagtggccaggatgactccaagatttctgacctaaactactgggaaggacgcggttgtcatttctgaaatgcagaaggatgccagaagagaaggtactttggggaggggcgggaatcaggagttagttttggacatgagataagcttggaatatttatttgctatctaagacagctccttaacatggtaagcccttatgcaagttgttgtcagctgagatgggcgtggcactgagcatgggagcatggaggcgcctgagtggtctcatgctcaggtggtttagcaaactcagtgtacatcctgccaattccagtcctgccatggccactgacaagctaggagggcgctgaaaggagaaggaccccgatgtctcctccagcccatccatctcctctctcccattggccaaacccaaccggaaactaaaggccaagggtacccggtgatgaagactgtggtatcagcctcctgagcacagagagggcagaaaggggtggagacaaagaggggcgcagatagtgggcaaatggggaagtggcacttcccctagctcgagggcagaggcttggtgtgatggaatggcactccttaaactgctacatattttccctttaatttggccaagaacaagttgtcaagtttgtgtgagataaaggtgcacttggttcgttcttgtctaatggcccccgcacccatgggtatttcttcagcttccacagtcatcccgacactagctgggaagctccagcagccctggtcctggccccagctctgtgggcgctggccctcaactttgcctgcactgtgcttttgtgctattccccttggtcctgtttgggtgcaagtccccctcacgcattgagttcctgggccgctcaggctgctcctgtgtctccccagggaacatgaaggtcttgcaggagcccacctgcgtctccgactacatgagcatctctacttgcgagtggaagatgaatggtcccaccaattgcagcaccgagctccgcctgttgtaccagctggtttttctgctctccgagtaagcctgcgctggagctggaggtttggggaggttgtgcccaaagggtttgccccaagagtgagctgggtccaggtggtgcgctggagtgcaggatgctgagtatggtttgctgctgtttatatggtgttagaggggaggtcccatctccagggacatgttatgtaagatacagtggagcgcatggtgggagtgttggtccacgtggcacatggatacggctggaatactggactagaccagcagttctcacactttttggtctcaggaccctttttcacacttaaaaatgagtgaggacccaaagggctttggtgtaggtaacacatcattctatgtttacctaattagaacttgcaatgaagaaatggtgtaatttttaaaaaattaaaacaattaaaaattttttttcttactgaaatggaggtctcactgtgttgcccaggctgctctcaaactcctgggctccagtgatcctcctgcctccgcctcccaaagtgctgggattacaagcgtgagccgctgtatccggcccaaaatggagaaattttaagtcccaacaacatgcaagcccgcattcaacaaatcttcagatcaattacatgatcacaggtcatgtagcctctagaaaattccactgtacgccagtgagagagagtgaaaaggcaaataacgtccctgtattatgatgaaaagagttttacctggtgggcccagaccacactttgagaaccactggactagacccttgattgaggagtacggtgttgagagtggagtcctctgtgatggtggatggaccaggacacatggcataggagtcaggtggttccctgggctactccatggtgcacaggatgcttcgttacactggtgcccaggacataatcacgtacacaagacacacagttacggggcagactggggatatacggcacaccagcatgcagcgttcaccagtaaaggtggtattccatgattattctaaggtagatgggctgtgctttgtttccattggcttagtccagggattggcaaactatggcccgtgagccaaatccggcccactgcttgtttttgtaaataaagttttattggaacacactggctgctgtagttgtaacagaaactgcatggccctcctttatgttttttgtttgtttgtttgtttgtttgttttctttgagacagagtttcgctcttgttgcccaggctggagtgcagtggcacaatctcggctcactgcaacctctgcctcccgggttcaagcgattctcctgtctcagcctcccgagtagttgggattaatggtgcctgccaccacacccggctaatttttcgtatttttagtagagaccggttttcatcatgttggccaagctggtctcgaactcctgaactcaggtgatccacccgcctcagcgtcccaaagtgctgggattacaggcatgagccactgagcccggcctcctcctttatcttaattgaaataattcagaaatggaaagtcaaatactgcatgttctcacttataagtaagagttaaataatgtgtacacatgggcattattccatgtaccatggaataacagacattgaagacttgggagggtgggagaggggtgaaggaagagaagttacttaatgggcatagtgtacaccatttgggtgacggacccaccagaaccccagacttcaccactaggcagcatatccagtgagaacagatctgaggcttgccatcaaaattgcacttgtaaggccgggcactgtggtggctcgcggctgtaatcccagccctttgggaggccgaggtgggcagatcacttgaggtcaggagttcgagaccggcctggccaacatggtgaagctccatctctactaaaaatacaacaattaactgggtgtagtggcgcacacctgtaatcccagctactagggaggctgaggcgggagaattgcttgagcccaggaggtggaggttgcagtgagccgagatcacatcactgtactctagcctgggtgacagtgagactttgtctcaggaaaaaaaaacaaaaacaaaaaacaaaaaactcgtaccccctaaatttatacaaataaccaaaaaaaaaaaaaaaaaaggaaattgtgtggcctttgaagtccaaaatattaactatctggcctgttacagaaaaagtttgcagacccctggcctagcccgtgagatgtgggttggctgttaaggtggaacattggaattatcttacgatggccaaactgtgcgatgcagagcttatgttgttctaaattaattagtgccaccggttcttccctttcatgggctttcaggaacaagctaagtcccaggaccagggccggcagctaggcaggtgtgaggagcatccttggtgcatgtggtaagaggctgtggccagcaagagaggcaaccctagtcggctgccccagcacaccctggccgctcccaagcccccagatctgtcctcacatccgtgatcgggaagctggaagagtctgatgcggttcctggaggcatgtcccggacacagctgtggggcccagccagcctacaggtgaccagcctaacccagcccctgtgtctgcagagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatggtgagcagggcggagtgcggcaggggtggctgggtgtgttcccacagctgcctgggctgagggtggggtgggcaggggaggaggtggggtcatagcaacagcaggaggaagccgcctgtattttcccaaatctgatgggattcctgcccctgcctgggcctcagtcctcccacctttgaaacggagctggtcgcagtagaccaccaagcccccttcagcccagctgtttccacccctgaacttaagtgcccaggaaggcgtattgagatgaggtgtgcttgctggaaggcatgcctgctgctgattgaaaaccgaactgggaacattccttccattctgtgtccactggtcagctgctgcggctttggatggtcttgaccgtggaaggctgaccttcttctggtacccggagtccctgcaggaatcccccttgagcttgctgggctgtggtgacaggagtttaaaacatgcgttgtattccagtgatgcatgatatgacatgcatcacaggaataaaaacctgaggtctcatggatatgattgcttcaaaggagaccaagttttaaaacagatgaatcaaaataaagaaaaatactcagtaaatcatcataaagtacagagatgtggccaaaggtgtgaaggatgcagctgtaaaagctgaagtttgaggccgggtgtggtggttcatgcctataatcccagcactttgggaggccgagcccagcggatcaccggaggtcaggagttcgagaccagcctggacaacatggtaaaaccccgtctctactaaaaatacaaaaaattagtctggcatggtggcaggcgcctgtaatcccagctacttgggaggctgaggtaggagaatggcttgaacccaggagaaggaggttgcagtgagcttagatcatgctactgccctccagcctgggcgacagagtgagattacgtctcaaaaaaataaaaataaataaaaataaaaagattttttaaaaggctgaagtttgggttactttggctcatacactttgccttcactgtagaaaggtggttagtaaagaccaggcgcggtggctcatgcctggaatcccagcactttgggagcccagcgcaggcagatcacttgagccctgggctattgaggctgcagtgagctgggattgtgccactgcactccagcctgggcaacagagtgggaccctgtctcaaaaaagaagaaaaaaagggtaattaataaacactaaagttctatgtagaattttagcaacattattgttattataatcttctttgctatggctctgaatctgtgtggtgctccagaagtatgctatggaggttttgtcgaccaaaaatctgggtggtggctgtggtttgtaggccggggctgggctgggtgatgggggagtcactgcatagatcctcacatagaggccgcttctcccgcagtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatgtgagtgggcatgctttgacgtttttctgtgacctctggggaacagggtgggtgaccagcagaggcccagtccctggagccaggagcctgggaggcaagccctggggctggatagcaaatcccaggagctagagacctggcttctcacctggctctgcactaggcaagtccctttgcttcctggccccccacccctcacatcagagaaggggagttatctctgcatgccgctcctcctctgtaaaggtagggctgtgggccacatctgtgtttcccagtttgggggacacaagtgatcgtaggtggcacattgacagctcacttgaataaccctattattgaagagaataatactgactcaagagacagtgacccgtgtcagttcccttttgaggccaacgggttaaggaggaagtccccatacagctgactcgtttactaattcctcttaatgaagagagcagaggccacaccccaggcttagactttcccaagaaaacaagatcagtttgttggttgttccccatggaagctggtcctgacattcccttcacagtagtgttggtggagtttttgttgttgtttgttttgagacagagtctcactctgtcacccagggtggaacacagtggcgtgatcttggctcactgcaacctccgcctcctgggttctagcgattctcctgcctcagcctcctgagcagccgggactacaggcacctgccaccgtgcccagctaatttttgtatatttagtagagatggggtttcactgcgttggccaggctggtctcaaactcctgacctcagatgatccactcgccttggcctcccaaagtgctgggattacaggtgtgagccaccgcacctggccagtggagttccttcttaagtacatgtattgacatctttaaaaagggcgagaggatttacaggaaactatcaggtcagtaatggcaggggccgtccacagtgggtggctgagtccccctatttttctgctggtgtgcagggaggtcatttcctgccacccatgtttccccaccctgaatccaccttcctcacattcccattggagggacaatctctggacatatgggacctggggtcccacagggctgcaatccaatgcctgctgtgccactcgccagctgtgtgatgttgggcatatcccataacctctttgtgcctcagtttcctcatctgtaacacaggagtgacaagagcacccgcccacagggctatgacagtacaaggtgtgtgatacagatgagctcccctgtttggcccacatgtgtcctaaaagccatgtgccctttctcttgagtgccccaggccacagagatccccatctgcccgctgtcccacacactggtctgtcatttgttccttgaggtttgtgagggccggctctgtgcatcccaggggcccaggctgggcctggttggctctcagggagcaggcacccgccaccttaagctcccatgctggtgtctgtcactgcttcctctcaatctggccaagccaggggtgtcgatttatatctctcaggtctggtttcccctttggcactgggccaggtatggggaaagagcaggaatggggcagttggctcacacagcagaggctcagaaagcggggggcatggggggaaggagtgcacagatgctagagagtggggcaagttttgtttggtcaataaatctccttctcatgccccaggcctgtgcaagacctacagagagtcccaaggatgggctggggggaagagaaaggtaccaccttcagagtccaaagatatgttatttaatattttcatatttctagatctgccttcaggcatggctggatccagcttctaggaacctgtccagctctgcgccctgctttattctgtactggcttcgtttttaggcaggctcttccctcatgtagtggcagatatgcctactagttgctccaggcctacatcccaaagccacagtgggaaaagggttttttttcttgacggttctaataagagtcctaaggctgctgctcagtggcctggcttcgatgctgtgccagcctctgaaccaatcactggctgtgggtggagagagggtgctggtggagggccctgcttgtccagggaggagtcacatacctgcctctagggctgcaggtgggctcagctccatccaaaccagatgaactgaaaataaggcaggagtggcttccccaggggaaactggggaagaggaagcaggactgtgctggctaaaatgccagccaggtttaagacgtggcaccagatgccagtcatgggattggattggtcagcatgcctgggctatggcttaggggtatgttggtgctcagggatgccacaggcctccagataccaggtctgaggcagaagaatgaagtccagcttctcttgtgggtggaacagtggcaactgagataccccatctctcccttcccaagaacagagctgaacataaagaatttagtgattggccagagcttggccacatgctcccctctgatgaatgataggccaggtgatgggattggcacaattggcttagactaatgagggttggccctggagttgcaggcagtggagttctgtcctaagcagtgggcacctaaacccgatggcataaaagctgggcgggtgtccacctgcatctgccacagcactataggcaccaactgtggctcatactgagtgggataaattccagaaagaaacattaggaacttactatagaattttggggctagagctactcattcattcccctagataatttctaggcaaggttccatagtggagggggagttttggcttgggcattgaaggatgcataggagttttctagatggggaaagaagggaacggtagaccaggcagagggaactgcatgataaaaggtttatgggtgtgaaaattcatggaatgtttgaggattatggggttgggggatgtgggaatatgtgtagcgataaagcaccaaacaaagccaaaagtttagttagagccctgaatgcctgcctcataatggtttccatattttatatgcctactatgtgccaggcacattgctcagggtcacacagctggaaatggcagggctgagtttttgttgttgttgttgttgttgagacagagtctcactctatcacccaggctggaatgcaggggcgtgatcatggctcactgcatccttgacttcctgggatcaggtgattctcccacctctgcctcccaggtagctgggactacaggcacaggccaccacgccaggctaattttttgtatttttagtagcgacagggtctcgccatgttgtccgggctggtctggatctcctggcttcaagtgatccccctggctcagcctcccaaggtgctgggattacaggcttgagccaccgcatccagcccagatctgagatttgcacccagtatttgaactcccaagcctgtgctctttttcctcccatggacatttctctcagagatggtctcccaaacacctgtccttcttgttaaaaaacagacaaaccgcaagtagttctttggaagctcagatttctcttttgtttcttagtaaaacatttcccagttcccagctcccttccagggtgtaagatttcttcggtaacttacatctagctgttgcttcttgtttgctcatgtttagaaagaaagacaaaagagagtgagaattttctctcccttccccagtctccccacaactcacaccccaccctcagctccctctgtaataggaaaatctctgaactctctgtagttgctccagcaatcttttggaactttgcttctttcttgtgaaaaaacctccccttggctcactttgcaccaggtttccccaaatgtgcttccaaccacaagcagaaatggagctgccagtaaccaggaagaaactgccgggggctgaggaagaggagagggaggtgcatagccctggatctcgcagggagaggggtgacaggatgagaactcaggttgctcacttgccatcagggtcagtcatgaatatagcgttcatgtatcactttttaaagcttttttggagggtaaaagtaatagttacacaaaataaaaatacaaatggtacaaaaggacttagaatggaaacatgtttctctcccgactccagcctcctgtttttcttcccagagactgaccactgctgtctgtctcttgccagaagggaaagggaggcaaggttagggcaggcagagggcatgtgcatcctttagagagagcttatgtctatacaagcaaatgtgtgtgttcagtcatcgctgtcttagttttctattgctgcataataatggtactaccagcttcacagctttaaacaacacccatttattatctcatagtttctgtggttgggagtctggacatagcttagccaggttctctgctttagagtctcgtgaggctataatcaaggtgtgggatggggctgcagtttcatctgaggctcaattggggaagggtcacttctaagctcatacaatattggtgacattcagtccctggcaggctgttgaactgagagcctcagtttcgtgctggctgttggttgtagttaaccctgaattccttcccatgtgccctttgcaaagccatcaaggcagagagacttgcctagcaagtaggatattacagtcttctgtaatataatcacatccatgaaatcctctatatatcccatcacctttaccatattctgtgggttagaaacaagtagcaggtcctgcccacactcgagaagaccagatgacacaaagatgtgattcaaagtggggatcatcggggccatcttaggtttgtctgcagtgatcactgtgccatctctctctctctctttttttttttttttttttccgagacgaagtcgtcactctgtcacccaggctggagtgcagtggcatgatctcagcttaccacaatctctgcctcccaggttcaaatgattcttctgcctcagcctcctgagtagctgggattacaggtgcccgccaccacacccagctaatttttgtatttttagtagagacagagtttcaccatgttggccaggctggtcttgaactcctcacctcaagtgatccacccacttcggcctcccaaagtgctgggattacaggcatgagccaccatgcccagccccatctctctttaaaaaacaaacaaacaaacaaaaaacataaaaagaagcagagaacacatacacatctgcatcttcccttgtttacttaacaatagatcttggaagtcacttctcagtagaggctaggttgggcagagcattggattctaggccagtgagtttggacttgaccatggagacactaggaagcccatgaaggacagagagagatgcctcgaccctgccagtcctttagaaagatcacccagtgctttttgtataccaaaccctatttgaaatacttacgtatattaacccatttccttatcaccacaaccctgcgggaagggagataggcacttttattatcttcattttgcagatgaggacattgaggtccagagaggttatgtcacttacttaaggtcacacagccaggaagtggtagtagggactcttacccttgttttacagatgagattgaattatctcacgaaaactcagaaaggttaaacaacttgcctaagtaacatacagctaattagtcgaggagcctgacgcatgttgctgtagcctggtcacagttacagaggtggcaagcaatggcctgaacaggacgaacaaccaaatacccaggctggtggctcttaaacatggtggggtcagctaacgacagcaaccagggtgggcactggtgcccctcgcccccggctggtgccctaacatctcccttttctctaccagttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactgtgagtatcaagaggcctaagcaatggtaatctccactctccattcttcccctgtggccagacacttcccctggctgagtctctgggcttttatatcataggatgcctctaatggcaatcctgccattagatacacctgccgtggtgtatctgccaggtaggcaggctaggctgcagtaacaaacaagcccacaatttccatggcttaacactatgggaatatatttcttgctcacgtaacaagctaacgtgaatgttgctggtttgtaggtggtttccctccctgtagaaatctggggagtgaggttctttccatcttgtggtgccgtcattctccaggacaaagattcttacctacttttgtgtcctggtttcctttggcagcctggtgaagcctatggacctcatttcagaatatttttaaatacataaaatcccagcctgggcaatatagtgaaacccccatctgtacaaaaattagccaggcatggtggcatgcacctgtagtcccaggtactgggaaggctgaggtgggaggatcacttgagcccaggagtttgaggctgcagtgagccgtgatcgtaccactttactcccacctgggtgacagagcaagagcccatctctaaaaataaataaatacaatgaaataaaataaaataaatagaactacagaggaaactaattgtattgaaatgcagttataaaacatttaaacacatttttaatctagagatatatgtgcttctttattaagatctataaataataagttctaggggtagctcgcataaatactgtaatttcaaagtagataagcataaataatactttatgatactgaaattgtgatgtgatatgagaatagctgtgagttttgttttgctggggacaggatcagtgatgctgtcattactggggtctcttccctccattctttttttaaaattgtattttattttatttttaaaattttaaaataaatagagacagggtatcactatgttgcccaggctgcttttgacctcctgggctccagtgatcttcccatcttggcttcccaaagtgctgggattacaagtgggagccagtgttcctggccccttcctccattcttaatggaaggagatgctaggtgtgagaggttagggaaagtaaagatgtaatttctttcccatccaagttctcagacccctgaattctacctgcagccatgttggtccatcaaccccaagtgaagaatccctgctctagggccccaccattgtctgtatccagccagcagaagaggcgtgattatggagatcacatctgcttcttgaaagcagacagcccggaagtgggccgcatcacttcctctcaaattctattggtgaaaatggtcacatgactacacatagccacaaaggaggctgggaactttctcacttggaacctacatcccagaaacaactcttttcagtgaggtatcccacaggtctttcgcagtagaaatattgattatctcacataaaatgaagtcttacaaatggacctactgggttttgtacagcagccaagtgatatctcttcccttctgctgtcttcccttctgccatccttcacatggtggcattgtatccttagacttgccacccatgccctcaggttggccgttgcacactgtcttacataaagcaggaaggaaaggaaaggctgctacgagagagtgtaccttgtgcatctcttttttaatcaggaagcaaacatctttctagaagcttccctagcaaaattccccttacatctcattggccaagactgttacatgttacatggttactgttattacttgctcattgcaaggaagactgggaactcaaatgcctggaaaaaggaacaggataatcgtgattggctcaagccttagggtgggcatggctccctgacaagggagagaggaaaaagctgttgagtgaagaagactgcttcagtttccccatctgtataatgggaggagtaagggctgtcgtaaaaactcaatgaaagaagattcttcaacgtggtaggtgcagtggcagctggcagtaccctgaccctgccaccgcacagccctctcagcattgctcatcctgcactgtggatatcagttgagccacgtgtctcctgccctgggctgtgagctccataggcagggtctccatggctgtatctccagaacccagcacagaaccaggtgcttgggaaagttttgaattgattctcatctgccattggcatggggaagggaactagcttgtatgaaacagataacaatgtatgggaccctcattcattatttcagcaaatatttgctgagttcctcctacatggctagccctgtgctagacactggggaatcggcgatgaacaaagcagatagaaatccccactcttgtggagctgacattctggagggagagacaaaaagcaaacatataaagaaagaaagaaatcacatggatctggatgacagtgagtgctgggaagaaaataaaagcagaggaaggggatggagcgatgggcagggggcaacggtagggagggtgtcggggaaaactttttggagaatgtgacgatgaaagtgaacaaggagaagtcaaccgtgttgagatgatggcagctaatgatgtggacaggccactctgttctgagtgcattatctattgattcatcatgtcatcctcgcaacagccctgcacgatcaattctgtcattaaccccatagtacagatgaggatgcggaggcacagagaagataagggacttgtcctgtgtcacacagcaaggagccatccggctcctaagttggtgcatttgacttctgtgcttccggaaagaaagagcagcaagtttaagatctggaggtggcactgagctttggaggagcagggggcaatgaggtggccggtgtgacgaggactcaatgtgcaagagggagagtggtggggagatgaggtggaggggtggtcggcggtcagatcgtggagggtctcggacgagggtcctgaccctgggtctccagtcctgggaagtggagcccaggctgtaccatggctgacctcagctcatggcttcccctcccacttccagcctacagggagcccttcgagcagcacctcctgctgggcgtcagcgtttcctgcattgtcatcctggccgtctgcctgttgtgctatgtcagcatcaccaagtgagtcctgggcccagtgctgccgagcagtccctctggagtgcagggtggcagggacttgcccctctagtctgcccctttgcagtcctctcagtcaataatacgcatttactgagcagctactacacaccttgagagtagagctgagaacatatcgacaaggaccccacttttttctttttttttttttttttttttttttgagacggagtctcactctgtcacccaggctggagtatagtggcacaatcttgcctaacagtaacctccgcctcccgggttcaagcaattcttctgcctcagcctccagagtagctgggattacaggcgcatgccactatgcccggctaattttttgtatttttggtagagatggggtttcaccatgttggtcaggctggtctcgaactcctgacctcatgatctgcctgcctcagcctcccaaagtgctgggattacaggtgtgagccactgcacccaaccaggactccacatttctaaaaccggcatcctactggggagactgaaaatacatatcaatcacaaacaggtggttttccatagtgacccactctctgaatgcactagaccagggtgcaggccagagatcttctggggtgctttttgcaagggggaccaggataaggctctccaaggagggaaaatttgaggggggccctgactggggagaatgagctggccagggataagcaagatggagtcatcccacatccccttacaacgctgggtgcctgggcaactgggggcatctgggggcatgtggtaggagccagaggaatttgcgacgattgccctgatggagtcaggagacctgggtttgaatcctggccttggagcttggtagctggcggccgacaagttgctgaaacccctgagcctggggttcctgctttgcagagtgacagtgatggtgagaacatatttcatcagccagaagaggccaaatcacagtaaaggctgagggaggagatgagtggcgagtggctgggaggtggtggaaggagcctcgtttccagagagctcttgccagcccttggaatcatggtgtctcagagcctcagtcctcccatctctgaaatgggactagcaagctcaacctcactaagtcaggattagaggtggctaaggattattaacatgattgatgaaagtgcccactcttggcccagcacacactaggtaggcagggaatgcaaattcccctccatatcttgtcactgatgcctccgagcaaccttggactgatcgccttgctctgagcctcagtttccccatcacctgtacctcttcccactccccatcactatatcccagcatgccagcctctttgctgttctttgtctttggtttcttgttttgttctgttttttagacagggtctcactctgttagccaggctgaagtgcagtggcgcggttacggctcactgcagcctccaattcctgggctaaagagatcctcccatttcaacttccagagcagctgggacaacaggcgcttgccaccacacctggctaattttcttattttaatttaatttaattttattttttgggacagagtggagtctcaaaaaccaagctggagtgcagtggtgcgatctcgactcactgcaatctctgcctcccgggttcaagcgattctcctgccttagcctcccgactagctgggattacaggcgtgtgccacgacacccagctaatttttgtatttttagtagagatggggtttcaccatgttggccaggatggtcttgaactcctgacctcaagtgatccacccacctcgttctcccaaggtgctgggtacaggcatgagccactgtgcctggccaattttcttacattttgtagagactggctgtcacttatgtagcccaggctgatcttgaacttctacccctttatctttattcatggcacttattaccatgaatgaatgacctcatataagcatttctttcgtttttttttttttttctttgagatggagtctcatgttgtcccccaggctggagtgcagtggcgcgatctcagctcactgcaacctccgccttccgggttcaagcgattctcctgcctcagcctcctgagtagctgggattgcaggcgcctgccaccatgcctggctaagttttgcatttttagtagagacggtgtttcaccatattggccaggctggtctcgaacttctgacctcaggtgatacacctgccttggcctcccaaagtgctgggattacaggcgtgagccaccatgcctggcctcatataagcatttctgtctccatttatcatccatctttccctcttgaaggtcagtttcaccaaggcaggcatctttgtctcgttcactgttgtggcctcagggccaggcacagtgagtcaaacatagaaggtgctcaataaatatgtgtttatttattgaaaccatgggcagaggctaattcagaagcggtctgaggaccttacctcccagtgatgatgcaccatggccccaggcaggccaggaagagagaagggttgtgtttctccgtaggtcccccagcttcccaggccatcccaggccattccctggtcatttgccctcagctgctctgaaaaagggattgttgaggggaacctagaatcctctctctgcagtttgagtctttcctaatcccctggggtctcattcccactgaggacataggtggcctcctcaggaactctgtgctgggtaacagaatgcgggagtgtgaacctggctctgccacctaccagctgtcactccacctccttgggcctcactctcctcatctgtagaatagggttagcaatagaatccatgtcaccaggttagaatgatgagtcagtggtttgacctccagaaactaatcagcctgatctctgatgccaaataagtattggtgataacgaccacttttatgggaggagcgttcacctgtcaataattcagagatcaacaccttttccttttgtttttcaggattaagaaagaatggtgggatcagattcccaacccagcccgcagccgcctcgtggctataataatccaggatgctcaggtaggagtaggcgtggatgaggacatgtgggactgtgtacatgaagaagtgtggttcagaacacctgggctgttaaggaccttcactggcttctggaatggcaaatagacagtcaggagggttgcaggggagacagagacagaagccgaatgaggtcattagcagaccagaggctttcccgcccttccccttggcaatcccagcctggggtgggcttctctggggttggtttcctgtttttttccctccccttgggagaatgacccttgggtcatcatcactgtgtcattccctggggaggtgccagtaccagggctagaggccagaaggagtggaggaaggagagggtgacaggctttctgtgtcttcttcttaagcataggaaactgcccccgaagcactagcaaatcccttccgggttctcattggcctgaaatgtatcccacccctaagccaggggtggagtcagcttccccaaggcgatggtcctgtgggtgagtgggtggggtttgcctgagcaagatgagagttctctaggtaggagaaagggggattataggtcctgtctagaagagaaggtctgagggtccttgcttttccagggactctggaatctagtggtgttggctttgaatcctgactctgccactcactggcagtgtggacttgagcaagttgcttaattctctgagcctcagtttcctcttgtgggttataacagtgtttacctggtaggacagatattggaatttattgagacaatacatataaagtgcatattccagcctcttgcaaataccaagtgccatttatgtatcagttagtgtttgctgtgtaacaaacgaccccgaaatgtagagggttacaacaactttatttagcttatgcttctgcaggctggcatttggggctgggctcagcagtgagggtggcgggggaggctgggctgggctgggctgggcagatctgaattgagctgacccgtccccgtagcctccctccgtgtctgacagttggctttttttttttttttctttttctgagacggagttttgctcttattgcccaggagtgcaatggcgtgatcttggctcactgcaacctctgcttcctgggttcaagcaattttcttgcctcagcctcccaagtagctgggattacaggcatgtgccaccacgccaggctaattttgtatttttaatagagatggggtttcttcatgtcggtcaggctggtctggaactcctaatatcaggtgatccacccacttcagcctcccaaagtgctgggattacaggcgtgagccactgcacccagcctagttggctgacttttacctgggacagtgcaggtgcctgagccatgtgcctctcactctccagcaggccggcccaggcttgtttacagagtggctcagttttcaagggtgggaagtcccaaggcttcttgaggcctaggcgcagcactggcatgatatcacttccatcacattctatgggcccaagcaagtcccagggccagtgtagattcaagggatgggaggagattcagagcactcctctgtggccacttttgccatcgaccacagtccctgtaaatattaggacaatgtaattaattcccaggaatctgaagctcagaaagcgtaagtgacctgttggacttctgatctgtgtgatgtcgaggcttgtaccccttcctgagcattgccgtactccaggccgggctgcaaggccactctgctctttcattggctgtctctgtattttaggggtcacagtgggagaagcggtcccgaggccaggaaccagccaagtgcccgtatgtatctgaacttaggtcacagcctgcatgcattgggaaggtgatagaattggagaggcaagcccctagctccatgtctgccttctcttccctgcattcggtaattgccctgtgacattagccttcaagggacggcaggaggaggggtgttctggaaacgtggactgctggccaagccccctgagtttcactggtgtgtcaggtacatggtgataccccttgggagtgctgttatagttaacaaccagagcagccgtgcctgttgttaaaatcttgacctaattgtatacttgtcggcaaatagccactatcctgaacactcccctccttttttttaatatacaggatctcactctgtggcccaggctggtgtgcagtggtgcgatcatagctcactgcaccttcaaactcctgagctcaagtgatcctcccatcttagcctcccgagtagctgatactacagatgtgcattaccacgcctggctattttaaaaggtttttgcctgtaattccagctactcaggaggctgaggcatgagaatcacttgaacccgggaggcagaggttgcagtgagcgcagattgtgccactgcactccagcctgggcgacagagtgagactcttgtctcaaaaaaaataataccaaaaaaagtttttgtaaagacaagctctcgctgtgttgccccgccactgtggcctccttagcttcttccctggggcctgctggacctttccatactccagaaactaaagggggtccaggaccctgcttcaaccctaggatcccgcatcttttttttttttttttttttttggacgcagggtcttgctgtgtccctcaggctggagtgcagtgattcactgcagcctcaaactcgtgggctcaagtgattctctagcctcagccttctaagtagctgggactacagtcatacaccaacatgcccagctaattttccttttttttaattcttgtagagatgtttgagacggcttgggctctgttgcccaggctgttctcaaactcctgagctcaagcgatcctccctcctcagcctcctaaagtgctgggattacaggcgtgagccaccgcacccggcttccatatcctttctaattggtcatggcttgggataatggtgttgcttttaattatcatcatccataaagactttttcttactcaacagatctgagcttgtatttggtgcccaggacatgtgctgggttcccgaaatcccaaagacacagaccctaccctcagggatttctcattctagcaacatagactgatcaattactgattataacgttagaaggcatgtctgaagtagacagccatcaggacatggtgatttcaggctgggctttgaagaatgaataggagtttttcaagtgtcgaaactgaaccctgaccaacctttgcttttgcagacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacgtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctatgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctcttta

SEQ ID NO: 1802 - DNA, 50870 bp, Homo sapiens; identical to SEQ ID NO: 1801

SEQ ID NO: 1803 - DNA, 50870 bp, Homo sapiens; identical to SEQ ID NO: 1801

SEQ ID NO: 1804 - DNA, 50870 bp, Homo sapiens; identical to SEQ ID NO: 1801

SEQ ID NO: 1805 - DNA, 72752 bp, Homo sapiens
ttaatacatagctcatttattttatcaaaggagaaatgtattccaaagtaagcaatttgtaatgctgtatgaaaatattttatatacagatatagtgtcaaaattaaatacagatatttcattaattaaaaggtaaacatatattattatcttaaaaatatatctcccaaattgcaaacttatttagacaagttataatctatataaatgacaatgtaactcagtactaaggtttagcatccttagactaggtgaatttatttttattttattttatttttttgaaattgtccttttttcatgtcaaaacatttgctataccatttattgaaggcactgtgttacacattcatgattaattaaatctcttgaaatctcttttaggtatcttggaccttgttatgctgttgcttacttaaggtttatgactctcttattctcaccggcattatccatatatcattgttaactctaaaacatctccagcacagaagaagacaattttcactcttaatacagtataatagattcatagtgagccataaaattattttgacagtaaagcaatgtcaattttgaatctttgaaaccattatatacttcatagatttaatgtcttgaaatatttaaacaggtttgagaagtattattgcaactgataccttacatggattgtcttacaaaaatcagtacagaattatactgattgataaatgttcacatatataagaaatagtttgttgactggagcattcagtttccattgtttgtattcatcttctagtaatacaatatgcatttctcaaatgccctaatccgttttgaccatggtgcattcagtaacttctaggaagcattccactctgaaaaactgcataagcagatagattcttggaggatgcagctaaagttcgtgtttctatattgccactccatatttttcagtgttctttagtgcccatcaaaattttattccaacaagtttttatctcttgtaatagtctctttaggaaacacaagtcattcagttttttctgttcctttaaagatttattttcttcctagagaatagagttttaaaagtttaaacttcacatttttacaaaaatatatattttaaaatactatttttcatcatattactttatactgaaaaactggtgcaatgaaaaggtagaatcctgtgtgacattttaaagacgatgatttctaactatctttgtgataactgacatgtagaaaattcaaggttggtgtgattaaagacttaggattctccaaagagctatatcagctgaccgccattttcacagtttaacagtggacataataacactgtttggaatttcatgagaaaggtaattgtaggttactcagttgagtttctttaatgtagaaaaatgtatttttagtgggaagaataatcaacattgaaaatactcagattattttgccaaagataataaggatatagctgatggaacttgtaccctaaggtctcctccaacaactaaccttcaccagagtatgtcagatgcctgcctcataagctaggttttagcacctgacaagaatcttaaaaagggctacctgtacaacctgtaggaagaaagagatacttggcatgaacagacatataaaggagtaactctgtatagactcagttatatttctctgagtcctctgacctgtgagaatgggaatagtgcagggtagagtaattcttcacttagataacaactagttgatcacaaatataaagcataccagtgacttttaccccttcctagaccaggaggtgatatcagttgtttgttttacactcttcacagttgagcccagacttcagggttaaaatcaacatagtgttttcaacaatcactagcaagtaaatggatgtgcaagcaatataaaaactattataactagttattgggtaactagataatttagataacaagttattgggtattctctcagtcatatattgtgctcagtgtttaacataatttacttcattttatttgcttaatcatcatatgaacttgatgatttgaactcatttcacagatgaagaaactgatccgcaaagaagataaataagctgctaaggtcaagtaaataaatatatgtcaagtaaatataatgactgaatcttgagctcctctgtcctatttttaatttggccacaaattcagatctctttttgtcatgtatttagtaacactagcacatactttttaaagaatacatttcaaagattaaacaacagatctcaaagggaaatataaaggcaaacttttcatattgttttcaatagggggtcctggacaatttttttaagtacaagttgaagttgatttgcctaagcagatttgaaatatacagatgtgaaaatttcatacttttccttgcacaccgagaataagcattcactaaaaagtaaaaaacagagaatcttggttttacccctgcatcctgggaaaatagttatcttttcttttcttttttttttttttttgtttttttttttttgctctgttttttgttttttgttttgagacggagtcccactctgttgcccaggctagagtgtagtggcgcgatctcggctcactgcaacctccacctcctgggttcaagtgattctcctgcctcagcctcctgagtagctgggactacaggcgtgcaccacgcccagctaatttttgtatttttagtagagacggggtttcaccatgttggccaggatggtcttgatctttccaccttgtgatccgcccacctcggacccccaaagtgctgggattacaggcgtgagccaccgcacccaacctttcttttctaaactttccaaattctcttagtgaaaagccttcagggtgattatattgcttttagcttctgtattcacttcagatgttccactttgcatagaatccctagaatttcctaaatctcagagtgtacaggctcactttgcttttctgaaaagagtaaggaatttccatgttgccatgtagctattggtcaaataatggaaatataaaagaagaatccatcacttttatgaaccaggtgtgctcatttttccatgcctcaacttaattagtacctatatcattttaaagtttagtcagatccatttaagtattctgccttattaagtcattcataaatattttccatattattgtataatttatctaataatgtctagtagtatatgtataaatatatgtttatatactattatatattatttatactgtacaatctacactaataaaagaggtatatataagataagtccttattgtttaatttttatttctttacaaactaacagggatggctttttttcttcatgtatttgtcatctagtttattttctcctatataaattatttgttcatttcttttacgtgctagctgcaatattttaatgctgcttcttctaaaaaaaaaaaaaatcatgcttttgtatttgccctaacagcttctattttaaaatagtgggtttaaaaatgcaatttaaaggaatcaaatttttgaggggcacctcgcttctccttttatcaatgttataataaattatttcaaaaccagctataagaaggaaacaattcaaaatgaaaaattaggaattaagttgagtaaaaacctgatgaaccataaggaaaattatacaattattctcaccaaactctttgttggttgggcttcacccagggcagctggttttcttcctttaaccttaaaaacaaagtcacatttataatattgaatatttcttcattgctcctccagttgtttgtaattgctaattttcatattgccttcagctcatctaatctatttgagactctactttaaatttcttattgttaagaaagtaaaatattaatatgatttagaaatggaatatcagggtaaaggaagaagcaagatagttcagtcttctgaatacccagaatccataattttgtaggtctgcctagtactgtgttaactactgtgaggtatgaaaaattaacatagtagggtatagtagcagagataaaacttgaattttaatcaatataaaaataaagttaacaagaaattgttaaatcctggccatacattttattaagcttcacttatcagaaacaaaatgaaataaaacaatagtaaaaagcttgtagcgtgcctggctcatgaagaaaattcagtgtagctgactgctttaacatcttgccttgttatttcaagaaaaaggtgacttgtatcaagttaatcaatgtaatataatttaatttcaaagatttaaattatttgcatattttctttctctacagttaattttggaacatgatgatccatataaagctcaatacataagagaaagaatcacaaatatataacatacctaagacctttacctcttagtagaccaagaggtgatatcagttttccgttttacactcttttcagttgaaccaagagtggaggcttataatcaacacagtattttcaacagtcacaactaattaattggatgtgcaagcaacataaaacctatctgcattagacagtactttgaaaccgctgttaagtaggaatgaagaaatggtagactagagtaggaagtcttcatgaatcttgagccgagccttgaaggcatagaacaaaatagatccaatttatagaaaaaaaaagtagaaatgctctctaggggacaaacgtaaggacgcaagtttggaaataagtttggcaaatccagcacactaagaggagacttgcttccatcaagtacataaagcaatgataaatgaggctatccaagttatataatagataatctacatttttatcactgtcaataggattcaaagataatcttaccattttaccttctatgggaaactactagtgctcaaacaaaacaaaattcttttttaagtcataaaaatgttatttaagaaaatatttaaaaccataaaataaacttttggttttgtgtggcagctggtaaaatccaaaaagaggtaaataatacaaataaaataaagcactgtattaaatattgaaaactttttagtactaagcactttacatgtgttatgccatttaatcctttcaaatcccacaatgtagatatgtttttctgcattttgtagataaggaaactgctgtctagtctctagatgatgtcttccatatttggttttgttgttttagttcataaccactagtagaaaagtaggaaaatattagccctatttgtatcaaaattatttaaagaagggaaaattgttggacatgtttatgtctagtttaagcctataaagatatttgttaaatacatttgatttcctgttttattgactaggagttcttgtaaatgtgtacatatatggattaaagctattaataagttttagatatagaaatttaccattccccacccaatatatcaccctagtatccttggaagttattatggcaatgaagaatttatttatttattttttactcccctttcacaaacaattcactctagccaagagataaataggtatttccaaactgagcctttcctcttctaggattgagtaaacatacttcaactttagatgataataaacacttaggattctatgataatggatgtgatcatcagagaatagtggtatcttggcacaggagtatttaatatttttattcaaagtaaatagtccttagcttacctggccagtgcagttcaacagtattgttgtgccttctgaaacttttaataagtggagatcaaaatcaccagtgctattcattttaagaaattgcctcaacttgcgagcagcacggaataaaaacataccttcctattataggaaaaagtcagaagggccatggttcaaataaaatattaagaaattataagctttcttaaggagcctagagcttgagctatgttgctaggtaatgccccgcctccaccccagctttctattccagttaatcatgtgattgacaagtaacagaactaaaactgtttggctcctaggtgacagcatgaagttcttagaacttggtttaataattatcttgacttttaaagtttgttttctctattatgcttatgtgatcttatcgcttatgtgtgaacatattagaagattattcaattttaaacatgataaccgaaggagaagacttctggaagcaacaatgtattataagaggtatgtgtggttttttcttagtatttcttgcatcttttgagctatggaagaatagctgataataagaaaataaaggactgtagtcacctaaaacataagttttgcagatatttaaattaagaaatttaaaaaaaagaatttatggttgtgagatgccatgaggctaacttagctactgtgagtttttaaaagactatgaaatagcacacttgtttctgtagggagaaatgatataaactttttaggttttttaaagtgtaatattataccaactagatgtggtaatcatttagagataagcaaatattgaaagaaaaattttcaagacgcttccaactaaattataccaatgacttatatttgtatgtgtgcaagcattcacattaacaagtatttttctgtataagaaatttagaggccaggcaccgtggctcacgcctgtaatcccagcactttgggaggcggaggcaggcggatcatgaggtcaggagatcgagatcatcctggccagcatggtgaaaccccgtctccactaaaaatacaaaaattagttgggtgtggtggtgcatgcctgtagacccagttactcgggagactgaggcaggagaatcgcttgaaaccaggaggcggagtttgcagtgagctgagattgcgccactacactccagcctggtgacagagcgaaactctgcctccaaaaaaaaaaacaaagaaagaaagaaagaaagaaaataagagataggtgtgtctttgaattcgacaattctagtattttcaaggtaaaaaatagaatggtgaaacaaaaaaaacttgttatttaataagcacaggactatttgtaaaacaaaaatataaaattgggccatagtatgatttaatcaatgggaattatgtgatcaggctgcaaatattaatagtattcatataattgtctaacagaggcacaaaaaatagaagcttctataaaatcaagcttgaatgacaaactccaaataattatcattaccttattagcatcacagatatgtcttttaaaaaagttaaattcattattcaggcaattgctaccaatttctttcatgctgtcctgtaataaataacataaaataatatggttaaaactgagtacttttctaatatcttgtaattataaaaaataataatcttataatatctgatatttatatgtgcattttaaggaaaataagttttgcctggctcagctgactaagcatgaggaatcattttctatagttgaaggataaataagtgtatacacaaatcctcccatatttagagcccctcccagatcccataattgaatcccagaattctctaagagaatctggctcatctagggaaatagaagtacctattttagaagttatgctttatagacaaagtattataaaatgtgaagtcattaagttgagatgaacttaagaggttattcagtcaaatttcctgccatcaacaaataacaagaaaaggaatttatattagaatgaagggatccatacaaagctcaacacataagagaaagaatcacaaatgtataacatacctaaaccctttaccccttcatatcagttgtctgttttacactcttttcagttgagctgagactacaggcttataatcaacatagtattttcaacagtcacaactaattaattggatgtgcaaggaatataaaaccatctgcattagtactttgaaattgacagtgagaattaaggttgaaatttgttcacaacatttttagcaatccaattttctgggatggttgaggtagaattttcctgagacagtgtaattatatgtgtgtattataaacataggagtgagaaagcagactgatatgtgcgctattttttttttcatttacaaggaatgtagtagaagaaggtagagattatctaaatcaataatttagttgatattaggaaaaacctcctaaggtttcagattttcttatgcaccgggttggactagctctgtccagcaaactagcaactccatgctatcagagcttctgggactgaaagcaatcttagcctatgtaatgtctccagagaaacaggataagaagtggagcaatggcaggatttagtcatgggctttgaatcctcatctgcctctcagaaaagtattcattactcttatcacctgtgaaaagcatgatgatgtctgggtttaccctgattttaaaatgtatatactatcagctttatctgcaagaagtgtctgaatacatacatctcaagtgtaaaagatacattttcaataactatcttcacattgccattgtacatattcctgaaaatttagtggataattaatatttgcctattaagtcattttcatgttgacttccccataccccaaggacaataactcatacataattttttctttgataaaacatagagtatttaatttttaccatgtcatccttcaaaaaagaaggtgaaacgtgtagctactctatatgttatcttccaattcaccaaaaatatcgtatgagacaatatgtcacataatgaatgccaatttcttgcaacatgttagcaaattgcatgacacatgaatatttaaaaagccatattggttaggtggctgttctaggttattaataaaacttatttttggcagatccacagaaagataatgttataccagttgattattttttacctaatgcttgatatggaatgtaaatgtgttactatacccttaaaaggttgactcctatagaggtcacagttattaattcatcgaccttagtacattttattaatgcatctaatatagatctatatgattgccaattactgttgctttctaaaattcttttcattcatgccctatcagaagaatggctcagagtaagaattatagatacatggtgttgaaaagaaacttagatggccatcttttgatttaacaaagaatagaattacttgaccaaagtcccaataattgtttcttattcacatgtcacatatgtccagatgcaaataagaaacaaatcacagctaggcatggtgccttatgcctgtaatcccagccctttgggaggccaaagtgggtagatcgtgaggtcagtagttcgagaccagcctggccaacatggtgaaaccccatctctactaaaaatacaaaaaaaaaaaaaaaaattagccgggtgtggtggcacatgcctgtaatctcagctgcttgggaggctgaggcaggagaatcgcttgaacctgggaggcggagcttgcagtgagctgagatcacgccactgcactccagcctgggcaacagagcaagactctgtctcagaaaaaaataaaaaataaaaagaaacaaatcatatatcacatatgtcaagatgtacataagaaacaaatttcttcaaatattttataaatatggaaaatcagaagagaaaagccaggattataagactgaactgcagtattttctagtataaaacatgacattggctaagttcttttttttaggtgaagttattttttaatacttttgtcttttaactcttatagtagaggaaaagtaacttataaactataattacagtatacacttaattacatacaaattcattacagccctctgaatttgactatattttatctttatggtgaattttatgctttatctttacagtgagttatatgctttcatatcttttcatgtttttagtgtctttttctttctctattttttaaacatttattttaagtccaggggtacaagtgcaggtttgttacataggtaaacttgtgtcatgggttttttttgtatagattatttcatcacccaggtattaagcctagtatccattaattgttttttgatcctctccctcttcctaccctccatcctccaaaaagccccagtgtgtattgttcccctgtatgtgtccatgtgttctgatcatttagctgccacttataagtgagaacatgtggtatttggttttctgttcctgcattagtttgctaaggataatggcctccagctccatccatgtccctgcaaaggacatgatctcattgatctcattcttttttgtggctgcatagtgttccatggtgtatacgtaccacattttctttatccagtccattattgatggccatttagtttgattccatgtctttgccattgtgaatagtgctgcaatgaacatacatgtgcatgtgtctttataacagaatgatttatattcccttggttatatgcccagtaatgggactgctgggttgaatagtatatctgtctttaggtctttgagaaattgccataccatcttccacaatggctgaactgatttacattcccaccaacagtgtataagcattcctttttcttcacaaccttgccagcatgttattttttgactttttaattatagccattctgactggtgtgatatggtattccatatttctcggaggttttgttcattccttttcattcttttttctctacatttgtctgcctgccatatttcattaagctctgaaattctttcctctgtttggtctattctactattaatacttgtgattgcattacgaaattcttgtagtgtgtttttcagccctatcaggaggattaagtacttctctatactggctattttgaacccttgctggagaggtaatgaggtcagctggaggaaagagggcactcaggctttttgaggtttcagcattcttgctctgattctttctcatttctgtgagcttatctaatctaccttcaatgttcgacgttgcctacctttttttttccccctggcacaatttggccaattttccatagggctgctgtggtttgctgggggtctactccagtccctagttgccttggattttccggtagctgaaggtatcaccagtgaaggctgcaaaacagcaaagatggcagcctgccacttcttctaagagctctggcccagggaggtatgaacctgttgccaggtggaacgcacctgcaggaggtggctggagatcctggttgggaggtcttgcccagtcaggaggaagaggattggggacccacttatagaagcagtctggccatgcttttgtagagcagctgcgcagtgctggggtaacgcttcaccgcctgttggcttgggctctccaaagcccacaggctggacaggttcagtacccaaatagcagagatgtcagcccacccctccctctgagacctctgtcccagggagttttcaaatctctgtaggccagagaacaccagcggggatggctggaggccctggttgggaggtcctgcccaataaggagggatggctcagggacctgcttaaagaagcagtctggccacgtgttggtagagcaattgtgctgtgttgggggatcccttctgcccgatcggtttggactcttcaaagtctgcaggctgaaaaaggtgacttgcccaaacagtgaagatggtggccttcccctctccctgggaactctgtcccaggtaggcacaacactgctgctggtggctggctggaattccaagccaatgtgtcttatcctttgaggcaccatggaagtagggcctacagaccatcgctgcttggcccactggattcagcctctttcctaagggtatgcacaaggatctaatctcctgcttttctggagttgcagttacttttgccgggaagcctgaaggtggaatatctacagttcctggttctccaacatgtgcctgagcagcttctctgccaagactcccgtatctctgtgtattagactgaaagccctgatggagtgggttcaagaggggatctcccaactcgaggttgcaaagattcgtgggaagagtgtggtttccagggtcacacattcactcaccgattctctgggcaggggaggttcacctggctgggtgtcgtgcccaggtgggctgtcgtcctgcctttgttttctatgttctccatgggtcaagttgtttccttgattagtcccagtgcgagtacttggatgtttcagtggaaggtgctgtatttactcgcccttttgtccctctttgtgagagccactcacacgagctgcttctagttggccatcttggccacttccccactccttttctttcaagttcttaaaatacataatgttctttacatttgtagaattatatcttctttaatttcagcatagttttcttctatctttgaatttttaaattacattttaagtatcttctttagaaacactaattacataaaaaatgaatcttctattgaactttttcttttcgtgtatgtgtgtacacacgtatatatacacaaacacacaatttcgttttgtgtggtttttacccatcctgtctttcatatgcctgttttaatggagtattcatttctggtttttattttagtctctgtatttctccaaaatccaaagaacatttgtttctttctggtttctttcatactatattgtttttagctctttttacattggtttcttagagacttcacattttccattgctttcatggataattaaactttggtctagatacttcattttccttttgcctattttgtgttaattcatttgttcatttattttgctagtaccagtgcataattttccttttaaattttgtgattatttttgaaaagatgctaaagtagagtagattattgttcagccagtatttaacatctaaactcaacaaatgagaggatgttttcattccatatggctgatgtaacaaattaccaaaaatttggaggctcaaaacaataaaaacttattatctcacatttctagaggctctgggagagcatgcattgtttgcctcttctatcttctggtgtctgccagcattccttagtgttccttggcttgtggcctagtggctccagtctctgcctccatcttcacatcaccttctttgtgtgggtgtcaagtcttctcctgcttttctcttagaaggaacttgtgatagcatttagggcccaccaagataatccaaaataaacttatcacaccaacattcttaattcaatcacatctgtagattcctttaccttatacattttcagattagaatttttttatctgggtggccattatttagcctactatagagaagtatgctcctctgtccattaatgttgagtttgtccaaaagacatgtggtaagaaattgatgctttcagtacagtttctgtggatcaagaatttggaagctgcctaaccgggagcttctagttcatctttcatgaggaggcagtcaagatgttggtcatgtctgtagtcatctggactccatcaggattagaggatctattcccaagatgacctattcatgcaggtattggcagaatgcctcaatttctcaccacatgagtttctccacaggctttcttcaatatccttccaagatagttgctgactttcccccaagtatcaatgtaagagaaagcaaggaggaagccatgtcttttattacatggaagtcacacactgccatttcctcattattcagttgcttgcagtgagtcactaattctaatccacactcaagaggagggaatttaagctgtacctcttgtaaggtggagtatctttgtgcatatgttaaaactcccatacagctgctccttccatcttatgacttagaatgaaacacatggaggtaatcgaactcagccaaactgcatacctgtgaacctaaggtaaatgcatattactgtatgcctttctctctttctgtgtgtgtatgtgtttgtagcaaaaactgactgatagagaactattgctttttagatcaactaattgtccaaaaataaaggtggaaaagggcaaaggtaatgaaatgaaacagctgttcattcttacccaatttctgtattctttgtgataggacagttttcttctgaatttttttcatatttttcttttcaggagagaaagtcaatatggttcacagttactcttcatggtcacatgtgctagagctagcaaacgaatgtctaattattgctcatagctgattgctgcttcctttctgttcttttttctttctttttgtagggctgattctaaggattggaaagttttggcatagaatatattcagtctcatgtctcttgctataaataaagttggtccctatagaaatatacttcattgctttttttttttttttttttttgagatggggtctgttgcccaggctggagtgcagtggcatggtctcggctcactgcaacctctgcctcctgggttcaagcaattctcctgcctcagcttcctaagtaactggattccaggcatgcaccaccaaagccagctaatgtttatatttttagtagacactgggtttcaccatgttggccaggctgtcctcaaactccttacctcaagtaaagtagaaatatttttcatttctgatcatcactatgacaacctatccatggccttgtgccatctgaagccttatttagggggccttttaaaatgcgctgcttattttttagaaaatctactctgtatgaaatttgaaaaaggtgtatattgttcctggaattctatctcaattgctacaatttttaccatttgtcaggtagcttagcagattatagtatgacttattagttaattcttagtttaaattaaagtcatttattctttgatcaaatatttgagcatttaccatgtgccatttagtattaggaatacaacagggatcaaaatcatacgtggctccttccctcaagaagtttattatttggtggcaaaaacattaatccaataacagcaatcaattcccaacttgagaactgttatgaatacaagatatatgctgccatgaagcctatacaagaagattttacttaaaaacctcaatgaatacttcccggagaaggatacttcacaagagatctcaatcataagtaccttagggaaaagggggattcagtagcaaatagtataggtgactactttgaagagagagggatcatggcctgtatgtggctagaaagaagagagcaagggaaagtaggaatatggctgagagaggaagagacagaactggtttgacataaagccagagctggaagagaccaaattatgtgtggccttaaggatattttaagaagttttgtatcaatcctaaaagcaataattaatgtatttgtacttacaaacatgggaacagtttttctagtttacttttttcaatggtcatattaacagccatatgccagatggtttggagagattcaagaaagtatatgggtgaatctttatgaggctattacatagtcagtgcttaacataattatttattgcacttgatagtaagagagaatctagaaatacatgaatagatttgagaaataagcaaatttaatgtgatttgaaaataaaaattaagcaagatggacatatcaaggatcattcttgagttgtctggtgagtacaacaaaagagtcagatgctccttaacttacaatgggtttacattccaataagcccattgtaaattcaaaaattataagcctaactatggtaagctggttaccatcagtattgtgttgccattgagataggaaatagaagaagaggtggagtgtataaattatgtgttaggttttaaacagatgacgtttgagctgactttcaaagattcaggaacagatgtcaaatagacaaatagtaaagccagagagttagaaggaaagccaagagaatggattgttttgaggaagtggtggtccatagtaaatgccaattaaaaggtcaagtaaattgagtcttgttcaaaatttatctacataaagaaaacagctaaaatagaaaagaaagctaataatggaatggtaaaatagatgatggaaaataaaataaaatattaagcagatatatttgttttcaggtaatgttcataaacaagtggtaaatctataataaaacattaagagaaaaaggtactatgtagaagcctatatttaaatgtgaatgcatatgtagacacttgaacacacttatctaccagaagtttaactgtcatttaactgactttctggatgatcaatagtttctattccttctgtcaaaacatattcactaatgcccagagaacaatgaagactccaaactagtagtttagtttcttatgtactcgtgtatattttctcccaccatttcagttgcttattgactaagtcaattccttaacactaagttatacttagcatttaattataatacttaatactatataaatcaataaaatattagtataaaatagttgttttgagaacttctacttttccatttggcatataagaagcttagaagttgccaatccatacttaaaagtaaaaagctaaacccattaaaaaaaaatcaacaactcttcttagatcagagaagtgaggtcacagggcaaaccactgccctaaagttggagagaaagagaggatccccaaattagagaaacagatagaaccacaacttactgaagcagagatccatgagcagaaacctccatagcaaccattgtgggggtagaaaaaattaaactgtaattggcaaattgctgaaggctcagtgtgaaacaacttagagaattaaaaactccaagggtacccagtcatagttgtgggggctatatacttttatgagtttgatctttaggagctctaactactaggtcctcacagtaagtatcagatgagaaagtcctcttgtgcttctggtaggaggaggggaaaaaactattataaaataagccagaggtgggaggatcacttgagcccagaagtttgagaccagcctggacaacatagtgagatcctatctttacaaacaattacaaaaaaattagccatgcatggtggcacatgctggtggtcccagctactcaggttgaaataggagcatcacttgaacccaggaggtcaaggctgcagtgagccatgatttatatcactgcactccagcctgggtgacagtaagaccctgtctcaaaaaaaaaatactaatttctaaaaagctgaatagtctgttctcctttaaagggcctaaactcaagggtgactattttaccagagcctaaccttctgaggttttatcagagtctgatctgcctggggaaaaaaatacccagctcaagggtcctctagtttttcacatgttggaaggctgccctgtaccacctaaggaggggaaaaaaaagagcagcactgaaagttcacagtccaggtcacaggctcgccaaaagactaagacctaatcacaggcttatagaacacatcccctttttccacaccgtattgtgacatcactaaaggcctgtttatcacagtttcttttactcagaacattataatcagctatgaaaaaaaaaattacaaggcatactagaaggcaaaacacacagtttgaagagccagagcaagcataaggactagacttacctatggccatgaggttggaattatcagaacagaaatctttttaaaagtctatgattgaggccaggcgtggtggctcacgcctgtaatcccagcactttgagaggccaaggcaggcagatcacgaggtcaggagatcgagaccatcctggctaacacggtgaaaccccgtctctactaaaaataccaaaaaattagctggacatggtggcgggcacctgtagtcccagctactcaggaggctgaggcaggagaatggcgtgaacctgagaggtggaggtttctgtgagccgagatcgtgccactgcactccagcctgggcaacagagcgagactccgtctcaaaaaaagaaaataaataaagtctatgattaatatgctcagagctgtcagagctgtaatgaaaaaattagacaacagacaagaacagataggaaatttaagcagagagattaaaattctaggaaataattttaaaatgataaagatcaaaaacagaaagaaaatatgcctttgatgggctcattagtagacttcacatagctgaggaaagaatcttggagtctaatgataggacaacagaaacttccaaaactgagaagcaaaaattcaaaaaaaaaaaaactgataaaaaagaacagaatatctaagaactgtgggacaactacaaaaggagtagcatacatgtaatgggaatataaaaaaggagaagagacagaaaaagaaaaatcaagggatgaagaaaatatctagaaaagaatgcaaagtggagaaaagaaacaacttacttatagaagagcaaagataagaattacatccaaattcaccacagaaatcatgcaagcaaaaagagagaggaatgaaatattcaaaatgttaagagtaaaaaaccagtgtttaaattatgtactctgtgaatttagccttcaaaagtgaaggaggaataaagcctttctcagacaaacaaaaattgagagaatttgttacaagtaaacctgccttgcaagaaatcttagcagaagctattcaggaagaaggaaaattacataagttagaaacatggatctaaataaaggaaggaacaacatcagagaataagtgaaggtaaaataaatactttcccttatttttactttttttccttttatttttagttgacacaatagtcgtacatatttatggatgacacagtgatatatttccatatgtgatatacaatgtgtaatgatcaaatcagggtaattagcatatccatcccctctaacattcatcatttctttctgttatgaacaatccaaatcctctattctagctttctgagcatatacaataaattatggtaaactatgttcaccctgcagtgctgcagaatgccagggctaattcctcctatctagttataattttgcatctgttaaccaacttctccctatcgtcccctccctcctacccttttgtgcctttaatacccacaattttattctctacttccatgaactcaattatgttttagctcccacatataaatgacagcatgtggtgtttatctttctgtgactgaccgatttggcttaatataaagtcctccaggctcatctgtgttgctgtgagtgacaggatttcatactttttttatacctgaaggttatttcattgagtgtatatatactacattttcttcatccatttgtttgttgatggacacctaagttaattccatgtcttagccattgtgaatactgctgcaataaacattaagttacaggtgtccctttaatagactgatttcctttcctttggataactgcttggtagtgagattgcaggagcacatgctagttccatttttaattttgtgaggaaacttcatactgttttcaataatggctgtactaattcacattcccaccaacaattccaatggtttccttttctccacatcctcatcaacacttatcttttgtctttttgataatagccattctgacaggtgtgatagctcattgtggtattgatttgcatttttttccagtgattagtgatcttgagcattttttctcatacttattggccatttgtatgttttagtttcataaatgtctattcacatcctttgctcacttttgttttattattatacttgaagttctgggatacagaacgtgcaggcttgtaacataggtatacatgtgccatggtggtttgttgcacccgtcaacccgtcatctacattaggtatctctcttaatgctatctctccccttgtcccccaccctgcgacaggccccaatgtgtgatgttcccctccctgtgccaatatgttctcattgttcaactcccacttaggagtgagaacgtgcggtctttggttttctgttcctgtgttagtttgctgagaatgatggtttcctgcttcatccatgtccctgcaaaggacatgaactcattattttttatggctgtatagtattccatggtgtatatgtgccacgttttctttatccagtctaacattgatgggcatttgggttggttccaagtctttgctattgtgaatagctgcaataaacatatatgtgaatgtgtctttatagtagaatgatttaaaatcctctgggtatatgggattggtgggtcaaatggtatttatagttctagatccttgaggaatcaccacactgtcttccacaatggttgaactaatttacactcctacaaacagtgcaaaaacgttcctatttctccacatcctctccagcatctgttgtttcctgactttttaatgatcgccattctaactggtgtgagatgatatctctttgtggttttgatttgcatttctctaatgaccagtgatgatgaactttttttgatatgtttgttggccgcataaatttgaaaagtgtctgttcatatcctttgcccactttttgatgggtttgtttatttttttcttataaatttgtttaagttccttgtagattctggatattaggtctttgtcaggtggataaattgcaaacattttctcccattctgtaggtaacctgttcactctgattatagtttcttttgctgtgcagaagctctttagtttaaatagataccatttgtcaatttgggcctttgttgccattgcttttggtgttttagtcatgaagtcttcccatgcctatgtcgtgaatggtattgcctaggttttcttctagggtttttatggttttaggtcgtatgtttaagtctttaatccatcttgagttaatttttgttctaaggcataaggaaggggtccagtttcagttttctgcatatggctagccagttttcccagcgccatttattaaatagggaaacctttccccatttcctgtttttgtcaggtttgtcaaagatggctgtagatgtgtgatgctatttctgaggcctcggttctgttcaattggtctatatatttgttttggttccattaccatgctgttcggttacatttcctttgaaaactggtacaaaacaaggatgccctctctcaccactcctattcaacatagtattggaagttctggccagggcaatcaggcaagagaaagaaataaaggatattcaaataggaagagaggatgtgaaattatctctgtttgcagatgatgtgattgtatatttagaaaacctcatcgtctcagccccaaaactccttaagctgataagcaacttcagcaaagtctcaggatacaaaatcaatgtgcaaaaatcacaagcatccctataaaccaataatagagagccaaatcatgagaaaactccaattcacaattgctacaaagagaataaaataactaggaatacaacttacaagggatgtgaaggacctcttgaaggagaactacaaaccactgctcaaggaaataagagaggacacaagcaaatggaaaaacattccatgctcatggaaagaagaatcaatgtcgtgaaaatggccatactgcccaaagcaatttatagattcaatgctattcccaacaagctatcactgaaattcttcacagagttagaaaaagctactttaaatttcacatagaaccaaaaaagagcccgtatagccaagacaatcctaagcaaaaagaacaaagctggaggcgtcacgctacctgacttcaaactatgctacaaggctttgctcactttttaatcaggtttttgttgttgttttgttttgctgttgagctgtatgaattccttatatattctgaaaattaatcccttgttggatgaataatttgcacatattttgtctcattctataggttgtctctccactctgttaattatttccattgctgtgtagaagtttttagtttaatacagtcacatttgtttctttttgtttttgctacttgtgcttttgaaatctcagccacaatatctttccctaaaaatgttctgaagcatttctcctatattctcttctagtggttttatatttctgggtttcatgtttaagtcttttatccatttcaagttgattcttatatatggtgagagataggggtctagtttccttcttctgcctgtgaacatccagttttcctagcactatttattaaagagaccatcattttcccatgtatgttctttcatatttgccaaaaataagttggctgtaaatacattgatttatttctggcttctctattccattcccttggtctatgtgtctgtttttataccagtgctatgttgttttggttatagctttgtagtatattttgaaattatatagtatgagacctccagctttgttctttttgagcagtattgcttttgctattcaagtcctttgtatttccatacaaattttaggactgttttttctctttctgtgaaaaatgtcattggtattatgatagggattgcattaaagttgtagattgctttgtgtagtatggtcattttaacaatattaatttttccaatccataggcatattatatctttacagttgtttgtattctcttcagtctttcattagtgttttgtagttttcattgtagaggtcttcacctccttggttaaatttatttctaggtttttatttttattttattttcctggcaaaaattgtaaatcagattgctttcttgatttctccttcagctagttcattatgatataaaaaaatgctactgattctcgtatgttaattttgtatctggcaactttactgaattcatttatcagttctaagagtttcctggtggagtatttagatttttctatgtataatcatgtcatctgcaaagagggacaattgacttcttcttttctaacttggacatcttttatttctttctcttgcctaattgctctggctagggcttccagtgagatgttgaataggagtggtaaaagtgggcatccttgtcttattcagttattataagaaagactttcagtttttcctcattctgtaagatgatagctgtgggttaataatatatggcctttattgagttgcaatactttgtttctatgccaatttgttaagagttttcatcataaagagttcttgaattatatcaaatgctttttttctgtgctagttgagataatcatatggtttttgttcttcactcttttgaagtgatgtatcacatttattgatttgtgtatgttgaaccttctttgcatccttgggataaatcccactttattatgttctattattttttagatgtgttgttagattcagtttgttagtattttgttgagaaactttgcatattggcttgtagttttctttttggttgtctctttatctggtattgctatcagggtaatgctggctttgtagaatgaattaagaagaattctctccttttcgtttttttctttaagaatagcttgagaagaattggcatttgtcttgctttaaaagtttggtagaactcagaaataaagccatctggtcctgggcttttcttttttgggagaattttattattgattcagtcttgttactcgttattggtctgttcatgtttcctatttatttctggttctgtcttgacagggtagatgtatttaggaattgattcatttccgctaggttttccaatttgttagtgtatagttgctcaaaataatctctgatagtcctttatatttctgtggtatcagttgtaatgtgtgctttatttgtttctgatttacttatttgggtcttctctctttattagttagtccagctagtggtttattttttatcttttcatctccttggttaaattttttctaggattttatttttattttattttccaagtggtttatgtttatcttttcaagaaataaaattttgttttgttaatagttttattatttagtttagtttagcttttagtttctatttcctttttttctgctctttatttttgccttctttgtattaattttgggcttggatccctcttgcttttctagttccttgtggtgcactgttaggatgtttatttgaaatctttccacttttttgatgtagatggctattgctataacattccctcttagcactacttttactatattccataggtttgggtatgttgtgtttacattttcatttgtttcagattttttttcattttgatcttcattttttcattaatctaatgatcactttgaagcctattgctttatttcaatgtatttgtacagtttccaaaatttctcttattattgatctatagttttattccattgtactctgggaaggtactcaacatgattttgatttttaaaaattttttgagacttgttttgtggactagcatatggtttatcctgaagaacgttccatgtgctggtgaaaagaatgtgtattctgtagctgttggataaaatattacgtaaatacctgctaggtccacttggtctatagcacagattaagtccaatatttctttgttgattttctctctagatgatctccccagtgctgaaagtggggtgctgaaatttccaactcttactgtattggagtctatctctctctttagctctaataatatttgctttatatatcttagtgctccagtgttgagtccatatatatttacaattgttatatcctgttaatgaattgatcccttcatcattacatactagacctctttatctcttgttatgttctttgactttaagtctactttgtccgatataagtatagctactcctgcaaagttttggctttcatatgcatgggatatggtttccgtcacttcactttcagtctatttgtgtctgatatggtttggctgtgtcctcacccaaatctcatcttgaattgtagctcccataattcccatgtgttgtgggagggacccagtaggaggtaattgactcatgattgtgggtctttcccatgctgttcttgtgatagtgaataagtctcatgagatctcatggttttataaatgagaatttccttatacaagttctattgccagccctcatgtaagatatccctttgttcttcccttgttttacaccatgactgtgagaccttcccagacatgtggaactgtgagtccatttaacctctttcctttataagttacccagtctcaggtatgtctttattagcagcatgaggacagactaatatagtgtctttacccatgatgtgaatttcttgttggcagcatataattgggtcttttgtgttttcttttctacccattcagccagtctatactttataattgtagaatttaaaccatttacattcaatgttgttaataataggtgagaacttactactgtcattttgatagctgttttctgaatgttctgtatatcctttgtttctctttcctcttttaatatttatctttacagtttggtcattttctgtagtgacaagctttgatttctttcttgctttcattagtgtatctgctctacccgtgagtttaattctttcttgtgctttctaaatagtagacatcatccttttacttatagatgttgtactccctgaagcatttattgtatggttgatctagtagtgatgaatttccttcagtttttacttgtctgaaaaagatgttatttctccatcctttttaaaggatagctttcctgggcatagtattcttcattggcatttttctctcagcactttgaatatagtttctcatgctctcctggcctgcaagatttttactgagtaataggctgctagtctgatgggatttcccccaacatgtgacttgatgtttttctcttgctatttttaaaattctccctctgtcttcaacctttcacagtgtaactttaatgtgccttggagaacacttatatttttattgaatctactagtagatattttagctttctatatctagatgtctatatccttcacaagaaggaagaatttttcagatattatttcaataaataggttgtctatggcatttccattttcttattcttatggaacttataaaattcaaatatttgtttgctttatggtgtcctatatgtcattaggctttcttcattctcttttattcttttattcccccccccacctttttttttaatctggctttgttattttaaaagaccaagttcaaaaattcttctgcttgatttagtctattgttgaactcttgattgtatatatatattttaatttcatccactgaattatttatttccaggatttctgctgggttcttttttttttttagctttaaacaaaactcacattttatttagattgaaataaactatacaaaattgattttcttcaccaaaaataacagcaatattttccatatttttctagataaaccacaacacttattttgtaggttttccaggttttgcttataaatcaagatgaggcagtagataagagtcatggaaaaaagacagaaaaaaaaaaccagacaaatcagttgtcagtatccatggcctctgattctgtctcaaccatgaaacagaagtgttcaacatatacctgctaaaaagcttaggaagatgtaggctccacaaaggaatgtaaacagcaatgagatgtggaacaacagcaggcttttccattcaaactttgtcatttgtttctttaagtttgagaaagacaaaatctacactgaaatccttgtttggtgagctcacaagcttttctctggtaatttcttgcaactgtccagtatagatttttaacatacttaaaactcctattagtcaaaggtcaattgtgggcttaactataacattttataaaatgtattccttcctcccacacctcttcaaaatatattttttcaaagaattcataacacccaacaagtagagatccacagtgataataaatgctatgtctaaaatgacttaactgaaacaattccagagtgccgtcaacagagatcacgcaaaaggaaacatggaactttcaacgttctcttctggaagaacaggtaggtcttcaaagcttgagagttcaaacaggggccatttaaacaggtagattatcaatggctaatgtattcaatggagtcctataggcaaagatatttagtgattaagtggcctacatacaccttacggcttttacttccaaatatcaaatataagaaagcctgtttttaaaagtctcttaggtattttccacagtttcggaattatctgtaggaagctctgacttacttgtatagagtttaatatatgtgtccaccattaaatccaggtcgtgttttatatcaaaatttatgttaagcaaagccaagttacttgacctttggtctgtcaaagtgttcctcaaatatgctttaagacgctttcatccattttcataccgctcattctcaaccttcatcacagaagaatacacaggaccttcagcaatgcatacacattaggaaaaaacttgatgtcaggcagttggagggcttcatagatggtggacggaagctctatatctttccccctgtgtttccatttgattccccaacaatgaagctcagctgacagcgtgtcaggattgggtaagtcacttctatacatgtcagcatggtgttcctccaaagtattgaatttgagttgtcccatgactgagggtaccagagataagcatttaagagctttgaggtgctgttctgagaatatatctttaagttcctgaataatgtgctccactgttgggacacttagggtttctttatagtaactctcaaaggttagctgagattccaagttaccctggtgagctctgcggaatttcccagggagtttcatttgaatatcaagtttggttgccaaatttgtggcttcctcaaaccaaaattcattataaacttcaatattttccatcacttcgttgagtgaatgcagtactgcagtcaagctaccggctgcaaagaagacatcagaggtttgcccctggaggtttttcccaaaggctcttgtaaaagataggacatttttaagaacaacaatagtaacaatgaaatcaaaatctgttactgcactgcagagtacaaatgctcggccagctatacagttattccatctaatatttgtgtcactatttataccatctaaacataaaacaagtgcttgcaggagttccactaaaatttcaaaagcatcatgcctccctgtccactgagaatggcagatttccttcagttctttacccctttctttactgttctgaaaaagaacagaaattacgttgtcaagttctaaaagcagttgtggtgatcgatggaaaaaagaacaaacttcctcgattgttcctaatgcaacagatactcccataacaggtactgattttgccaaccacatatttaaggcacagaaagagcagagtgtgtagatagcttggggatatttctctaaaagtctagaagcaacaactttcattttggaagaaaatccactagagacaatgtaagcctggccacgacaatactccatatttaatccccacttctcagttatcatagtgtgaaatttcacagccaaaatttctgcatcagcttcataaggcaggaagcctataaattcctctcttaggttatgagattcatcaacaaacctcaccaacacaggtaggtgctcttcccctgctatgtccactacatcgtcagtgataatggaaaagacgtgtgagtctctcacttccctgagagtttcttctcgaatacagctctcacagatctctagcatctgcctctgctgtgtttttgaacaaaacaacgtgttaactgctgttgtctcaaaccgctttctcagaacctcttcaccagaatttatccgacactccagtagtgcctgaaagttatctggagtaaagagaccttctgggatttcatcagcctcatgtccgtccagaggtatgttttgccttcccatcagaatcaagatttcaagtagatatttgaggtattctttgttttccttctcttcaagggttagaggtaaaatgtcctcatcttgcccttcaccctcttcttcgctggggttctgagcattgctattgttggtttctttatgtttttgttcctgctcagaagtttcatcaatttttttctgtttcagtgtcctgatttcatcttcactcagttcttttattcgttttctgtgtctactatgtgggttgttcaaatgactgttaagatcaaatattgttggtattgcattatctcgaagaactgtcctataaggaccagttctacagatcatagaggtctcaaaatgtttggcacataatcgataatgtttatttagctgatcaggtgttttatcttctaagtctgctctcctacagttctccacccacttctggcatctggcagggtcccgcgggaagctgaagaaggccaagtcaagtcggactgcgtgctcttccgcgtgcagttggcggcagcgcagaagttcggcatcgtcgcccgcccgccggccggtccagccctcccctccccgcctcctcagggcagtccgcccgcccgtcggggccggggaggggagccaggccggccggccggctcggcagggccgacgcgcgggggaggggcgggcgggctagaagccgccgggttcttttttatatctgtctctctttcttgaaattctcattgaagacatgaattgccttcccaatgcatttttttttttctattgtgtcctcttgtatttgtatctgtgtcctcttgtatctcgctgcattttcttaagaacattattttgaattctttttcaggctttttaacatatttacatttctttgggatattttactgaagaagtattgtattccttcagaggtgtcatttttttcttgaattttcatatttctcatgtccttaccttatctgtgcatctattttaacagtttctcttttaatttcatggattggcttctttcatagagaaagacttttcctgtagctgtaattatagtattgtttggggaagatgttttggctttaattctgggctagcacagtagtgtcgtctctgtatgttctatttggatgcgatcaatgtcagcattgtctgagagttcttcattggcttaggctctggttgttagtgaaaattatggtgaggtgcacctgtcctcatgccaccagatgctgcacacaagcactgtcagtggtgagtagaattggccaatatgcagccccctggacagcatttgttggtgccagtgatggcacatggggtggttaatcttcacgcccccagcctgtttttcttattcttaattgatataaaagttaataccttcaaataatgatagcaaccatgtattcaattatgcttatatgtttatttataagtgaaatgaatgatagcagtgataaaaggttaggagggagaaattagtaatattttattaccataaattacttgtacctcctataaagtggtataatgttatttggaagtagatttagattggtattaagtgaaaattgttcatataaaaatgatacagagacatcactttagatccaatagacattaaacagataataaacaaatattatgagcaactctaaatccacaaatttgataacctatatgaaatgcatcaattactcaaaaggcacaatctaccaaaactcacacaaaaagaaatagaaactctgaataggactatatctattcaagaaaataaataaaaaatgatgttacaaaacaaaaaatactaatcccagatgagtttattgctgaattctatcaaatagttaaggacaatattgtatcaatgctccacactatctgacagtgtgtgtaagcaggagcaggaggaatacttctcaactcattctataaggccagcattaccctaatatcaaaaatcaaagacactgcaagaaaataaaactatagacaagtacctctcatgaacatagattcaaaaatcctccacataaaactgtatacttttatacattattggattcaatttgctattggggatagcacttatcatctacaccacaattgagtggatttaatttcaggtatgcaaaggtgttttaacattggaatattgtttaatctaatccatcacatcaataggccaatgaagaaaaatcacacaatcatatcaatagatgcagaaaaagcatttgacaacattcaacacccattcatgataaaaaattttaacacattaggaatagagagggacttcctcaacttaaaggacatctacaaaagtcctatagctaatatcatacttaataataagaaatttgtaggtttcctgataataaaaaaaaagctatctcccttcacttcagctttcaacatcttactgcaaaacttagctattgcagtaagacaaaaaaggaaataaaatgtatacagattggtaagaacaaaataatacagtctttgtttgcagatgatataattgtctatgtagaaaatttttttaaattggtaaaaaagtctctgataactaataagcaattatataaaagttgcaggatacaagagaaataagtcaatcacttttctatgtaccatcaatgaacaagtgaaatttgaaattaaaaacccattgccactttatgttagcagccctaaaaataaaatgcttaagtgtaaatctaaaaaaaaatgtccaaaatacatatgaggaaaactacaaaactctgataaataatatcaaaaaaagaaaaaaataaatggagagatattccaggtcatgggtagaaagactcaatattgtcatgatgtcagttctttccaaatgaatggacagactcaatgcaattccaatcagaatcccaggaagttattttgtagaaattgacaaattggttctaaagtttatgtgaagaggaaaaagacccaggagagtaaattcaatattgaaagaaaagagcaaagttagaggactgacaccactcaatttcaaaacctaccataaacttacagtaatcaagacactatagcattagtgaaaaaacagacaaatagatcaatggaccagaatatgagctgagaaatcgactcacctaagtataatccattgatttttgacaaacgggcaaaggcaataaaatggagcagtctcttttcaacaaatggtgctaagacaactggacattcacatccacacccctaacattaatctagacacagaccttgaacctttcacaaaaattagctcaaaatggatcatagacttcaatgtaaaatgcaagattataaaaatcttagagaatgacataggagaaattcttgatgaacttgggcattgagatgacattttaaataaaataccaaaggcatgatctatgaaagaggtgattgataagctgagctccattaaaattcagaacttctgctttgcaaaaagcagcatcaggagaatgagattacaagccacagactggaaaaaatatttacaaaagacatatctggtaaaataatattatccaaaatattatacagaactcttaaaaatctaaaataagacaatttacaacccaataaaaaattggcaaaaaacctgaataagcacctcagcaaagaagatacacagatagcaaataagcatatgaaacgttattcaacagcatatgccatcagggaaatgcaaattaaaacaacaatgagataccatgacaccctattagaatggccaaaacccaaaacactgaccacagtaaatgctggcaaggatgtaaagcaaaaagaattctcattcattgctgatgggaaggtaaacagtacagccactttgaaagacagtttggtggtcttctacaaaactaaacaatctcttacgacataatgcagcaatccttgctatatacccaaagaatttgaaaatttgtggccacacaaaacccccatgtgaataattatagcagctttattcataatgaccaaaacttggaaggaatgaatatgtccttcagtaggtgaatgaataagtaaactgtggtgcttccagacaatggaatattttttcagttctaaaatgaaatgagctataaagcaacaagaaaacatggaaggatcttaaatgcatattattaagtgaaagaagccaaactgaaaaaggctatatacagtttgagtgcaactatgtaacattctggaaaaggtaaaactagagacagtaaaaagattcgtggtttgtcaagatttaagagggagcaagtggatgaataggagaggcacaaagaatgaacagtgaagttgttaggagagtgaaactattctgtaatataatttggattgaagacatttgacaaaacccatagtatgtacaacaccaagagtgaatcttaatctaaactatagactttgggtgacaatgatgtgtagagtcattgatcataataaatgtaccactgtgatagcaactgttgatagtggggaaatttgtctgtgggcacaaggagtatatgagacctctatactttcagctcagcatcctatgcctatgcgtgttaggtctgcaggcatagaaaatacacatatatacatgcatatatagggttttatgagggtattttcctttttcattttgttaaaaaataggatcacagtgtatacattacactttgatttttgtatcattctcactttatatcatgactgtcattctaggtcaaacatactagaacaattgttttataactgcgtaatattccacattaagtgtgttccacaaattattcaatacttattgatgaatagtcaaatatttgctcctaccaacaattctgtaacagacatctttgtatgtgtatctgtatgtgtttgttatctcattttatattaatgcttgcatttctgtagacttagttcccaaaagtgagatttgctgaataaaatggtatatgtatttttaaaataatttgtgcttctaccagcatataaaggaggccattctgttacattcttatttggatcagatgtcatcagtctttaccatttttaccaatcctgagaagtaaaaaattatgcctcattatagcttacatttgcatttttgtaactacttgaagatgaacatcatttcatgttaattaacaatttgcatcttcttttctatgaatagtctgttcttatccactttcttataagttttttgtcttttaatgatcagttgataattttatataagggattaaaaaaatttttgatattttactttaggtttatctcttatatagtgcatacagtgtgagtgagtgtgtgtgtgtgtctgtgtttatctcttatatagtgcatacagtgtgaacaagtgagtgtgtgtgtgtgagtgtgaacaatcaggttaattttggagtttaacataatttatatttattgtcagatagtcattctatttctttttgttccttttcctttattttataattttggtataattttggtatttaagtgactacattgtattttcctttttctttgtaatttgaaagactataattcttttaagagtgttttccaataattattaaaattatattctctaccaatctaattagtatacatatccactaatcattctaatgaaagggagggatttatcatctttttagctttctcagtcctcccataaccacgcactttttatattcttagggcttaggtgaaacaagttatttttgtgttttaatatttacaatagctatctagaaatcaccaaatactgcagcatttaatagtgattgttttatatcaccatttctctattattgatatttattaatatcttgttcaaatggagtaatcttttttattttattattattatactttaagttttagggtacatgtgcacaatgtgcaggttagttacataagtatacatgtgccatgctggtgtgctgcacccattaactcatcatttagcatttggtatatctcctaaagctatccctccccctccccccacctcacaacagtccccagagtgtgatgttccccttcctgtgtccctgtgttctcattgttcaattcccacctatgagtgagaatatgcggtgtttggctttttgttcttgtgatagtttactgagaatgatgatttccaatttcatccacgtccctacaaaggacatgaactcatccttttgtatggctgcatagtattccatggtgtatatgtgccacattttcttaatccagtctatcattgacggacatttgggttggttccaagtctttgctattgtgaatagtgccacaataaacatacgtgtgcatgtgtctttatagcagcatgatttatagttctttgggtatatacccagtaatgggatggctgggtaaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatgggggtgtttgtttttttcttgtaaatttgtttgagttcattgtagattctggatattagccctttgtcagatgagtaggttgcgaaaattttctcccattttgtatgttgcctgttcactctgatggtagtttcttttgctgtgcagaagctctttagtttaattagatcccatttgtcactggcaaaccgaatccagcagcacgtcaagaagcttatccaccttgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaaccttcatgctaaaaactctcaataacttaggtattgatgggacgtatctcaaaatcataagagctatctatgacaaacccacagccaatatcatactgaatgggcaaaaactggaagcattccctttgaaaactggcacaagacagggatgccctctctcaccactcctattcaacacagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataggcaacttcagcaaagtctcaggatacaaaatcaatgtacaaaaatcacaagcatttttatacaccaataacagacaaacagagagccaaatcatgagtgaactcccattcacaattgcttcaaagagaataaaatacctaggaatccaacttacaagggacgtgaaggacctcttcaaggagaactacaaatcactgctcaatgaaataaaagaggatacaaacaaatggaagaacaatccatgctcatgggtaggaagaatcaatatcatgaaaatggccatactgcccaaggtaatttatagattcaatgccatccccatcaagctaccaatgactttcttcacagaattggaaaaaactacttttaagttcatatggaaccaaaaaagagcccacatcgccaagtcaaacctaagccaaaagaacaaagctggaggcatcacactacctgacttcaaactatactacaaggctacagtaaccaaaacaacatgatactggtaccaaaacagagatatagaccaatggaacagaacagaggcctcagaaataatgccacacatctacaacaatctgatctttgacaaacctgagaaaaacaagcaatggggaaaggattccctatttaataaatggtgctgggaaaactggctagccatatgtagaaagctgaaactggatcccttccttacacctgatacaaaaaataattcaagatggattaaagacttaaatgttaggcctaaaaccataaaaaccctagaagaaaacctaggctttaccattcaggacataggcatgggcaagagcttcatgtctaaaacaccaaaagcagtggcaacaaaagccaaatggactaatcttaaggtcaggtttttattgaataaagaagcagtacccttgctggcctatctgtgtctttattattcttggtacattcaataaaatttgcctgggtctaagactgtgaacccacagtaacaaaacttagtagttatcacaaaattcagtagagcttggtcaattggagctaaacattggtaaaaaaatagaggctaacctaattgtatccttttgtcgacatgtttcccctctcttactggaaggatgcttccttgaaaaaattcaccttgatatatcctagtgtttgtctcttacccttgagtcataatcaacaagtttaagattttaatacagaaatatatctctcttttattctgaacttttgcttctgttttgatgggctattttctcttcagaaacacttattatttatagattagctctctgctctgtctatggtatcaatcatcttctcttaattatatatacatatgcatacacagaccaatatgcaaagacacgcacacacacacacatacacacgcacacgcacacaagtgagataggtaggaagatagtatgtagacagatacacaaattatttccttttgctttataggagatctttacagttttgtctatccagtgattatataataaaatcactcttctttttttatacacacattattataatttaagcctttaagttcctatctgatggagataaactcctctgaaagcaccatgtaatttctgaaaattcccataatgttatctaatgtgtgttctgtaataaactcttcaggttcttctccttggtctccacaacttgctgtcatagaaatgacgaacttcatgaaatcaccactttcctaggtaaagctacttctctagtgggaatcactaatgttcccactccatttgtggagaggggacagatcttattatgtcagaaagtgttttcctagctgtttcctggctgttggagctccaaaacctcccaacgcaatagacattgtggttttcattgcatatcattcctatttctctctctccattatttagcagtaatttttttaatgaaagttaataccacttccagctctggcttgagttttgattggtctaagacttagatactaagtaaataaaggttatcccatctctctgaccaaagcaacttgctcaattaaacaaggtctaaggcagttaagacctgggtcttccgctgacataaggattttttcatagataatccaatcagagtacatctaagaacttagttaattataggcaaaggaattatcattctgctggatatggaagaataaagaaaccctggtggctactggtaagccacaacatgaagattaatgccacatggagaaacgcagagtcaaaaaattgcaaagaaattaagttgaaattctaagccacagttgaaagcattcaactggggtcttttcagttatacaggccattaaataactctttaatgtttaagtccatttatgttcagttttctactaattatacatgaaagcatactgacacaaatacttacacatgctgaggaagcacacattcttcagcctggaggattcaaaaactaataccctgtgccaggccgctctaaaaactgcccccctttctgttgcagccactgctacaaatgaaaggcttgctcctgctgtaccttcacatagttaggggaatacaatcataacattggaacagctttagtcctctcttaactgagatttttaaagtaagtcatttctagccccaaagaggagaggaagtgccttcttctcctgtgggaaaacaatcagttatatttcctattccaggaaactttcttcctagaataatggacagtgcaagcaatatctaacaactgtcactatcattacactccacaatcccaaagaaaccagattcacaaaaacactaagtggaaaaactaatgattggcagggctagcatgcaaatactggtttgcctggttacaaagcccatgctttttctattacccgaatttgtcatataagtaatgtgagcttgattcaaaattttcaatcaacagaatttaatagaagagttgacaatataagtgctagcaaaattcaagacaacatattattttctgaatcctaagccctgaccacatgacatagcctgtaatacattttgtttgcttagtcatttacatgtctactttaaaaaaaatattgaatgtatatgcatattcagattttatgcataaaatatagaatgataccttccttaatagtgttcaagataaagtgcaacagtaagactacttttgacttgcgttatgaataaagtagaacctgaacttgaccttaaatggcacagtaagtcctcatctaacatcacggataggttcttggaaactgcgactttaagtaaactgttgtacaaagaaaccaattttaccgtaggttaattgatataaaaaagagttaagatcctgtggcatatttctcatcacaaaaacatcgccaaatttctaaatgaagaccccaaacatttctaatattaaacactgaattaaatatgagctacacatacatttaagaaagattaacaaaaacaagataattacccatgtttttgtaaatcagtgagtgtcgatggtcatagtggtggtggattaagtcaagaaataagtgtttgcaaagctaaaactgtcaggagcacttccaccacacagttaaaaaagaatcacaaacaagtaaggctgactcacagctggatgagcaccttcgtcttgcatcatttattgttgtgtatttgtataatgaccatttacttaacaaatttttatttgacaataatttacattgattgatttgttcattttccaaactgcttattctagttcagggtcactttccaaactgcttattctagttcaggtggctggagtctatctcagcagctcagattacaaagcacggaccagtcctggataggacaccctcgatcacagggtgcattcacacacacctacactcagactaggaccatgtcgacatacccattcacccagtgggcacgtctttgggatgtgggaggaaaccaaagtacccagagaaaacccacacagacacggggagaatgtgctaactctacacagacagtggtccagggccagaaatggacttttttctcatcaatgtcataacgaacggtattgaacaaaggatgttattcaattcctgctgtctttaaatttgggtgcgggaagatttgtggagcaagacaggggaagtagaaaattccacaatgagaaaacagcaaaggcactgaggtacaaaaatgtggagcatattttggaaacagtaagtaatccaatttggttgtggtgctgggcgtgtaaggggcaatacagagtggcaagtaggctagaaatgtaaagaacagattttccttctccaatgcccacataaggaattagtcctgcaatagccagtgagtggtaacctaaggaaagttgttgagcagcgatatggcatgatctgagccttggtttgtggcgattagtacatgtttgggaagttctcataatgtatttctgactgagatgcttatccactttgactggagaagccaattaggtagagggtagatgtgaattatgggagaaacacagtgtgaggaggaacaaaggcagaaaaatcagaaggaaggctgtctgtaggaattctgcctcattgcaaatatgcaactggggtaaatctagctgaatgaaggtactggctccaatttggccatattaggtaaacaagcattctttagtttggaacgccactgtgaaaaaaattataaagaaaaaactccaaccttattaatcatgttctacattttctaccaaaagagcagagaaaagaaaaaaaaacatatatttgtgagttcaactgtgtttaccctatctaacattttggatttcattacttataataattttcaatgcctaagttttgagaaggcaagagataccaagtatttgcaaagactaagactgcagatccttatctaaccctgtagccttgcctcttcttcatctaatgcccaacattgctaggttaacaagaaggaaaaaaagtacctggaattttttgactttagcattgattctttgtgatgacaataagtatatattaattatattctaacatgtatgaaataggacatatttaataccaaaatttaatatcccaaaagtgttttgtactaaattttatgttaataacaaaggtgaacatatactactaattaacaactgtatgttaattaataaaagctctgcatctataaaaacgtgactatattaatttcccagtccttcctatgaccaagaatagcccaagtaaagcaattctcgtgcaatttattggcactgtgcttctcatttaacttacacccataacatagcgtgttttctaatacatgtctctgtggtacataaaacaatggcagaaatagaaagttaatattttaacaattaatattgatggaatccactgtagagaacattaggacataaagaacaaacaaagaataaaaatgactatattcttaaatatggtgtttcagaataatatcatcatgaaagtgtcctcagtgcttttttatgcaaaagagttagaaaacttgtgattgtgagttttcatttgtgaaaatacctctacagaatttctctgatgaagctcaacttaagaaaaatcaattggtgaaattcactagaaaatctaataatgtaatgaatacagaacaaaagaatgtctcatgaaagggtaatgaacaaatcttagttgttaaacccattctttaacttgtgtaaagttgtgtatgcattacatttatttttctggaggtaatatatattttttattcatgagttgccttttccagctttaccaacacaccttaggtacacaacgtagtattttattaatttactttaatccaggtgtggttatataagtttggggataagaaatggtgttccaggaactatatgattcaacaattggcagatttgcctagctatcagtgttcatgttaaatacacacactgcataactattgaaaacctgacggcatattcacctgtacttggtacagtgccatacgtcacaaaattatacatatcctactctggatgtgcagaaaggttattatggaattcatccagggcattcattctttggttctcctaagtagtcgatacttctacatcagtgcaatgaaaagaacaccaaactagagtttgtggatgactgtgtgcatttctgacattgaatagttttacagcaggaatggatctcagagattatgaaaatcaaaattctaattggaaaaatcaggctttcaagcagttaactgaattgtccaacatctcatagccaaaggggcaaagtggggactctgaccaaagcatttcatttccagtcctttttcttcctgtagcgttttactgacttactgtaacctctccttgaattttctcataagcaaaatgagtacattggactagggcagtggttttcatagatcatattccatgtagtcctaggatttcataaggtaactgggggggcgcttagaagtaagcgtaaggatgatacaggatagtcagggcttgggacttcactggacctctgtgtaagattttacttcaaacacttccatgctaaataaatatttagtggttattaaatagccacttctacattctctacagtagtaccccttatccttggaggatactttccaaggccaccagtggatgcctgagaccatacatggtaccagaccctatatatgcggtacttttcttcctatgcatacataccaatgataaaactttaatttataaattaggcacagtaagagattaataacaatacctaataatgaaatagagcaattatgacaatattctagcatcactactcttgctttttggggccattatgaagtaaagtaagaatgacttgaacataagcactgagatacctctgcagccaatctgataatctaaaaggctactatgagactaatgggcaggtagcatccacagcccggttctgctagacaaagggatgattcaccccttggatgggatagagtgagacagtgcaagatttcatcatgctactcagaacggcacacaatttaaaatttacgaattatttctggaagtttccatagaagatttttgaaccttcattgatttttgggtaactgaaaccacagaagctgaaatgttggataagaggggactaaagtgaatgcaaaatcatattgtgtatgtttgaattttgctctcataaatcacacaatttctagccattttcaaatattacaggtttttatttgcatctgttcttaaggatgtgagataggaaatttagagagcattgttgcagacattatttctaacattaataatatgacaagaactatgacttgttgaatgcttaagttccaggcactgttccatgagctttacatatattagcccatttaatttatttaaaataaccctatgaagtatgggtcctaattttatccccactttagaaataaggaaactaaggcacagaaggattaagtaatttatccaatgtcacatagctagcaagtggcatattcagattcaatattgacacagggtccacacgggtcataacataagtagatgcagtataaattactccctggcagatgaaaacatctgtgatcttcatggtgaatagaaacttttcatctctataaatgacattcctactctcacattcctcaataccaatgatggtctttgaattaataacctgcataataagcaccattaagagaaaaacaactgaagcacaaatattatcattatgtgatcgacaatgtcttcatcggttgtctagttgagattcacctctatctgcacatggtaaagaagctagataataaagtttataatatctaatgcaggcatagatgtgggttcaaaacaaataaaaataccaatatagtaattttcataaaatagctattcaggcctgggagtattagacgcatcattgtcctcaaagttgaatgcacagacttaatggaagtctggccaggtatgagaacaggccttgacaacaacaggcacctataaaaaagggcaatctgaaagtgccttccttcttcactaggacggactttgtaattatgttgtggcattagcattcatctcattgctccaacttgcagtttctcctttttctctccaggtgctgggggccatttcagttttactcttccttttgggaaactacctttaaggactccatgcattcactactgccttttatttgcttgttcctaatgcaagaactatattttatcaatctttgagttttccattgtattttcatgtaataaaaattactgattgaatgacaatatcatcaatcacatactcccaaactttcagaggacatcagctgccatctgtaaattttactatggtttttaaaaagaaacatgccatactcaacagtgccaactacgaatgctgaaataacctatctttctgaatgcttttcatcacaaatttattttatatggcgcatatgaattatctttctaaatcccagatttaattctacactgctgcagtttaaaagcctgatcgctccttattatatagtcctaaagatcaagttcacattcttcggcctggtatgtaaggtcttgcaaaatctagccataccctaccttccaacttttctacatccaaatctcctctagagctacatggggccattgacttaaatctaattaccaagcccccaggtcaaattagttggtatccctaaacattttcaactgtaattatcagcattatcccattgcattgcaattctttatttaagagtctagctctctttcaaaactaaacctcatagtctggtaaactggtcttttttatacctgtgctcattatttaacagcttgcacacaatctttaacagccatttcataaatgcatgcaaaattgcatggaaaggcaggattcgaagctttgactcaaatagtcctctctgatgaaatggcattccctttcatttttgcctccttaagaactatacattcttcaaagtcccattaaaattgttattccactctgagtcactagagttcttgaagaggggaatacatcattcagatttgagttgacagattactattagcagatgcttaataaatgtttaaaataatggaatattaaggaaacatttattaaatagggaatcctttccccattgcttgtttttgtcaggtttgtcaaagatcggatggctgtagatatgtggtcttctttgtgaggtctctattcttttccattggactacgtgtctgtttttgtatgagtactgtgctattttggttgctgtagccttgtagaatgtagtttgaagttgggtagcatggtgcctccagctttgttctttttgcttaggattgtcttgacaatactggctcttttctgggtccatatgaattttatggtagttttttctaattctgggaagaatgttaatggtaatttaatgggagtagcattggatctataaattactttgggcagtatggccattttcacaatgttgattcttcctatccatgagcatgacatgttttttcatttgtttgtgtcctctctgatatacttgagcagtggtttgtatttctccctgagaggtcttcacttgcccttgttagctgtattcctaagtattttatcctctttttagcaattgtaaatgggagttcattcatgattttgctttctccttgtgtattgttggtgtataggaatgcttgtgatttttgcacattgattttgtattctgagattttgctgaagttgcttatcagcttaagaagcttttgggctgagacaatggggttttctagatataaaatcacatcatcggcaaacagtttgacttcctgtcttcctatttgcctacctttatttgtttcttttgcctgattgccctggccagaacttccaatactatgttgaacaggagtggtgagagtgggcatccttgtcttgtgctagttttctagaggaatgcttccagcttttgtccattcagtatgatattggctgtgggtttgtcataaatggctcttgttattttgaggtatgttccatcaatatctagtttattgagagtttttaacatggggggatgttgaattttatcaaaggccttttctacatctattgagataatcaagtggtttttgtctttagttcagtttatgtgatgaattacatttattgatttttgtatgttgcaccagccttacatcccagagatgaagccaacttgatcatggtggataagcttttcgatgtgctcctggatttggtttggcagtattttaccgaagatttttgtattgacgttcatcagagatgttggcctgaagttttctttttttgtagtatctctgccaggttttggtgtgagaatgatgctggcttcataaaatgagttagtgaggagtccctccttttcaattgtttggaataatttcagaaaaaatggtaccagctcctctttgtacctctggtagaattcagctctaaatctgtctggtcgcgggttttcttggttggcaggctatttattactgcctcaatttcagaacttgttattcgcctattcaaggattcaacttcttcctggttcagtcttgggagtatatatctgtccaggaatttatccatttcttctagattttctaatttatttgcatagaggtgtttatggtattctctgatggttgtttgtatttctgtggggtcagtgatgatatttatcttatcgttttattgtgtatatttgattcttctcccttttcttctttattagtctaactagcagtctgttttattaatttttttcaaaaaccagcttctggattcattaatattttgaagggttttttatgtctacatctgcttcaattcttttctgatcttggttatttcttgtcttctgctagctttgtggtttgtttgcccttggttctctagttcttttcattgtgatgttaggatgttgactagagatctttctagctttttaatgtggacatttagttttataaatttctcgcttaacactgctgtagctgcattccagagattctggcacactgcctctttgttttcattgatttcaaagaacttcctgacttgtgccttaagttcattatttaccgaggagtcattcaggatcgggttgttcaatttccatgtaattgtatgcttttgagtgagttccttaaaattgagttctaatttgattgcactgtggtctaagagactgtttgttgtgatttcagttctttggcatttgctgaggagtgttttacatccaattatgtggttgattttacagtaagtgccatgtggtgccaagaagaatgtatattctgttattttggggtggagagttctgtagatatctatcaggtccacttgatccagagctgagttcaattcctgaatatccttgttaattttctgcctcaatgatctgtctaatattgacagtgcagtgttaaattctctcactattattctgtgggagtctaagtctctttgtatgtctctaagaatatgttttatgaatctaggtgctcctgtattgggtgcatatatatttaggatgttagctcttcttgttgaattgaaccctttacaattatgtaatgcctttatcttttttgatctttattggtttaaagtctgttttgtcagaaactaggattgcaacccctgattttttctgttttccatttgctcggtagattttactattttgagcctatatgtgtctttgtacatgagatgtgtctcttaaatacagctcactagtggaccttgactctttatccagcttgccactctgtgccttttaattggggcatttaggccatttacatttaaggttaatattcctatgtgtgcagttgatcttgtcaccatgatgctagctggttattttacagacttgttgatgtagttgcttcatagtatcattggtctgtgtacttcagtgtgtttttgtagtggctggtaatcatttttcctttccatatttagtgcttccttcagtaactcttgcatggcaggcctggtgatgacaaatttcctcagcatttgcctgtctggaaaggattttatttctcctttgcttatgaagcttagtttcactggatatgaaattctggttagaaacatttttcttttaagagtgttgaatattggcccccaatctcttctggcttgtagggtttctgctgagaggtttgctgttattccgatgggctttcccttgtaggtgacctggcctttctctctggctgcccttaatatttttttccttcatttcaaccttggagaatctgatgatcatgtgtcttggagtggttcttctcatggcgtatcttactggggctctctgtacttcctgaatttgactgttgccctgtcttgctaggttgaggaagttctcctggatgatatcctaaagcatgttttccaagttagttcaattctccccatctctttcacgtaccccaatcaggcgtaggttttgtgggtttacataatcccatagttctcacaggttctgttcatttcttttcatgccttttttctctaattttgtgtcttatttcagcaagatagtcctcaagttctgaagtgctttcctccacttgatctattcagctattgatacctgtggttgcattgggaagttcttgtgttgtatttttcagctccatcaggtcatttatgtttctctctaaacattattctggttaacagcttctataatgttttatcatggttcttaacttctttgcattgggttaggacatgctcctttggctcagtgaagttcattattacccaccttctgaagcctacttctgccagtttatccatctcagcctcagcccagttctgtgccttgttggaaaggtgttgcgatcatttcaagaagaggtactctggcttttgagttgtcagtgttttttcattgactgtttctcatcttgctgaggttatctacctttgatctttgaggctgctgacctttggatggggtttctgtgggtgcctttttgttgatgctgttgttgttgttgctttctgtttgcttttcttttaacagtcaggcccctcttccataaggctcctgtcagttgctgggggttcactccagaccctatttgcctgggtctctcccacccctgggggtgtcaccagtggaggctgcgcaacagcaaagatggcttactgctccttcctctgggagctccatcccagagggttattgacttcatgttagtgggaatgtctctatataaggtatctggtgacccctgttgggggtggtctcacccagtcaggagaacaggatcaaagacccacttaatgaagcactctggctggaatcccactcgtctgaactgcctggattcctcagagccagcggggaaaagactaagtctgctgatccacagagacaacagccgctcctccccccagaagctccatcccaggggtatcagagctctgtccgtaaacccctggctggagatgatgaaattcccagagggaggccacatgcagtgaagatggatgggtccgggtgcagcctaaagaggcagtctggtgattatctgccacagctgctgtgttgcactgtggagaattcctcctggatctgaaccacccaatatctctggcaccagcaggggaaaaggcagactggagctgcagtgatggttgctgccccttttctaagttcagtcatcttaggcagcaggtagccatagcgatggtggctacccttccctctaggaactctgtagtcttaggcagaccccagcccagtggccactgagagaatatgcactgctctgtgcttggaacccaaggcccttttggtgtgggcttatgatgggaatctcctgatttgcaggttgcacccatccacggaaaaatatggtttcctgggcaggatggccaatcactcactgcctcccttggctggggatgggagtcccacttaccccctgcaggtgggccattactccactctgatttctttgctttctgtcagttgcaccaaccacctagtcagtccaaatgagagaacctggataccttagttgccagcacaggattcacttgctgtttttgttattctcggtggaggcctccaactgcaactgtgtctagtcagccatcatggcccagctctcactcattagtcttaaggttaatatgcagtaatggttatataccatcctacaagcagcgatctaattaccaattaacatatgtggcaactgtaaatttataatcacaaatgcttatatgctgtactttataactatttacttgaactttaaatatcaatttcaactatataacctgtgattaatgagacaatttgagagatgaagtatgagatggatatattcgaagattctagtgagctgaagtggggtggtaacaggcagatcaaagataaagatttattaaagaaatatgtaaagcaaagcagccaagtatgataaaccaaactgtcagaagagagtgttctgttttgagagcataactctaaacaccacctggttaagcaaaaataagcgagccattaggtaaactgcaagtaaatatatgagtagcacataaaccaatagtgagaagtcactgatagagccaatatggtgaagactataagtcatataatgattttaaaatgtcactgttatgaactgaacatttgtgtctcctcgaaattcatatgttgaaatcctaacccccaatgtgttgtcgttagaaagtgaggccttcgggaggtaattaagtcatgaaggtgaacctctaatgaatggtggtagtgccttataaagaaacaccagagagctctctagccatctgaaaatttcacattctgccacgtgaagatatgagaagctggtagtccacaacctggaagaggtccttcaccagaacccaaccatatgccaccccaatcctggacttccagcctccagaactgtgaggaataaatttctcttgtttataagccaccaaagtaccaaagtccatggttctttgatatggcagccagaagtgtctaacacagtcacttatgtatatcaacatctttacaacataattttgaattatactatatacacgatataacatataattttatgctacactgtaattttataactttaaaataacatttaagttttttttaatgtaaactatgttcattcactcagtcagtcaataaatatttatgaagggtcttgtctgtaccaggtaacattctagatggtggggatacaaggattatcaagacagagagtctctgtcctaaaaatatgataatttgagacagtagcaagaaccatgaggaaaataaaagaatataatatattttgaagaggctactctaattctacaaggaagtgaattttgtgctatcaattgaccttttactacagtgtcttcacttttctcttggttggttggattttatatccagtagctcccctccccctccatcttctccttgaaaaggctcatgagtgttctattgcctaaattctgacatacataaatttctgcctgtgcactttatatttgaacaacatcttgtctaggtatcaaattctgagccacatttttatctctcagaattttgtagacattattccattatcttttgcatttagatgtgaaaaatctgaagccactctgattctcctccaactgacttgccatttccacctttagaattattcttccttgctcttgaaattcagtcacttttccaagatataacttagtaacaatcatgttgaatcaatttttatagtacatgatatactacctagcactgttcattccattttgcctcaatttgtggaaaaaatttcctctatcataggttgttttattcttccattcgatgaattttctttggtaggaacaattattcataaaatggatcactatcatctcttcttatcttttattgtttcagcaactgtttggtatttgtatttttactgtgcatttatggtgattataacaaatctatttcatattttttgttcattcttcttgttgttgctaacacttttgtcacatctaaaatggagggagtgcataattttggatttcaatgtatttccttggttgtataatattttttcatctcattctattcttttatcaactactctttgatattctgttgtaaaattcatgtgtactttaaaactatggcgtgaagtacaaatgaaagtttttattctgtttcttcgtgtctgcccccttccagaatggatgcttatattctaggtttcttttagtctttttattttgctgtggcatttctgtatcgttgtatgttattttcatcttaaatttaaagtggaccactctgtgctgatatttatttgactccatatctcatgatcctcttctcacttatcacagtcacttctctgttgaatttctaagtgaagccacagtattatctgctctgtgtgctcttggaaagcctgggaacacagctatatgcgaaggggtatgtggcaatggtagtgcactgagaagtgggaaaacctgtggtcaattttgttggtggacagggactgtcctctttctctctttttattaaagactattttatagagcaattttaggtccacaaaaaaatgagaagaaggtatagagattcctcatgtacattgtgatactgtgaaatacagttatgtgtcacttaatgataggggatatattatgagaaatgtgtcattgtaatggtgccattagatgatttcatcatcgcacaaacatcatagaacccaaacctaaatggtatagcctattacatacctaggctataaggtatagtctattgctctcaggctacaaacctgcatagcatgcactaaatagataataataacacaatggtaagtatttgtgtgtctaaacatatctaaatatagaacaggtacagtaaaaatatggtataaaatattaaaaatagtacacttgtatagggcaccttccatgaatggagcttgcagaactgcaagttgctctggatgagtcagtgagtgagccatgagtgaatgtgaaggcctaggacattactgaacactactgtgctatacctttatatgactggcagtgcaatgggtttgtttacatcagtatcatcacaaacatgtgagtaatgcattctaagacattaccacagatatgatgtcactaggcaatatgaatattgcaactccattataatcttatggggccatcatggtatatgcagtccctcattgactgaaacattgtgtcgtatgactgtatgtttggtctttgtcccagattcctgacacacaacccataaaatccttgaaacctccaaaggaatgtctttttctgtgctaatgagatgactggtatctggcagcccctaggcagcccccagctccagccccagtcccagcccctaggataacaaggcataaatagagggttgggactttcggccccatcccccagcttctggggagaggagaggggctgaaggttatgttgatcaccaatggccaatgatttaatcagtcatgcctaactctccagagagcttacaaatagctgaacatgtggaggtatttggagggtggcatgcccagagaaggcaagaaagctccagacctgttctcccatatcttgcccatgaatctcttcatctgtacctttgtaatatcctttataagaaatgataaatattagtatttccccaagttctgagagctgctctagcaaattagttaaacccaaggagcaggttgtgggatccccattgtacagccagttggtcagaagcacaggttagacatcctagggtttgtgattggcatctgaaatgggggtggagggggaaggaggagtcatgaagacagcctcaacctgtgctatgtggtgctgtcttcagatagatagtgtcataattgaattgacagccagcttgtgtcctttgcagaattgattctttgcttagaatatgaggaaaaaaactctcacacatttggtcatagaagtctcctatgttgattgttgttgagggagagaataagaaaactgttttttttcccacagatactctctgtccccacacatgcatagccttccctgttattaacactgtgctctctttttaacaatttaccttttgttaaagtgcatcatggtgtatggtgagctggcctgcatgaggaaagagtgctcatttggtcttcaagtttcctcccaactgagaaagaggtgttttgcttttcatagagactaccatatttaggggtcatttccccaattcacttgcttttccccagtagacatttccacggcctctcttcaaagtggagtgttagtgaattttttttcaggatgttgtccacttttgtcaccatttatttgagtttcctagggcttctataacaaatgtccatgaacagggtggcttaaaacaacagaaatttagtctctcagagttctggaagccataagtctgacatcaaagtgttggcagggttggttccttttggaggctctgtggtgaaaccacttcatgactttctcctagattttggtggctgctggcaatccttggtgttccttggccaagataagttaatgcataaaattaaccatcaaaatacttttacctcattatctttataatatccatggaatcagtagtgatggctctcttttcacttctgatagtagtagtttgtgtcttgtttcttattttcgtggtcagcctggctggaggcttattaattttattgatcttttcaaagaaccagttttggtttcattgattttcctctactaatttcttgttctcaatttcatctctaatttcattatttattttcttctgattaatttagttttaattttctttctcatttctgttttcctaaggtggaagattagactattgattttatatctttttcttttctttctatgcatttaataccctaagcactgctctcactgtatcatgcaaatatctattttcttttcatttaattcaaaatattttaaaatttcttttgagacattttgtttgacccatatgttatcaaaaattgtgtttttaatttccaaatatttgggaattttccacctatttttcttattttattgatttctacttcaattacattttggttgagagcatgttgtgcatgacttgtactttataaaaatttgttaaggtgtgttttacggctcagtacatgttcaattttggggaatattccatgtgagtctgagaaaaatgtgtattatgctgttgtttgatgaagtattttataactgtcaattagatccagttgatttatggtgctttcaagttcatctgtaaccttactgatttcctccctgctgaatctgtcaattactgacagaaggctgtgaagtttccaactataataatagatacatgtatttcttgcagtttatcagtttttgcttcacagagtttgatgctgtttttagatatgtacagagcaaggattcttatgtcttcttggataattggccctttattattatgtaatgcaccctctttatatccatgatagtccgccttgctctgaagttgactttgactgaaatgaatatagctactcccattttgattagtgttaacatagtgtatcattccccatccttttactttcaatctatatgtatctttatatttaaagtaggtttcttttaggcaacgtaaagtagggtttttaaaatctactcaggcagtctctatcttttaattagtctatttttctttaatttttataactagaaaaaagttattcataaaacaaaaagccttgcctcttaaaaagcaatgtctcttgttaaattgcaactgattagtcatgctactgagtcatataaacaggaaatttatattttactctagcataaattgatattaaaaaactaatttttattgtaatcaatttacattttccttatttgttaactacaattatttaaacattgtccatttatttacacatatttttgaagcaatatttggctagaatttgatccttctttggctacttctgttagcaaaccaatcaaatgcaagaccaaatcctgataggtgctgggggagagatacttcattaaagagtttttaaaaagaagaaaaatggtaacagatttgaatcgggacagataactcaagcatcattaaaaaggccagatgcacaggggaggcaggaaggttagtcagggcccactgacagctgcagaagtggtcccggtgagatctgacaactacttgaactaagactagtagtagaagtctatagaatagatggataatacaggtgttaagatgatatattaaactatagaatttggtgatggatgagatgaaggccatcaaagatgattctaggctttcagaattgaaagactaggaaaatgctaaaattacctaagatagagaatacagaagcaggaacaggctaaatgtgatggcaattagttgactattatgcatgaggtgccatagtacatctgggtagagatatctactagatatttgaattaaatggtcctagagttaatgggagaaatgtagacctcaggctatatgagagctgtcagtgcaaagacagaagttgaatctgtgaaagcctctggaatagagtcacagttaaagatattggaagttgtgaaagtatattataaccgattagtcattagatttataagtttacaacttaaaataaagggatagccctgtatttgcctacaattagactgagttattcctagaaagcgtttggccatttctagcagcctttatattttgaaacagcctttgctgtggtgactaagagttatgtagttcaaccatgtgagttatatttaggtaaaataattttttatggataaaaaatattgtataacatccaaaactagttcatattgatatcaaaaagtacctgatatttaattcataacaaatttccaaagaacatatgttaaaaaaacaggcttcctagattattcaaaattagctctgggttttcattaatttatggtgttgattaacaatccataaattattaattaaacatttgaaaaactactacgtgtaagatgctgggctaatagtctgtgagatacaaagatgactcaaacataaaatctgtccttaatatacatatggactagtacggggaaataagacacatacttaggtaagtatacaaggagtggagagttagaaatcatagataattttaaaataaagaaaaaattccatttgcaatagcattaaagagacataagatacttaggaataaatttaacaaaagaagggtaaaacctatattctgaaaactataaaatattgttaaaagaaaatttaaaagatacaaataaatggaacaaaaatcccatgttcatggaccacaagcatttttaaacattattacgaaaatgatggtcccaaattagtttatgcatgaaccaaaacaatctcaaaaaaaaaaaaagtaaaatgattcatatttcccgatttcaaacttatccaaagaaagagtaataaagacagtttggtactgacccaggacagatatacagatgaacaaaatggaattggagagtccagaaataaacccatacatctctggtgaagtgatgtttgatgaggatgccaagattattcaagggggaaagacaagttctttcttctccaagtatcacttatttgtggctttataggaaaactatttctgtatcaatttcacaccagtccctgatccctcccaccttggtgcccaaattgaaccatctgaaattttattatatagatgtcactacataaaaataaaattatatatcaaaagtaagaaaataagggaattatgaatggaaagatgttttaaacagataggacaattacagagttatacttaggccaagcacagtgactcatgcctgtaatcccagcacttcgagaggctgaagcaggcagatcacttgaggtcaggagtttgagaacagcctggccaacatggcaaaaacccatctctactaaaaatacaaaaattagctgggtgtggtggcacatgcctgtaatcctagctacttggtaggcagaagcacaagaattgcttgaacctgggaggtggagatttcaatgagctaagaacacaccagtgcactccagcctgggtgatggagtgagactctgtctctaaataaatcaataacattatacttaatatattatcatgtgctcttaccaaatgatgagcatatcatcaaaatctaatgggagaatgaaaacggatcttgagagctataaggaagagaatactcttaagctccccaccacttctctacagtctgtcattacttctgtccatgccactcactggaccatacttactagtatatggagtcacatggtttagtaattgctcagagatatgacatcaccagagagatttagattgcatttaaattataaagctatttaatatactaatccctaaaaaaaggtagtcaatccataaaataaatatcagcaatttcatcagtataaatgattttaagaaaataaaaacataattgaaagacaaaactgatttcaaaactaaacaccaagctacagtaattgagactgtctggtcctggcatagggattatatatcaatggattaccatggagaggtcagaaataaacccatacatttgagttcaatttattttcaacaagggtgtccagacattcaatgagggaaaatataattttcaatatcagatgcaggaacaactgtatagccacatgaaaaagaatgaagttggacccctacctcacaccacgtacataaattaactcaatatgaatcaaagaccaacatgtgagactgaaactataaagctcttagaataaaacatagatgtaaatctttgttgtcttggattaagcaatagtttctttgatatgaaaacaaaaacatgggcaacaagagtaaatgaattggacttcataaaagttaaaaatgtccttcaaaggacactatcaagaaaataaaaaacaatacaaatgatgggaggaaaaaatataatatctgataaaggtctaagatccagagcatataaagaactcttacaactataaaaatgaaaagacaaataatccaatttaaaagtgggtgaaagatttgaataaacaattctccaaaagaagatatataaaatggctgataataacagccaataatgaaaagatgcttgacatcattagtcatcaaggaaatgccaatcagtatcactatgagatactacttcacacccacagagatagctagaataaaaagttagatgataacaagctttggtgagaaagtagaaaaatcagagccttaactgctgatagaaacgcaaatggtgcagcctctttagaaacagtttgcagtttctcaaaaagtttaacagagtgaccatataatccaacaatttgactactaggaacatatcaagacaattgtataaaaacttgcatagccaaacaatggaaaacccaaatgtccagaaattgatgaatggataaacaaaatgtggcatatccatacaacagaattttattgagccatgaagagaaatgaaatactaactcctgttatcatatggattaattttaaaaacattatactaaggcaaacaagatcaatacaaaaagctgcatatcatccatatgaattatatacaagacagatgtgaaatgtccagaataggcaaattcctagagacagaaagcagaatgcagaatagtggctgccagaggctagtgatggggaataaagagttactgctaatgggtagaatatttcttttggcaatgatgaaaatattctagaattagatagtgataatgattgcataatttattgcaggcatacctcagagatactgtgggtttggttccactgcagtaaagcaagtatcacaatacagtgagtcatacaattttgtttggtttcccagcatataaaagttatgtttacactatactgtagtctattatgtgtacaatagtcttatgtctaaaataacaatgtatacattttaatttaaaaagaattttttgctgaaaaatgctaacaatcatctgagccttcagggtgttgtaaacttttttgctggtggagggccttgcttcaacgttagtggatgctgactgatcagagtggtggttgctgaaggttgggtggctgtagtaatttttaaaatgaggcaacaatgaagtttgccacatagattaactctttctttcataaaagattcctctgtagcatgtgatactgtttgaaagcattttatccacagtagaacttcttttaaaattagaggcaatcctctcaaatccttccattgctttaacaactaattttgtgtaatatcctaaattttttcttgtcatttcagcaatgttcacagcatctttactcaaagtaaaatcatttcaagaaaccactttctttgctcatgcctgagaagcaactcatcatccattccagttttatcctgagatttcagcatttcagtcacatcttcaggctccacttctaattctaattctcttgctatttctaccatatctgcatttactttctctattgaagtcttgaacccctcaaagtcatctatgacagttggaatcaacttcttccgaactcctgttaatgtggatattttgacctcctcccatgaatcacaaatgtttttaaggacatctactacagaacaatgaatgctgttcacaaggtttcaattctttgcccagatctattagatgaatcattatctctggcagccatagcctcaaaaatacatggcttaaaaaataaggcttgaaggttgaaactactctttgattcacgggctgaaaaacagatgttatattagcagttatgaaaacattaatatccatcagcactcttgggtgactagttttgcattgtcaatgagcagtaatattttgctaaaacttaaagtcaccagctgcatttgtccctaacaagagagttagtttgtcctcttaagctttgaagccaggcattgacttctcttctttagctatgaaagttctagatgtcgcctgtttccagtagaaggatgtttcatctacattgaaatctgttgtttagtgtagccacttttaccaatcatcttagctagaccttctggataacttgctgaaacttctacacaggccaaaattgcttctttactacttccagaacaccatttacatctttttgtttctgagcttgttttacaaccagtctatttgttagatgataagcagacatctaacaaacaggaagtcactcttcctacttttaaaactgtaacttgcattattcaccaccaatctttaacactcaccaaaatgtaagcttcttgaaaaaagatctgtacttggtccatcattctatccacacccaaacccaacatcacctacacaaatgggtttttcatagtaacttgtacatatcaggccctaaataaatgtttgctgattgaataaactatcacagagattgtccttgggaggtaggagagtggggtagagagcatggacaaagattctggctcggtcacttataaactggataaccctgggcctcagattcttctgttgtgaaacggaggtagtaagagtgtctttctcaagggctgttgtaaggattaaattagttaacacatggaaagcactgagaacataacaagcacttcataactattagtattatggtctccccaagacttaaacacagtaatgtctgcaaagcatctagtccacactgaatgaatgagtaactaaatctgctctaccagtcatgttgacattaataattcattgagactttctttctccttccctcaaatttatcaccttctatgtatagaaaacattcttaaggttactatggaactactcagttggactgattagctgtgttctcttccatgtcttgtgaattaacctccttaagaagagtagccatgttttgttttttgaaaataatataattattgctgctgatgtacttgttcttgttttgtgtgttaatgagataagctcctctatattctcccaccaaaaaaatgtgtcatgagtctgttggatgaaactctccttttactgaatttttaatagcatattattttgcacttttatacacatatagttatttataaatgttgaactagcactagtttgttctctgcccagataacaaaattaaatgagaaatattatcttgactcaaaagattaatttagtagcatcatcaaatgcaatgtccaaattagcaagaaatctaaatggagcaattgccatttactgtgcactattttttttcttgtcaatgggcaaaatcaggaacctctggattacaatgtacagtgtagcacagtatctctttttagtttccatattcctacaagaggtataacactaaattcctcaaggcatcatgccacttcagtatgagtatgtggaagagacagtggagtaaaagtcgggggacagattagacaatttctcccatcttatgaacatttgagagagttttcctttgctattcagtttcaatctgattgaaaagagactaattatctgttaaaacaataaatcaatcacattgtattgatacagctctgaaaccttggaaaaaattaactcttgcagatgacatgattgtctatgtagaaaattcctaataatcaacaacagacttctagaacaaacaagtgattatagtaaggttgcaggacataggttaatatacaaaaatcaattgctttcctatgtaccagcaataaacaactaaaatttgaaattagaaacacaccatttaaaatagcactaaaatatgaaatatttaggtataagtctaataaaatatttacaggatttatatgctgaaaagaacaaagctctgatgaaagtttgcattttcaattgcatcttcttttgcagagttttacacacatataattatttacaaatgttgtcacagtaatactcatttgttctctgtccagataatacaattaaatgatgaaaaaaattaaaaaagagatagtgcatgataatggctaagaagactcaatattgttaagatttcagtaaaaatgtgagttcagacacctcagcaaagcagatatacaaatggcaaaaagtatctgaaaagatggtcaacattgtatgtcattatggaatggaaaattgaaacaacactgagatactatgacaagcctattaaaatggttaaaatctgcaaaactgataataccaaaggctggcgaagatggaaggcattaggatctcattcattgctggtaagaatgcaaaatattacagccactttggaagaaagtttggcagttttgtacagagctaaacacagtcttaccatatgatccagcagtcatgcttgtaggtatttacctgagttgaaaacttatgtccacacaaaaccctgcacgtatatgtttatagaagttttattcataatttccaaatattggaagcaactgtgacacatttttcaatcagtgaaaaaataaacaagttgtggtatatccattcaatagactgttatccagcaataagaaaaaatgaaatatcaaaccacaaaaaatcatgggggatgctttgattcacattgctaagtgaaagaatccagtctaaagaggccacatacagaccgcatgattctaactatatgacattctaaagaaggcaaaactacagagacataaacaaatcagtggttactaggagttcaggggaagaaagagaaggatgagtcggtggataggagatttttaccatatgatttgtatgatatgtaatcacggatatgtgatggtatacatttatcaaaacccataaaactataaaacataaagaatgaatcctaatgttaactatgcacttatgtaatgtatcaatgctggctcatcaattgtaataaatgtgccatactgatgtaagataataagggaaacagtgcagagagagagagagcatatgggaattttctactttctgctcgaattttctagaaacctaagttggctctaaggtataaaatctattaattagaaaagctttaaccatcaaaaatagaaaatttaactcataacaaattattgattacacatagatataaaatacacacatataaataactatgcatctacacacagccaaataaaatacacatctattcaccataagtcttaactatttactctgttattttcccactcttaatgtaatgcttctacagggactaacatggtaaatgggaggtgaggaaatttaggcagtgatactgaattatgcttacaagaaatttactaaaagggaaataggactgaaatgaatagttgtgagaatcttagagtcgaggaaagaattatttttaagctacataattatgtcagctataaaaatatacagttagtagctcattaaattttattctatagttacttcactttcttgtcaagaaagatgaatacttgattataaaactgcataccaaaaaggttcaaattttcccaatgcatgaaaatgtgagtaaaacaaaataatcacataccaataattgatcgatgctgaccattagaacactctcatattgtttgccatctttaccttcaatatcacaatcagatgatgctactggcaacagaacaaggatcaggggaggaagtccaaagatatacctaaaagaaactaaatttgacagtaaataagaatgagctaaatgttatatcgtattgcatttgattgtggggtttcaatggactggaccactaatttctaataattttaaaaatacatcttggtttggagatactacaggaagaacctcaaaagttgaacttatgtaacaaccaaagtggaacagcattttggagtatagcgtcctttcacttttttattttgcaattactctttaggaaagtgcaaaacaagggtgatgaaatcatagactgcttctgaaaaacactccagggtgttaatcaatttgaatttatgttgaacatccccataagaaaaggcatatacaggtaaagaggtgcactacagttcgaagagttacatattgttggaattttatgatgtactgcacgtaattgtatatttttgtaaaccttgatggtagtccatgtctatttgcttcttggaggcaacactgtgggaggttaatctccctgggattgcactgtaactactgtaagtgcactctttctttttaataatgaaccctgaagggtttacattcccaaaagtcttacaaagtttatgtttgtattttgggactactctcctatcctttcactatcttctgtctctgagtccccagagacccagattcttttcaaacacagcgctatccagcttcttgtcatgttagaaaaactctgtaaataaattcacatcctcagatagaaaccaatgatttctatctgtttttgataactcttcccaattaggagcaattgtctaatcaaaaggactgaaataatggtattatttcaggcagaaagatggaaagccagtggttcccacaaacattaaaatctgatcatacagggacctatttcttcataaacctgccatagtgtcttatttgtatctttttgtaaactctgaggcatgttgacaatgtatttcctgtgaatttcccaaatgaacttcaattgtacttgaatgcaagatatttcacttgtgtgccttctctgattaagagtacaagcaacactccttcaaacccaaggaactaatattgtgacagcctgaagactgttagggatatcataaagtttccagtaacattgtcatctattatatcatgatctgtcatataaaacaatcaataacacctcccaataaatcaagtgacccatgttgttacaaatagagaaaattttctgggtagcaattatgaaaacaaacataaatctaacttctcatctgcatatgtgacaacatagtaagagaaacaaaaattgataattttatttatacaaatatattaataactctgccactaagtgcctatatgcatgatgagcatgaattaacttaggagacagataatgatgatgatgctagttacctttagttgagtacctaccatgtgtcaggaactttatatataaaatctcatatatatatatatgatttataaatatccaaaaagttctgcaagttagtctttctgtaacacatacatagtaggtgccaggtttggatgctaacctgaatttgttgctttaccaggattcgattagaaatggccataatctattgataacatgtaatcacatttgtcttctgaatgaagttttgcctctctcttctactcctgttccttcaacctaaagatcctcagtgatcaattgctaatttaaaaaaaatattttggcaattaaaaaaatgtacactcatagatttaagggggaccagagcagatttcttactaatacatatttaatatactgtacagtggtgaagtctgggctttagtgtatctatcacctgaatagtgaacatggtacccaataggtaatttttcaatccttatccccctcctactctcccacctttcaaagtctccaatgcctattattccaccctgtatgtccatctgtaccactgtttagctcccagttataagtaaaaacatgcagcatttgactttctgagtcatttcacttagataatggcctcaagtttcatccattttgctgcaaaagacgacttaactcttatggctgagtagtattccatggtatacatataccacattttctttttttctccctctctttttgagacagggtttcactctgctgcccaggctggagtgcagtggcatgatcatagctcactgaagcctcaaattcctaggttcaagcgatcctcctacctcagcgttctgagtagctaggactacagggtgccccaccatgcccagctaattttttaaaatttgtttttagcagacggctcttactcttttgtacagactggtcttgaactcctgggctcaagcaatcttcctgcctcagcctccttaagtgtcagaattacaagctgtaattacaagcccggccataccacattttctttatccaaacctctgctgatggacatttggatgatcaattgctaattattcaccagattctgaccttgtaatcagatttgtatagattgtatgaaatcatactttttattttctctgtcatcttacaggggtccaaaaggtatacttcgggaggagtagatgatagaggaaaaattatataacatataacttgaaatgagcttaaaggagaatataataaaataattaaatgctagagtgaaagggatacttttaccattatcataaatattccaaaggtccaccttttgttttaatacatgaggttgttttacttgctatgagcattagctgtcttcttcacctcaattttcagtagttaagtgctcctcaaatttaaatcaacctatttattcaccggatggcattttgtgcattctttccaatgagggttgctggaaaattcagtctttttgtatattacacgtactttctcaattttaaaacataatttgccttgcctgttaagagtgttttctgttgccattgttgtcattgaataattagccccagacagactatggcaatataaagcacagaggttttggaattaaaattctcataataataattataatgcatggcttcctgcagtttgtttcaagagatttcactagaagcttgttccattaagagtgcacataatgttactctttaccctttgtctatgccatttcttttgagagttgaagtagttgaggatctactatgtggtctccaactgtcttatctggtttgggtaatttcatcatatttgaggaccaaaaagttgaatagcaataaaaacagactctacttgggaggctgaggcaggaggattgtttgagcctggaagtcaaggctgccatgagccatgatcttaccgtgagccatggccgtaagccatggccgtgagccacgatctactgagcctaggctgagtagtcaagtcaaaacttgagacttttgacttgccaagacaatggtttgtgtgactgtgtaaatgacacagcatctcttaaggtcacttacctgatttctaaaatgaaaacttcagactaaatgatctttttcatcttgcagacaccttattctaagaatctacctggtcctccaaatgcagaaactctttagatctgaaattgcctcacggacaatgctgcaaacatacctagggccttggacccacatctcataggttcccagctctcccattaatgatgtagcttggtagtttggtccataattgaagacctttctcctacatcacatagagagtaacatattaagaatggctggtttgagagtgcttttggcattgttgtcacacccacactccccaccatcctgaacttttcattaggttaccgaaaagataaaccataggaataacgcaaggcaagcgtggcttgtgggattgcccttacttcccctgaagaggctgaaattggagaatttgttttcagtagggaatttggttaaaccagaaggaggtctgtctaaaaattcttgttggtttttaatgtaagccaaataatacattcaatcctcagctgcttaagttatgggggtcaaagttaacataaatagttttctacaatccatcaactccagtctttatcagtctttaaaaccagtgtttactgaatgtccattgcatagacctattttcactgataatttaattccataaccacttcatgaagaagtaggtaagtactacaagttattcacatttatagatggagaatctggggcacaaagacagtcatgtaggaaaattcctttcgtatttttctctctcttttttttttttttgatatggagtctcattctatcatctaggctggagtgcaatggtgcgatcacggctcactgcaacctcagcctcccaggttcaagtgattctcctccctcagcctcctgagtagctgggattataggtgcccaccacaacgcctggcaaatttttttgtatttttagttgagacgaggtttcaccatgttggccagcctggtctcgaactcctgacctaaggtgatctgcccacctcagcctccccaagtgttgggattacaggcttgagccaccatgcctagtcagaaaattcctgtacataatatagatatggaattcaaatccaagactgtcacattgaagagtctagaacctcagcttttaggcactgaactacattgcttccttaaaaaataaccatatatgtgtagtcaaggggattgcataaaaacccatcttcctgtgcatgaacctcactaaggtacttcctggccaaactgtgaaactgcatcatatgcttttatttcagaaaaagagactaaatatttgttcttgttacagtaggttatgtgtcagggttaaaagcagaaaaaaaagtcacatagatgagtgtgaatatgacacgtaagttcgttctatgaaatggccttttccattttttaaaaaaatattcaaacactaacgtgatgcagtttgtaattctcctttatgcttgttcagggtttctaatattagttctctattattattttttgagacagggcatcactctgttgcctaggctggaggacagtggtaagatcatggctcacggcagccttgacttccaggctcaagcaatcctcctgcctcagcctcccgagtagagtctatttttattgctattcaactttttggtcctcaaatatgatgaaattacccaaaccagataagacagttggagaccacatagtagatcctcaactacttcaactctcaaaagaaatggcaaagacaaagggtaaagagtaacattatgtgcactcttaatggaacaagcttctagtgaaatttcttgaaacaaacttcaggaagccatgcattataatcattattattagaattttaatattttgtctgctaatgaaaacttatagcccatgattcatataactgtgcttcaggaagtaaaggctttttctgaaaaatgcacacgctagcttccttttctcagtttacctttctactttagagcagaggtgttgcaaggattagaaccaagggtgatccagaagaagaaactgcagaactatgggcattgcaaggaaaatagggttgtgctcaatttttagttttgtattaagctccgggaggacattccttagaagtcctccataattacgttggctattctttccgctctctctatctttgttttgttactgagctggcactccttggttgtgtcaattcttgattctttacccacgagagtggaaagaagtcttgatctaacggagtagccatcaaaagaaagagcagtcagtttcctattcccgcaccctccccccagctgtcttcttgcttgaggaagtacttactgtaaagcattccaattttcctaagcagatcttttcccctcacaatcctttttcctcttttttaattccagtaagttttttggctctttcattggtcatatatgactgccatccgaatccaaccctcctgaattctgtccctgtccattctaaatccgtattctgcacaaataagatatattaggtctcaatactggtctggaagttagagtcacgcctatttcattctgcctccatcaagaagcgcccgtaggaaaaaataacaacaaaaacaaaaacaaaaacaaaaaaacccagaagctggccttcctcagcgccagccccaggactggtttcccagcaataggcgcaaggtacagcccttgccggaaactcccagtcttactcaggggggaaaaatggggttttccggagacctgttcccctagggtttaaaagcgcgtcccgtgggagcttcgctttcacttctctagggagttctgagctgcaagagcccagctactcgccgaacccgggccgcctgcgtgagtaacttggggcggccaggagcacgggaagggcgccagacagagagcctttggctgcttctgagaccggctgtgggctgccaccgctgagcggcgcggaggctgcagcgttccctctcaggacagaaagcaggcgttggggactgttactcgcagcctgccaggggcagcagccgccccaggttcaagtggctatgtgccaggatactcaggcgcggctgttggctgcccatgggagagccagtgctctccgcaggtccaaagtgcaaggccgggctattcccggacttgcctaggagcaggggcccccagcgcgtctgggattgccccggcgcgtcgggcgcgcgaacttgtgcgcaagggagaagagcgcttaccatggaacatggtctgcgggaggcgggcgtagtcatgatgaccgcaactggagcaggagcaagctctcaccgcccatagtcactcccaggaccctggtcttccgcggagttgccgagtctgtgttgggcagggtgatctctgcagctggttcctcttacccacgccgcgactgcagtttcatccatcccaaggggggcggcacacactacggcgtggctctgcgctttgccttttccataacttccgtaggatccgccagcagtgtactttcagtttctactttgcgcttggtctgcaggttcaatctttgggatcatcagcatggaatcttcattatcccctctctcctgggcacctgcttcccgcgcacctggatgaggaccagaggaattcgcgaatttccgaatcaccgcaggaaaaaccagctggcctgaatcaaagcaattctgggtaaaagacttcccagatgatctctcaacgccttggcaacgcttggcgactgggagctagaaccatgagttgttaatgtgtgcacggaagccacaagtgtgcaggacgcaagctgggttattggaagcggacgacaccaaggaggcgttgccgcggatgt

SEQ ID NO: 1806 - DNA, 72752 bp, Homo sapiens; identical to SEQ ID NO: 1805

SEQ ID NO: 1807 - DNA, 72752 bp, Homo sapiens; identical to SEQ ID NO: 1805

SEQ ID NO: 1808 - DNA, 72752 bp, Homo sapiens; identical to SEQ ID NO: 1805

SEQ ID NO: 1809 - DNA, 22729 bp, Homo sapiens
atctaagcttctctgtcttcctccctccctcccttcctcttactctcattcatttcatacacactggctcacacatctactctctctctctatctctctcagaatgacaattctaggtacaacttttggcatggttttttctttacttcaagtcgtttctggagaaagtggctatgctcaaaatggtgagtcatttctaagttttcttatggattttggattatctgtagcatggtttcaggttattcagttccctaacagacctgagtcaggcactgggtttgaatgcagtttgagaatttcccacatattcagtcattttttttaatgtttaaccaccatgacagggggcaggggatcaatactatgggtggtttataagacctcagtattctcaagaaggaatgcatttcactcccaagtgtagatcttaaatgttgaatgattactctgctcttacaaaaagaatgctcatgtagatgctatgactgtacttgtaggaaaatgtccaaagtaattttaccttgtcaggagatcaaactggattcattttgtttgactttttaagaaatcctgaaagcataactttcaggataaggtaatgtacagaagcaatagctttgtcttcagtgaccagtgctatatcctcagcacctaaatcagtggctagaatatagtagacatccaataacttttgaaagtgttttcaaaatactttagttttgagagatttatgtgagattttaagtaaataactgactagagaaagatctaaatgagtttactcattgaaatacactgaattgcctccacaccaacaaattggccatatgtaataattctttttgggatctaaaaaacttagtaccgagaagccaaccctgcccatacataaacacattgtaattataacaaaactaggcagaagcttctaacagcagcaggaggcatgtgggaatttagaccatcaacttgctcctgcaaattaagccctttctctttaagagttaaaaactatttggctatagacaatatcaaacacatcagcctaatgactcagcttatgcattttgagtcatgtaattacgaaggatggaaatccctagaattttctcattaagggaattgtcagagagtttgacattttttacagtatatgactcactttatgggggatgattattattctatgctaaactttgccttggatttccacaaagactgatgggaggcaggaaacataaatcttactctctttcatgtcatctatactcactagttcaccctggtgatcatactatttttaaaatatataagaatgctagttgaaagctgggttttcactccaactttttaagtttcagattttttagaagatgtataattaccctattcacatgattacgtcaaaatacttcccagtttggggtataggaattcacattcagttgctgcttgttgaaagttgtcaattttctgatcatcacaaggatgatcaagagaagaaagggatactttttaaaaatccaaatcatttacactattaatcaactaactccattcagtaggaagaagacttctagatgacactggcttgcctatgatacatattccacacaatttaaatttttatggataaatatgtctagatacctatttaaatatgaataatattaattattgagcatttaaagaataatagattaactcattattcaaaagctctatgtaatttcaaaaccatagtaattataacaccgtcaattgacataaactttttaaagagaagctcaaatgtttcatgtatattttcagaattagaattcttattttaccttttcattacttatttctcagaaaatattatactcatagctaatccctattaaatccttactgtgttctaagctacctctttgtaaatatccattcagtgattgctcatagcacgagtttacatattagaacacatgtcttagagaagttgcctacctgacagaggaccacaggtagagtatccagaatttaaacgcacatctgtccagctctaacaccacaggtcttaaccactgtgtacattaactactcttagccaagaatttttcagctcacgtcatgtagaatattctttttgtaaaatgccatcacattttataagtcattgaagggaatttttcttggttacaaagcaactctgccccataatatctactgaaaagccagtgagctgcttcctaaaacacagccattttaggtgcaggaaacagtgtataaatggctcattgtatattgtatgctttgccagactgagtggcagtgggagtcctttgttatgtgggtgctgacatctgctagagtgtgctgtctctattgaagaatcgtgaagacaaagccgacccacaggatgtctgaatccaaataataatacatgttctgtgtatagaattggtggaagagaaaatgtcaggacagtgtgaggactgccatgtaaggtcagaaccactgcatttagaaagctaccactgcacagggaagaaatctaagtctacaaaattagtgggctgtctctcattatttcgtgctgtcatcagaaggagggccataccctgctgaaactacataaagagcttttgctggtggcagaactgtgaactggatggattctgggaatggccagaaaaacaaatgcctgtggttgtgagcagtgcccacacccatggtctagctagggctgtttgagatttgttgctttgactgaaccaacctgtcattcaactggttggtccattcacagtcagctttattaactttcccattttccctactgagttatttaagtaaagaaagtgctattcggacagcccttggtctctgggacaatcaactgggatttgattttagtatattctgtctccagtgtaaagccttggaagcatctaatttctagtactgatgaaccaaaaatacatggaagcagtcctaggctcacacttgagcactctgagaatggctttgcttactccagattttctcaggtcccagtgggtgtatattttctgacatatttattccagcctcactttctatcatgtaaaacatacatacaaaatgtagatttcattatagggtctacaaaacagcttaagaaaccaaatactatgtgtgacagatcacactttccaaaagtaatagcaaaaaaaaaaaaaatctggttccccactttcttccagcatcctgctagaatctatcagatactgcgtctatagaagaatctataagaacagaagcagtatgtacaacattcacaggaagtttcaccaaatcggagtcctgccagatctaattttttttccctaatcacgtttgtctcagtcagtagcttaagacaatggaaataatcagtgccacttttaattgggatgcctttttaggcaagggaaagtgacctcttaaaaaagcaaaattctgactgcaagatagctatcattgtccttcatttaagacaaaaaaaatactagggagggaataaattatgatttgtaataaagtgaaaagtgagattaggtagcatggggataatggaaataaagtgtctcttctttgaaataatatgaacaatcaatgtaacaaatgtagcagaaaaaactccagtttaaatacagaaaagaatgtgttcaatgcctctggttctttaactcagaaatatttggaggttacttactcattatgatggattttttttttctattggaaaactctgttagcattgagcgtttttgttttttgttttttgttggttggttggttttgaagcatttttcttgtctttgcccttgggcttttcttccttgaatactacataatccattactatttcatgtctgccacagagtctgctattttattaaggtcatgccatatttcaaaaggatgcatttatttgtttcattaacagctgcatgtttgttcctccccaggagacttggaagatgcagaactggatgactactcattctcatgctatagccagttggaagtgaatggatcgcagcactcactgacctgtgcttttgaggacccagatgtcaacatcaccaatctggaatttgaaatatggtgagggatggtggttttaatggttgcttagacatcctctgtctctcttttcatatgctctttttaatagccacaaaagaaagaatatgtggcctaattaacaaatgttaacatctaaggaattcccaaaggcctcctgaaactccttgtccttcaccaaaaacactcatacaaatctcctctcacggttcagctttcagaccctgagactcagtcaaatgatgctctggatcttggggatcccacatccctcccaacttcatatcagaatttaaatcctgcgtctcctacaacacttctcaccaaaaatctgtttgcccaacacgagacaatccagtgtcttcaagttgcatctgagagttaaactgccttgtttccaatcccaataccagtgcttactagttttttgacctagagaaagttatgtaatgtatctatgcctcagtttcctcacctgtaaaatgagataacctgcctcacaggaaggctgtgatggttaaataatttcatcatataaatcattccaaatagtcggccagtgaataacgagtaatggggaagcaacattaaattataattctgtgaatattgacctaacttctaccatcttgacacaatttgacttcagatgatcctctcaatgtaaattttccaaaaatccacaggaataagttggcattttgtttcacaaggtctcacagaaaagacaaaggaaaagagtctggtttgaaagtttactaaaggtctcagggaactttatcttctccttctccttcatccataagtcatctcttgttgccaagggttactatctctggtgatttgagaaactactctagcttgaaattctgacctgaggctatctccaaattcatatccgaatgacctactttttagttagtgtcctagtgagcaaagtaaatcaagatccaccagtagtaatagaaggcttcctacattccatagacactgagacaattctccacagtctatagtccaaacaagccctgaattccagtttttgtcaatttatgggagcttcctgcatctatttatggagtgctttctgctgcagtccttagataaacatgctgttggacttgagtagtgtactgtgttctctgtctgcctctgttcacttccctaacacattttccaggaataaaatatgtcaaaagaacctgaaccagttcgatgtccacaatctaggctggaaatggattgcactaaaacagccataacaactcattcaaacaaggcactcattttcatgggcaaatcactctcccacacggaggtttgactttggcttctttaaccagctggctggtgggctgagtgttcatcctggtttctcttggccaagctgaggttgacctttctgttcactttcattcacaccatatttgaccacttccttgcccactcaaacatacttaccctttaacatatctcttgacttttcctgtcatattgtaatctgtccagagcctcctctatttgggttttccaattggattcagatatttcagttggaaagggactgccttaagaaagaaacgttttcagtggaaaatatatgtatgagctctttaatagatgaactcctggagttcagagcccttaaaaggatgcccagtttcacaagacagccatacggtcatccttgattgtccattgctcattaatttcattctcaaaatcatgggaatgagctgagaataccattttagatcctccttaaattcccaacagtaccagaaacttgctacaggttggggcctgtaattggatatttcacacatactttccttacaaatatattctatactcaagaattgaactaaaagttattgtcctagtttctccacatcccatgtttacctaaaattcagaaatgggaccccgctcccagtctccccttctatatttatttatcaaatcgtgacaacattaccatcttcagatctttccacctgatgtttgtcctaagcttattccctggtatctgtctagcttacccaaaaattcggtttttatttttatcctgttccaagttgggaaagcctatctaccccaacaaggaacacaactccctagtaactttgagacacacacacacatacacacctactctttaaagcctaaacaatcgcacactctaaaagatagcagttaacaaaagtaacgatttgggagaacagttttaaggaatgtccccaaaataatcaatacatttagccagttaattaacttaacatttcttcaccaatctctagttttcatgactgtaggagcttaaccagtcactctcagaccacaataaaccaaaggtgaaagattctgtaacaaaagctagggcactctcccctgcatttaacctcctggccagctcactcgaagccagacaaacaggttcctctttttgtgcagagtccaggaaccattctcgaaaggactcatttgagcacatgcagagaagagtgtacacacatccagttcaccaagggaagccaacacacattgtgggttgtaggtagtaaaaggccttcctagaacacactccttaggatttaaacaaaattacatcggttaatggaaagaattctttcatatacgcaaacttacccagaggaacttttcttctgcccagatcttcacttccaatttgacccagttatacctctttagagctatttggctgagcttaaacagcacataggaaaaacaaattggtaactgtgtttatcacagaagaggaaaattaaatttagggttgggaaaggaaaataaccctatgatattacttttattctacctttacaatgagaatatatacctttgttacttctttaatttttacattatttacttatttttctttgctttcttgtttgattacaatgcattttaggggtaaaatttatgtgtggtaaaatgcacaaaaattaagtgaatttggagaaatgtctatgacctgtagccattccaatggtaaagatatagaacttatttttcccctagaaggatgcttcatgttcctttccagtcaatcttcataccccaggagcaatcataattctcaattctattaccctttggtttttgccagtttctgatagttcttattaatagaatactctttattcttttctgtcttctttcatttaaccagtgtttgtgagagttagccatgttgatgtccatctcatagctcatcttttcaattgctaagtagtaattccactgtatgaatataccacaaatttttaattctttctcttcttgatgaacatttgtgttttttcaagtttgagactattattttttaggttgctgttcacattcttggacaaatcagtttgtgtatatatattttcatttttctggggtataaaacctcagaatggaattgctgtgtcataaggtaagcatgtatctaagtttataagaaaccgcccaacagtttttcaaagtggttataccattctactctccttccagcgatgcatgagagatatacatcatttgcaacgtttgactttgggatagtatctcgttaggtttttaattcgcatttgtcaaataacaaatgttgagcagcttttcatatacttggtcttttgcctgtcttctttgggctagtatctgttaaaagcactgagttatttgtccttttgttattgctggatatgagttctttatacattctgtatacatttcctttgtcagatagatgtattgcatctattttctattctgaagtttgccattttattttcttactggtgcgttttaataagcaagagtttttttttattttgatggagtctaatatatcatttattttcttttatatgtagtgctttttgtatccttgctaagataactttgcctactcccaaagttgggaagatattttctcatgttttcttttaaatgttctacagttttagcctttatatttagtttttttaattattattatactttaagttctagggtacatgtgcacaacgtgtaggtttgttacatatgtatacatgtgccatgttggtgtgctgcaccgattaactcgtcatttacattaggtatatctcctaatgctatccctcccccctccttccacctatgactggccctggtgtgtgatgttccccttcctgtgtccaagtgctcttatcgttcaattcccatctatgagtgagaacatgcagtgtttgattttttgtccttgtgatagtttgctgagaatgatggtttccagcttcatccatgtccctataaaggacatgaactcatccttttttatggctgcatagtattccatggtgtatatgtgccacattttcttaatccagtctatcattgatggacatttggcttggttccaagtctttgctattgtgaatagtgctgcaataatcgtacatgtgcatgtgtctttatagcagcatgatttatactcctttgggtatatacccagtaatgggatggctgggtcaaatagtatttctagctctggatccttgaggactcgccacactgtcttccacaatggttgaactagtttacagtcccaccaacagtgtaaaagtgttcctatttctccacattccctccagcaccttttgtttcctgactttttaatgatcaccattctaactggtgtgagatggtatgtcattgtggttttgatttgcatttctctgatggccattgatggctaatatccagaatctacaatgaactcaaacaaatttacaagaaaaaaacaaacaaccccatcaaaaagtgggcaaaggatatgaacagacacttctcaaaagaagacatttatgcagccaaaagacacatgaaaaaatgctcatcatcaatggccatcagagaaacgcaaatcaaattgtgtttatttgtttctcttgtcttatgcattggctaaaacctcctgtacaccactgaatagaaatggtgaaagtggatattcctgtcgtgtcctggtcttagggaaacaattcatgttcacaatttcagcactaaatatgatattaactataggcttttgtaaatgctctttatcagattgaggaagtgtctttctatttcttatttgctgtgagtttttaacatgaatagatgcattcatgttattaaattatgctttgaatgcattgattgattataaccaggttatttatgtcttctagtctgttaacatggcaaattatattgattaatttttgaatctttaacctgctttggtttcctgagatgtgccctactttataattatgtattaaaattagtgtgttagtattttcttgtgaaagtttgcttatacatttttgagggatatttgtctatcaacttcttttctctaatattttggccaggtttgggtaccaggattaagctagcttcaaaaaataggttgagaagggtcattcctcttccagtttctaaaataatttgtgtcagattgacactatttctttccttatacatttgatagaatttaccagaatataaccatcaagcatagagttttctttggggggaagtttattgataataagtttaatttctttgagagaaatataactgttgaaatattccatttctatgtgggtcagatttactaatttgtgtttataaaaacattttcattacatctaagttattatatacattaaaatagcatttaaaatttccttattatacttttaacatctgcatgttctatagtgatatctcctcttacattccagatattagtaatttatatattttgttttcttaaccactcttgttagggttcaccagccaaaattacctataaaaatccattacgttacccatcaagtatatgtgatattatgtatataaccctttatactatgttatcattttctttaacactttttttaatcaatattttttacagctcttatttcttacatatattcctatggaacatcaaaaaaagcaattactttttaatctaaacaaagtatttgtttttcagtgatcaattataaaaatatagaaatttcccataattttataaatatgtcttgactatttcaggttcaattgcatctaattctaagtaaatcatcactaagtatcatagcagcagaaagccataagattttaattcattatctctcattcctgaacatgcctccactcacccacccacatacctatgaacagagttaaagtcaaacatacatcaatgtgcatatgatactattccactgcatacaggaactcctacctgaatcaagacatatcccctttttattcctacagtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactataggtaagaagttgtatataaaagtatggttgtcacttttgggctacctgaaaacactgtgtctggacattctgtaggttaaaagtagacaaatagtggaaacaactggcaatagataatagctaattccctactgtaaatttttataataaatgaaaagcttgaaatttatactttcctgcagtgaaagaattctgaggatcttcaaacccaggtgtgaaagatagtgtttgtgcaaacctacatgaagtggctaactggagctgggcttcctgtcatccatcacaggtgtcctttccttccttatctgtcctttccttccttacctgtccttctcccaaattccttgtggtcttctccccaaatccccacaacattctgagtaagtttagctaacttatcaagttattttaaaaagcatatatgccttctctattagtcagagttttctacaaaaaaaaaagggaatcaataggaggatagatagatagatcattgataggagagatttctattaagaaattgacttttgtggttgtgggaactggcaatcgcaaaaatccataaggcaagccagtaggctagaaattcaggaaagagtgcagtattgagcctaaattccgcagggcaagaaactcaagcagattttctgtattgtactcttgagacagacttgcttcttcttcagggaacctctgtctttgctctagaggccttctactgatgaggtgatgcccaccacatcacggaaggcaatctactttactcaaagtttactgatttaaatgttaaccatgtcttaaaaatacttttagcattccctattcgctcccccttcaaccctcaaaaagaaaattaaaggtaagagagcaatactcattagagataagaaagagtaagaaacctagctcagctttgtctcagttttgtttcactaagatgataaaatagagaggtaaagcagaagttccatgtgtgaacaattaacttgtgaaaaggcaaatgtagtagaaaagagacattaggcagatggctgtgcatgttggccacacagaagcagcattggccatgaccagtgtgggtcctggttaggggaagagaactggctttgacaacaacagggtatctctgaggttataaaaagttgggttctgatcatttggagatgaggtccctatggatagggcaccatatctaaaggttcaccatttacattgcaaatatacattcagttctctgagagtgagcagagaaggcagaggttctcagtcttctgacaaggtcctggagcatcaggggagagcccattcttacaaaactccacaccagcatgcaagcccttacatgcacataagcactcacaacacaccaagagcctccaggtgacatctgccacctccaaatccccatatcccacatgctcaatgcacttgcagtctccatcccccagcagactgcaaatctgacatgcctcctccgaacggcaagggggagaggtacgtatggtacacacactgctgatggcataggcccctttggaaggggtagtgtgagtctcttggggctatggcaagcacccctggacaagcaggaagagaggtggtggaggcatgtctcacggtagcatctccttctaggtcctaatgggacacttcattaatggaactaccatttaagtgagtttaaactggatgcttctgattgagccccagagccagtgctccactgccaccacctgcaccctcacttccccttgtttaagcatcttccaacccagtaaggctgaagagggaagcatcctgccttcccacttctcttagcagagtagattgatatgattattcagattgtacaagaatctattccctctgaagtattgcttgatgaatgagcccctttttctaatttgctcaaagaaatcatttgagcttgaggaaaactgtccagagggcacgaggaccagccgttgtgatatgtaacaaggtagagaaacaaaagctaaatgaagaagagtgagcctcagaatcaaagaactggatttggatccctttaaaccattttacaggggcctgaatgtaattaacttctctgaaattcagtttccttatcaatatgctggtgataagtgactattgtttgaagacagcataagcaaagcatgcagtacttaggagatgtgttcttccttcaattcctctattattaaaagatgggcacagggcaggggcttcagctcagaaggccttgttgagaatggaatggagagcaggaacaagagagaggggcaaaggcattgccagcattctctgttcggctgttctccacccactgcctttcctcctgcttccctctaagtccagggcattttcccttttgataaacttccccttttacaacccatccaagggtgaaaaacaaagtcattacttttttttcagtacctctaaggcaaagcagcagaaacaggcagtcaccactacgaataagtgactacaacaagagctaggccaaactctgccatgtgggctgcattttattgggccggcaagtaactttaaatcccagctcacactctactgagtgaaagtctgatgaacccgcatcttcttgtgaacaactgcgcctgagatcagtcatgcaagaagtagcacccccacccccagacaactaacttcccaggctgtgaccaacaagcagccaagaggccaggacagggaagtctcaggacctttctaggaaatcaatacctttctctgggtttgttctgcctgaaataataccaatctccctccaacagcttagcatgtgtggagcatttgatactaacagcaaccctgcaaggcaggaaggcagtagggagaggcccaagaggaattcagcattaaggcagtgagactgacagaggggaccccctgaggacattctggaaggtcttagccagggccaggatgcagacccttcatgtcactgtagctgagacgaggtgcaaggttcacagcatataacctaattttattacaagaataaagactcagagtttaaatactcctgctttggggctcattagtaacaagttctccaatattcaaaaggcaaagtggatgtgttttagtgtaaaattaacactagctgctgtaacaaataagcccccaaacatatgatatctcaaacaccgtaggtttatttctcactcacatcagagtcaaaatggatgtttctaacctgcagctggggcttctcccagcagtattaggggcactttccatcttgtggctccaccgtctgtaatgcaggactccaagtggtggaagaggacggagcagaggagtcacacatgggtgtgtgtctggcccagggtggaagtggatgtgcatttcttctgcccacctcactcacaaggccacaccccactgcaagagaggctggagaatgcggactggatttaaacccaagaagaagaaatggttttctgaatagttggccatttactgacacaaaaagggtcaaagtgacttgcagaggagatgaattttaaatactataattatttccttggctgccctttagacagaatttatttctttttcttttccagttaaacctgaggctccttttgacctgagtgtcgtctatcgggaaggagccaatgactttgtggtgacatttaatacatcacacttgcaaaagaagtatgtaaaagttttaatgcacgatgtagcttaccgccaggaaaaggatgaaaacaaatggacggtatgtagttcaactacattaataaaataaaaacttatgaatgttttctattttgttggcctagtagtgcatttcccctgggagggcccaacaattttgctttcaaaatctaccttctactgaaagaatctcccaatattggccccatgaaaacctggatcttccctgatgcatactcttctagctctggttgttttcttctgctctaattttggtcttcagaatgtttctacattagtgagttggataacaatatagattgaggccaaattaatcctctgtattcaggggcctcaaaaagtgtcatgtctagtgccactttcataggcaaatcaggcaaaatgtatatctgcttatgatcaccaagtcgtagccacattctggcttatgagattcatgggaccagcatgaggtaaagaaaagaggcataatgtttgcctttgttttgtttttattttaaagcccaaggtctttgtttttgaagtaacagcttaatttttacccttcataatcaggagagttacttagatgctctcttcatgatttgttgaggttggaatgatttggcagtccctgaaatttattttggggaggaggtggcagaagagtggagtgtaccaggttatgagatttctcttaacccaccaacctaacttctgttctttctgcacctcagagatgaagaagagatgatgatttctcttcctcaagtccttcttattcttgctgtcctgttttttcaggccaagattggccttgtttgtttgcagtgtgatgcaagatgccacttgcataaatgtaacaactgccccaaaccacctgctccctccttctactcacccaccccacccttgatcctgccatctttcattattcatctgaaaattgcaccaattgaaaagcaacttagtggagaaaggaaggattatgaataaatgctgccaggacaattagttaactaaaaagaaaaatagataaattcaataaatacatgaatttttttgagatggagtcttgctcagtcatccaggttggagtgcaatggcgccatcttggctcactgcaacctccgcctcccgggttcaagcaattctcccatctcagcctcccaagtacctgtgattacaggcacccgccatcatgcccggctaatttttgtatttttgtagagctggggtttcaccatgttggccaggctggtcttgaactcctcacctcaggtgatctgcccacctcagcctcccaaagtgctgggattacaggcataagccaacacgccagccaaaaattgttttaattaaaaaaaattaaactaaatgcctagccaccttcatataacaacaacaaaataccagatgatttaaggaaattatataaaagtgaaactctaaacaaattagaaaaattatagccaaatgtttacataatcttgacatgaagaagaacattctaagcatcaaagctgtagaagaaaagaaaggattgagacatgcaactacataaaaagtggaggtttatatatgtcaacacacacaataatcaaaaatcaaaaatgcaaatttaaaagtaagcttaaattgccacataaacagctgatagatggttagtatcattaatagataaaggactcttataaatcattaaaaaaacaaatatcacaatagaaaaatgagcaaaaaaattgggaaaaatctcataaagtatggaatagataaattcaataaatatatgaaaatgaactaattatcaaataaatacagatataaatagcaatggacttctttttatctgtcaaattgatagagtggtttttttttaatcttaaagataatacactgtgtggtggagacttttgtctctttatcactattcacaatgtaaaatggcgtctttctggagagaaatgattcctgctcactaacctaacctaacctttcatctccccttaatatgtgaaaggatagagagaaaagaagaagatattgaagtgtggaaagggagatcctgggcagtgcctaactcacctgaataagacccatcatttcactctcctccttgaccactcacaacatcctttataagctcagattctgtccctaattttgctgttgactcctttacgtatcagagctccttattctaacaaatacgagacaacttcagagaatgcttatgggactaaaggaatcccaattgaaatgatttgggagatttaggcaacacctcttttcccatcctaagaatgtaactgcactctactctctagcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggtaaggaatggtggtagagtttttgttccctcagagtgctttgcatgtcaaagtgtgggagcaagtgagaggaagattgttgaaactaacctgcaaaataggacacccttggagggcactcttacactttctttggagaatgacttgcctgctgtctttgcgccttttgtgaagaacaaggaagcagagggagtggggtccttattagctgagaattagtacaagccatctgtattcctggaagctgccatacattttgaacaaaatccccacccactacgtccagttaaccaatttagcctgggaccccaatggctgctgtctctaaggcccctttaagaagcacctttattggtgtcaggtatgcaggcaagtgcggctgtcctatgtctccttttccagaaggatgaagatgtctttgggactggaactgagaatgtgtaggaactgagacatctcctccctaaaatttgcaacaggggtgaacatccctctcatcatctcctgctctggcttcttttccttggtagaaagtcaagaagggaagagagcattggtacctttgatgctagatcacgtttacatttcaagtggcagatgctctgggcctggtcacccaagtcaatgccttttaaaccaaaatccctccataaagctgtcaaatatgtctcttaactgaaaagcaactttcaggaaataataagtgggcccacattactaagtaaatgcaaagcaccctgagaccctacccccactgcatggctactgaatgctcaccacaatctattcttgctttccaggggagatggatcctatcttactaaccatcagcattttgagttttttctctgtcgctctgttggtcatcttggcctgtgtgttatggaaaaaaaggtgaccttcttcaactaataaagagggtgattgtgtgggatcacggacagtcagagcttaagccccatttattgatgagaaaaccacaaaggggattaaggcatttcacgaatttagtgcccagtatccctatctatcctcagcgaatttccacagttaatttcataagaggcaaaaagatattaactggacattaggcaaacgctgtccccaaagtaagaattccgtaatgcaatgtttcccaagcttttcttccagtatctcctaaaggttgcagaagccatcattcatggcaaatgcacaatgtacttgaagtcttgactttaagcatataaattcatgggattttttatactaatccatgctaaggctatgtttgtttcatcataaaaatgatgttttaaacatgcacttgttaaattacttactattctaggagaatgcccttggcagaaggctacatatccccaggattacaaataccctaatttgaaaagtactgcctggaaagtactaagcaatttccctgggtaatttgaaaatattcccccacttccaccaaaattagctgccagagttgctgtcagtaaagagaagaaataaaaagacaacacttaaattgggagtaaacaacggggttaaatttacttccatagctgcaccaaaattacctccttgcaagccttggtgttccttccctctagggctttttcccagaggtatattattgtcatgtcttgttcacagaatggattgatatctgtggtctctggtccaacccctccttgaattgatagggccccgaggcccagagaaagccagtctcttgaccatggtcacccacctaattgtgttagagccaagactagaaatctgttcttctgattccaagctcagaataagtgggaagactcagtgtgcctgtgccctctgccattcacttcatctatcaatgttctctgatttcaggattaagcctatcgtatggcccagtctccccgatcataagaagactctggaacatctttgtaagaaaccaagaaaagtgagtgtttttggtgcttaaaaagtgttgtgttggcaacatcccagtggccaagaatgatattccaggacaaggaacagttgaacctcaccttttggtatttgattcatcctgtaactagggtccctcctaagaccctagctgcagtagggaactgaaataagatacacatctcagaacttctgggctccctggggctggagggcacagccagtggtcacttcaagtcttgaagtgtctcagaagctccagaagcaaagagtccattgaggaacatgctggcaattctgtgacattccctgtcagaaaactctatagacctactcctgaactgaacatttgatggtgtgtctctctggtgccatcttaataccctttctcctttttctgtgcagaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcatcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagcacagagaagacaaaattagcaaaaccccactacacagtctgcaagattctgaaacattgctttgaccactcttcctgagttcagtggcactcaacatgagtcaagagcatcctgcttctaccatgtggatttggtcacaaggtttaaggtgacccaatgattcagctatttaaaaaaaaaagaggaaagaatgaaagagtaaaggaaatgattgaggagtgaggaaggcaggaagagagcatgagaggaaagaaagaaaggaaaataaaaaatgatagttgccattattaggatttaatatatatccagtgctttgcaagtgctctgcgcaccttgtctcactccatcctgacaataatcctgggaggtgtgtgcaattactacgactactctcttttttatagatcattaaattcagaactaaggagttaagtaacttgtccaagttgttcacacagtgaagggaggggccaagatatgatggctgggagtctaattgcagttccctgagccatgtgcctttctcttcactgaggactgccccattcttgagtgccaaacgtcactagtaacagggtgtgcctagataatttatgatccaaactgagtcagtttggaaagtgaaagggaaacttacatataatccctccgggacaatgagcaaaaactaggactgtccccagacaaatgtgaacatacatatcatcacttaaattaaaatggctatgagaaagaaagagggggagaaacagtcttgcgggtgtgaagtcccatgaccagccatgtcaaaagaaggtaaagaagtcaagaaaaagccatgaagcccatttggtttcatttttctgaaaataggctcaagagggaataaattagaaactcacaatttctcttgtttgttaccaagacagtgattctcttgctgctaccacccaactgcatccgtccatgatctcagaggaaactgtcgctgaccctggacatgggtacgtttgacgagtgagaggaggcatgacccctcccatgtgtatagacactaccccaacctaaattcatccctaaattgtcccaagttctccagcaatagaggctgccacaaacttcagggagaaagagttacaagtacatgcaatgagtgaactgactgtggctacaatcttgaagatatacggaagagacgtattattaatgcttgacatatatcatcttgcctttcttggtctagactgacttctaatgactaactcaaagtcaaggcaactgagtaatgtcagctcagcaaagtgcagcaaacccatctcccacaggcctccaaaccctggctgttcacagaaccacaaagggcagatgctgcacagaaaactagagaaggggtcataggttcatggttttgtttgagatttgttgctactgtttttctgttttgaattttcttctttgttctgtttttactttatttagggggactaggtgtttctgatattttagttttcttgtttgttttgttttgtgttgtctgtgaatggggttttaactgtggatgaatggaccttatctgttggcttaaaggactggtaagatcagaccatcttattcttcaggtgaatgttttactttccaaagtgctctcctctgcaccagcagtaataaatacaatgccataatcccttaggtttgcctagtgcttttgcaattttcaaagcacttccataagcattccttccacctccttgataggcatttatggaaagcctgctacatgtcaatcatactgttaggcacaggggacctaaagacacataaaaggatggcattctgcctcataaattgcaaaacctaatgaaagtgactgcttggtaaacaaattattattatattataaaatgctataaaagagccatattgaaagtgccctgttggagacagggcaaatgccacaaaaatgatgtaaatttacatggaggaaaagtagaatctgcctggtttgtaggcagcagaagacatttttcatcagtgggcaggtgttctttaccttttgtagaaatgggagtcaagtctcaaataggaggctccacaaaatctcatgccaggtctctgataccttattcacagaagttctttgaagtatttattgttattttctttgacttatgggaaaactgggacacaggaagacaggtaaattacccaacctcacacgttaagtcagaactgggagccataattttgtatccctggtataaatagacaatctcttgaagaaatgaagagatgaccatagaaaaacatcgagatatctccagctctaaaatcctttgtttcaatgttgtttggcatatgttatctttggaatttagtgtctgagcctctgtctgttactgtagtatttaaaatgcatgtattataatcatataatcataactgctgttaattcttgattatatacctagggacaatgtgtaatgtaagattactaattggttctgcccaatctcctttcagattttattaggaaaaaaaaataaacctcctgatcggagacaatgtattaatcagaagtgtaaactgccagttctatatagcatgaaatgaaaagacagctaatttggtccaacaaacatgactgggtctagggcacccaggctgattcagctgatttcctaccagcctttgcctcttccttcaatgtggtttccatgggaatttgcttcagaaaagccaagtatgggctgttcagaggtgcacacctgcattttcttagctcttctagaggggctaagagacttggtacgggccaggaagaatatgtggcagagctcctggaaatgatgcagattaggtggcatttttgtcagctctgtggtttattgttgggactattctttaaaatatccattgttcactacagtgaagatctctgatttaaccgtgtactatccacatgcattacaaacatttcgcagagctgcttagtatataagcgtacaatgtatgtaataaccatctcatatttaattaaatggtatagaagaaca

SEQ ID NO: 1810 - DNA, 30600 bp, Homo sapiens
cccgccccttcgcggcgcttcctagttcggctggttcttctgtcgccggcttcagcagcccgcgcccgggcaggtaaggcattccccgccttaatgcctcggtcaaacgtcgtccgaggtccgcttccaggcctcggcacctctgccccagggttgctggggtcggctgcggaacggaaatctctttatcatccgtgagaaaagttagagaggaagtgggttcctttgacagagcttactccagaagaaagacttgggtaggtccccggtaatcaagaagttcgtcggccctgaggaagagcctgaggcttggagggacgtcacccagctgttctggggcgcagtcggacctcaagtttctcacctctcaggccctggattccgtgaacccgactgcgaaatgaagtctcttttccccagaaccaggaagtcaggccagcacctgacagatgcctgtggcgccagcagctcgctgagcctccacacgattgtaattcgcttgtttctccggcctccaagcttccagggaattagaaagtggaggcggcttatgggatcagatgagtacattcgcagatgggggaaaaaagtgtacctgtcagcttggaagccagagggagacaaagggataaaagcaaaccctgtccaggtgcggtggctcatgcttgtaatcccagcactttgggaggcccaggcgggcggatcgcttgaggtcaggagttcgagaccagcctggccaacatggtgaaacccctgtctctactaagatacaaaatttagctggcatagtggcgggcgcccgtaatgccagctactccgggggctgaggcaggagaatcgcttgaacccaggaggcagaggttgcagtgagccgagatcgtgccactacactccagcctgggcaacagagggagactccgtctcaaaagaaaaaaaaaaaaaaaaaagcaaaccctgagaaagcgagaaagcactttgagcatttagaatgggaacaaacggcgctattagtgcttcaaaaacgtaactgcccaaggcccctggtaagcagaggatactaaaatctgccttttccctttcttggagtggtccttgaagagggctatcgggaagttcaaatttcttctgttttcctgcagagcgttcatttgaagtttgctttctacctctccaaactgagcttctgatattccaggccaaacttgctccttcctcagccttctctatctcagtaaatatcggtaaacttggttatgctgtcttctcactctccacatcagcccatagctttctattggctccacctcagaatcctaggacttctgcacttgctctgctacgaccctggtcccagcctgcagcacgtcccacctggcttattggtaggctctcctaaatgcttctttcttgcttctctgtccttactccaacatcctttattcccagcagccccagtatccttctaagacatgagtacagagcatgtctcttttctcaaaacttccagcatctacatctcacccagaggataaacaaagtcaatacaaaaactctaaggcccttgaagacctggcccctttacctttctgacctcatctgctacttgcctgttccctcctctgcagtctcaccatgtccttgctgttgcccagtgggcccagttccaacctttgcatttacatttcgttttgtccacaaacttttcccacagatagtccagtggctggctttctccttctttttgacctttaatcaaatggcaccttcttattgaggcttcctgtgactaccatatttataattacaaccttttctctatttcgttttgttctttcatttcacttggcaccatctaacatactatagagtttatttatttgcttattgccttccttcctccattagaatataaactccatgaattcaggttttggttttgttttgttttttttctctaattttcctaatgcttcatctccaggggcctggagcagtatctagcacaaagtagacactcagtaaatatttggtgagtcaatggtattatattttgttttttaaatatatgcaaagcattttcaattacttactgttgtgttggatcaatgttcaagaaagatatgttaagtttaatttatggtacaccagcacatatcccagtttgtaataggcagccctatctaatttaatagctctggaagccctcaccagcttttgttcataatgatgatgttaaagtatctaaaaataaagattaatggttatacagcatattttgctaagaatatatggaagtaaatagtgtattttagaaaggatataaatacattaaaattaccatggttgatcaaataagacagccaccatctcaaaagcttagctattttctcagacttgttatttgtacgctttcagtagatcctcactactgttctggaaattgaacctaaatacagtctgcacatatctttaaaaataatgtgatataagaataatttctgccaggaaataataattgctcctttttttttttgaccacctattattatgtgacaagatttggccctttgcatgtgttgattttaattcttacagcaattcttaggtattactatctctgtttttcagataaagaaaagcaaggtgcagagaaatgtatttactagctctggtcacagttggctttggttagaacttaggcctgtgcaacctcaaagttcatcttccctccacccctgcacaatcttttcctctgatcaaagtgctaatgaagcagtcttaaaactttattaacacatttgacaagaatcttttgccctcctgttttgggcacagtactttgggaaggcattggattccataagcaggtgcttattttaatatatttctcaatcaccaccccaccttttacacttgtctgaattgtcttacttgaaaatatgaatgggttttctttactatgagagttagtggtatgaggaaacagtcatgaaggtatttacttatttgtaagcaacatatcctgttccacctgtgttaatcctaagtgtactaaagtaaatcttgaagaatttgaaagagatgacactttttaagtttttttttgcccagtctgttttcattattgaaaattcagaaaagcaaaatgaaaacaaaactatcataaaagtcatcaccaagggataaccacgttaatattttggcttatgttcttgtaagtatgtggttgggagtggtatatgaatatacatttaaagtaaaattttaatttctgggattttgaacttctgggcacatgtgtggaggagttgcagaaggccttctttttcctagtatccctacacttatcacctctgctggaagcctgggtgcaggagagctaccaaatttatccctggcctttagatagtctgggttttttcctcaattccttgtattttgctctaatttataagactactaagcagttctatcttgtctagctttgtcaatcatgttgtaccttacagtagagagaaatcttagtaaggaaaaataacttgaagagagcaactgcagagtctataggcaacctagatacaatttcttaattaaagttaaaaagtcatcagcctttcattcaacacaaatgttgtgagtcgttgctgaggtgaatttggttgggtcctagctcaggagagcacccatctaacagagaaagcaaacacataaacagtaaaacataataattattataacagaagaatgactaggtgacattttggagcaaaagagatgacaatcaggggaagctaacagtgccttttgaattgggcttgaaggaataataggcatttaccaggtggcctttaaggtatgtgggctattcttttacctggccctagatgacttcatttcctgtttcacagaaaaaataacagtatgtgggaactcttctcccttcaaatatatctgtatttaaacctctgcttccttctttctagattcaaaagaggtttctctctattcaaggctgatttcttcaccctatatgctattcattatcccatttgtattgccaaacagcttaagtcttaaacccttaacaccaacagttctcaaaagtctggttggagtccctaatgctctttcaggagatttgtaaggtcaaaatcatgtttagttaaaagattcattcagagtgcaatggattttaatgttccaagttaatttatacagcttcagattcctcattgcagcttacctttaggaagttatttcttgtcaaattttagtgtagtatcaaagagaaatatctactactttgtgaaaaggctattaaaatacacctttctttataactatatgtctgtgtgaagctggattttcttcatatacatcaaccaaaacaacatgctgcagtgggttgagtgcagaagcagatacaagaattcagctctcttctattaagttaaatattgaagagattagcaaaactttaaaacaatgttgttcttctgtttttgaggaaaaggtaattattttattaaaatatatatgctaacatctatatttatgattattttaaatgaattaataagtaatttttaagtttctcagcatcaatttattatggtaaatattggtagatataaccaacataaacaaaagccctttggggtctacaatagtttttaagagggtaaaaggtcctgagaccaaatttgaaaactgctactctcttgcatgctctcctccctctctttccctacccctccacccccattttccctcccctcatactcctctctctctctttctccttcccttcataaccagacttcttggaaaatctgtttttgccattcactcactttttcactatagctgttcccaagtcaccaatggccttctgatttcagagtctaacatatccatcagtgtctatttgacctctctgagtcttttataccaacctgccaccttttctagaagtctctggtatgctaccatcctggtttttttcttgccttcatgactaagcagtattttttaaaattcttctttcacatcattcctttccattctaagcattcctaataggcaacctcattttattgttgcttcaactgtatatgtgtatatgctcttaatttgtatgagggcatttcaaaaagtttgtggaaaaattgaattaaaagataaaaaatgtaaactttggctcagcactatggctcatacctgtaatcccagcactttgggaggccgaggtgggcagatcacctgaggtcaggagttcaagaccagcctggtcaacatggcgaaaccccatctctaccaaaaatacaagaattagctgggtgtggtggtgcacacctgtaatcccagctacttgggaggctgaggcaggagaatcgcttaaacctgggaggcagaggttgcagtaagccaaaattgcaccactgcactacagcctggatgatagagcaagactccaaaaacaaaaacaaaactgtaaactttatttctgaacataagcccatgaagttcaagacacttttgtaagcgataacaccagccatttgggccatccctaaagaactgagagtcctgggaatttaaccacatcaatgaagtcttttttacattattaactgaagaaaaatgggtgctctatgaagatttttcaagattgggaaacaaaaagaagtcagaaggagacaaatcaggactgtaaggtggatgcctaatgatttccagttgaaactcacagaattgcccttgtttgatgagagaaaagagcaggggcattgtgatggagaaggactctgtggtgaagctttcccaggtgtttttctgctaaacatttgactaaagctgtaacagaaaagctttagtttagaaacacttagaaaagctactgtttctcaaaaccctctctaataagcagatgttaccattctttttccctccagaaagtcagcaagcaaaataccttgagcatcccaaaaacctgcagccatgcccttgcttttgactgtctgcttttgctttaattggaccactgccactttgggggagccattgctttgattgtgctttaggatcatactcgtaaagtcatgtttcatctcctgttacaattttttgaggaaatggtttaggatcttcatcccacttgtttaaagtttccattgaaagctctgctcgcatctgcagctgatctgggtacaacagtttgggcagccatcaagtggaaagtttgctcaactttaattttcagtcagaattgtataggctgaactagttgtctatggtgttcactgttggttctgctgttaattataggtactcttcatttagggcacaaacgagatgaatgttttcctcgaaaatcgatgtggatggtctgccgcagcaggcttcatcttcaacatcatctcatcccttaaaatgagttactgatttgtacactgctgattttctgggggcattgtccccataaataaagcatcagtgatttcaccattcttccaaccaacctccaccataaatgtggtgtttgttcttgctttagttttagcagaattcatgttgctgtggtagaggttcttttcaaactgtcttattcttctcagtgtctcaactagatcctgtttagacatgaatgataagttagtatgagtttattttggaaatacattttgcaaaaaaaaaaaaattgaaatccatgcatggtttttgcacgatatgcattttccatgaactctttgaaaaccccttatatatgagaatacttacataatgagcattctttgctgaaacctctctcctaagctccagaccacatatataagtacttggtatgaaggctcctagatagtgccaaaggtagatatttcacatttaacatgagccaaaaaaaaaaaaaaaacttcattctatctccctttcttctaatcgctcatctctagtgaaattgttttgatttggcctcctaaatgttttgacgttttacctctccattcccctaccctatactttttccaagctctcctttctgctcacctggattattgcagaagttttcaaactaattttcttgcctcaatatacatccctttgatttttatccagaggaatccacttaaccatataagattatttaacatccctcctaaaaatcctaaagtggctctcctgtaacttttagtttataagttcaaactctttgtcttagcacatgaggtacatgatgatctggccctgctacctttccaccctcatctcttctcacttaatcacaggcatcctgtggtccagccatagcaagctctttgcctgagacacacatgctcttaccttttcccatgctattccctctgcctggaattttcttttgggcttatcctcattccctttcattcatccttccaacctcctactccaaccaaatctgtcttgatatccctattccagactgcctctgcttgatgccccttttctgggccccataacattcttgcagcatttatcactccctgtcactgtttgtatcccctggtatactgaacagcttggaaacaaagattttctcttctctgtgctcccacttgttagtacaaagactgacataaatattttctgaatgtattcatgaatgaaaggaaaggaatggtctttctgaaatagagaatggcatgaacaatgcattgtgttataaaagcagagttgtatggcatgacttttggagtcagacataattgtaagtcctggatctctcacttaccacctttgtaaaatagagatgataaaactgtactgggaaataatttagttgttccaaaagtaaatactgaacaataccattatctacagtatgcaagtcactaggtgtatattcatgaataaaattagcatggtcctgaactcatggatcttaaaatcgaatatgggagacagtaaacaggtaaacaaataagtatatgattacaaatacattgtgcagtgatgaaagataattaggtgaagggcagctagacctatttagatgtggtcaaagaagtccaaagagaagaagtgaatactaacatagaagcctctgatacagagaagcttttcgctttttactctttttgatagttttagaatgttgttccatatgaacacattatttactctaaaattgtatttttaaaatatatatagggaagcaaaaataattgacagaagaatatctgagtctatttgtcttaattggaaggaaagatcatttcctattgagaatgagggacacgcagaacaaataaaatccacatagaaagaagtaaaggtatgaaatagtcactaaggactatgagagaagacaagtggaaggattaacggcagtgttgaaggccctgtggaaagggggttaccataaatttgtattcacatcagcaaccctggtgtacaagtaaagttgttagatttatccctggctgcagctctccaggatggagtagcagaagtaaagggggattgcagaaataaagattctgtctagagagtagttgaagtggtgaagcacaggttttggcgtagtagcaaatgaattgtggtcaggcagatctcatggactcaaaaaatgtgcagaggtcaaggaagagcaaagtatgtgaaaagtgggtgggtggaccatatctgttaatgctacacaaatcatttcagtacgttttttttttttacttctaccaaagaatgttgcataaattttaattgtaaataagtactaattgagaaacataaattgaaaggtaaatgtttttattaatagatttgatttctgaatatgctaattctgatagtttgttgatattactcttaagaatttttctggtaagttttttgcccctttctataaattttactaggaaaatatcagtgtcagaaaaaagtcctccgatttttattgctattaatgggtggaaaaaggaagcaaacccagaggataattggacaaatgaattacaattttaatttcatcttaggatatcaatgacttgactttggaatgtttctttattatggtataatcagttgctgacatttcatatgatatagcaaagtgtgatatataagcttacagatgtcatctctaaaagtactgtaaaattttaatgagatttttccatattttaggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataaggtaacagataaaattctttgtatttttaaattcttacatcacaatatggaatgattaattggtataagtactgtctaatgtggcagtttagaaagtaaacctctccactatggaggagacattggtagtaggtaacctctttttgattgttccttttgcagttttgtcttctttgtcccatatgtcaatagggctaatactgtgatctctcaaataagttttttgggttagaatcaagattcccacctttgctgtggttccctgtttggcaagccaagtgaagttcactctgcctcacacttctcatttccagattgaaggaaaataagaatgttacaagaatgtctggtaaaaatctagagcttaaatttcaaagtgtgtgaatctctaacacactctaacaatgtattttgggactttttcaatttgacgttttaaagttgttgcttacaagtgtacacttctgtgcacagaattcttaaatcttagctaggatttctcagtgctgtcttcagataatttcaatttttcctttttactcatctctgctcaatttagtgtaaaatatgcatgcatattttatttttgtcagtcattgcagttaaaacctatgtcaaaatgtttctttggtagcaaaaggaaaagaagactatttgttattttcagcattaatctgggaaagaacctaaaagacttggctcccttgcaggaaatatttcctcataagaagagcgaacatgttaaattacttgaaagaagcttaagtttaaactgtgttaagccaatgtttaaagataattttttgatattactgttaaaaacttatggaagataattggggcagtggtggcaggaagataaagctcttctcttttttttttcttttttccaagactcattcctgtgacagaaaaagcttttctttacagaataatacctgcaaataattgtgaaaagaatggtagaatgagaaaaatacctatttgcaaccaccaatgagtaactgattcatgcaaggctcatcactgaacctaaaagcataaggtgaaaggtggttgttctcgtgcatgtgagcaggatatgcacaagattttaaagtattataggctgagcacagtggctcatgcctgtaatcctaacacttgtggagaccgaggtgggcagattgcttgagcccaggagttcaagaccagcctggacaacatggtaaaaccccatcactacaaaaaattagctgggtgtggtagtgcacgcctgtagtcccagctacttgggaggttgaggtgggaggatcacctgagcccaggaagtcaaggctgcagtgagccatgatcatgccactgcactccagcctgagtgacagagcaagaccccctcaatagatagagaaaaagtattgtacacaaattacttgtgaagtatgaaagagaagggtacatttttaatgaggaaatctgaagtacacttccttcaccaagtgatcaaactttagcaccaataataatggtacaaaatgctaatatgtacccctggatgtgatacaatgggaaaggcacattatacctatgtagtatttctaccaaaatgcttaatctgaatttaatcatgagaaagtagtcagataaatctaggctgttagacccattctataagacatctggcccgtattctaaaacacacacacccacagacacagattgaaagagagaatgcacaagagcccagatatggcacaattttatcaattattcaattggtgaatctaggtgaatggttgttcattctatcattttttcaacttttctgtaagtttgaaatttttaaaaataaaatctttagaggaaaaacagaaagaaacaatattggttaaatttttaaatgttacttttcaaaactaatttttgattttaaagaaatggaaagaaatgggttgaaagccgactttgtgatttttttcaatttaattgaattacagttaagatcaaaggaataatttcctaagtttttgtgtgttctgtttctttaattaagcaggtgcatttattaaaaattatatagctatcagagtcttaagtcatgtgggaagtaatattgctagtagattaagaatacactcttttgtcaaatgagatctgaatttgtacctcaacttggatacatcatattggctgtgtggctatgggctggttactctacctctccaagcctggctttttcactagtaaattcatatgataatcataatatctttgaacatgctcatgtgtgtgcatcctataacccactaagtaaatatccagtaagtacccagtaaattattatcatcatctttggcatcttttttcctcctatctttcctgtctctctgtaattcttgctggttctcttgttgtcccttttctttaatgttgtaggagatgctgtgggcaaaatgggcaggggagatcaacacctattttcatatgacctcagtttataaatgctattgtttgaatgtgtccccaaaagttcatgtgttagaaacttaatacccattgcaacagggttgataggtgggacctttaaagggtagttaggccatgagagctttgcccttatgagtggattaatgtcgtcatggcaggagtgggttagttatctagggagtgggtttctgataaaaggataagttaggccctatttttctttttctctctctctctttttttttctctttcacatgcacgtgtgcatgctcttttgcccttctgcccttccaccatgagatgatgtagcaagaaggccctaaccagatgcagcctctcgatcttggacttcccagcctccagaaccgtgagccaaattaactattatttataaattaccctgtctgtggtattctattattgcagcacaaaatggactaagacaatagactaattttgtttctttgttacttacttttaaggagatttgaagcattacttcaaactggaaaaagtcccacttctgaattactgtttgactggggcaccacaaattgcacagttggtgatcttgtggatcttttgatccaaaatgaattttttgctcctgcgagtcttttgctcccaggtaaactgattgtgaccagggtgtccacaattagggtggaaagacaaatggcagaaatataaatgtttcttcttactcttccttttttctcatagtagatgaagcttacatttgagagtccctttctttcagcactcctcaactctttaaaaagcagcacagacaaaggacactgtggactctgctgctaaggtgatagaagcttcgtaagagttagatagttttgtgccaacaggaagtttagaaggaaagacttcatacttctggcttaggctgtaagaaagtaattataattttgagttcttcctttttttcatcttcaacttctaccctgatgggactctataatcataattttaaaaaattgtattctgatgtggtagtgtctagttgccttccttataagctttctttttttcctttgatgcctttcacaccagtggttctcaacctttatcatgcataagaatcacttaggttctggttaaacatgtagtttcctagggtctgttccaaatctatgtaatcagaattctggaattgggtttaaggtctatattcttaaacaggtgcttcagtgcctctgatataggtggctcatggatcactgtttgaaaacactgccttactctctttacccatcttcattataacttacagattcttactaggcagcttcttgtgtgtgctgtgagaatatgagaccaacctgtagaaactggaatgatattaaatgaaccaagtttctagtttaactttttcacaaccactttttcttactgaaaaaccacttgtatcttacttcatttgttagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgtaagtaacattttcagtgctttccactagggatttgtcattaagactaccagtgctttaaaagaaagctcttgctcttttgtttgtgcagcaatcacaggcacactggcaatagctcttttgtgagttgtttcctcctgatatattaagaaccatcttcattgtattaatcagtgattagaggcaataggacatgcaaacaaccagagaagctatgaaaaaaaataagtaaatatttacataacttggaaaggtcactttttaaaataaaatatgtgactagagttttgggtaggtagactagacccactcaaatgtgtgactagaattttgggtgggtgactacagtgttcagagggtaggatcaccaaacagagttctcaagaaaaacttataatttgtattttagaaatggttttatcttctctcatcttgtctaattcaaaatcataaatatttgcatatatgtgaaatcttcaaatgagaaaatattataattattaaaacgaatttttaaaatttaagcatgtttttcttattttgacataggttttcacagtttttcattttatgaattgaagaatgtcacaaataactttgatgaacgacccatttctgttggtggtaataaaatgggagagggaggatttggagttgtatataaaggctacgtaaataacacaactgtggcagtgaagaagcttgcagcagtaagttatattttcaggaataaaaagaaagagttgcttcatagtgtgccctataataggttttaaagttaatctttaggaaatacattatttcagtatgtattttctttaaataaacatcattctaaatagtagttcttaaaattttaaaatctgttgaacactatggaccctacccctagaaaaatgtggttatgtccatgtacacaagatcatacatacaattttgggagattcacaaactaaagttgagaagccctgctccacatagtgcttcatgtgtaatcaagattaaaatggtaagataccaggaaaactatttttaaaaaaccttgtttgcattacttttcccatttaaaaataaaatttaggaagtatacattaagaaaaaacattaaaattttttttatctgtgtcctttgttgccatttctactgaggtgtttaccttttacttacttgttatattctaaatcttttgttagagcctaaaaatatcaatagaatgcatatgtatgtgataaagatagtcactctttgtcatatatgttgcagggcttttgtagggtttttttttccattttgcacctaaattgcttatgttttctgtttcctagaatttttttcaaatttttttgtgtagtgaaatttcgtgttatttcattttgtttccacaactcagtgaaatttatatatatttttcattccactaaccagccatgggccttgagcaaatcactagtatttctagatctcagttattctgtagaattgggagaataatacactattgttttaaagaaagggagatgagccagctgatctcttgatccctctgagcattaggaaccttagaattgtgtagtattacattgtatattttattttttcagatggttgacattactactgaagaactgaaacagcagtttgatcaagaaataaaagtaatggcaaagtaagtcttaatctggcagtgcggtgtagtggaaagaaaaaagacaaggagtaaagaacctggttcactctagagtatgccatgaactagtgatgtttgcacatatatgaaattaaaataaagtgtttagattagagaaattgaaagtacttttggctccataattctatgattacatatactcatatgcctggagattaaatagcagtcatttttatttatttattttttttgagacagagtctcgctcttttgcccaagctggagtgcagtggcatgatctcggctcactgcaacctctgcctcccaggttcaagcgattctcctgcctcagcctcccgagtagctggacctacaggcgtgtgccaccatgcctggctaatttttttctgtatttttagtagagacggggtttcaccgtgttagccaggatagtctcgatctcctgaccttgtgatccacctgcctcagcctcccaaagagctgggattacaggcgtgaccacgcctggccgcagtcattattttaagtcacaacaaagttacgtgaaatttcactatcatgtccttcattatcatgttttccacttccagaattcatgagagatcaattgtagagatacttaaaaacaactatctatagagtaataggcccttatatataaagtagcatctatagagcaactagagtcatgttatctgtaaggatgcttagaaggcattgatcctgtgtgctggaaaattgttggacatcatcaggaaaagtaggagggacaaagtaggaaatgtattctaattattatagtgattaatagtgattgatatttgagtgtgtgcaacatgccagacattgtgctatgtactttatgtgcattgtctgtctaacccttacaactgttacaactgcccattttgtttgttaactgagatttagaaacattaaatagcttgtccaagatcacatagccagtaagtgttagagatgggattgaaatccagatctgtttgattgcggagcctgaactttagatctgaatcgtaatgggatttaccaaattatacccattaaacccactgctgtaaatcaccaatcatagttacctaacctcaagtaagaagaatagactagaattgatttatgcacggtaaaaatgatacatgctgaaaaaagatcaaactttttttttcaggatttgtcttcttcactcctacccctactctccaattctaaaagtaacttgttcacagtaggtcatctggaaaatacaggaaaacatttttaaaatatacaagcctatatgcatgcaggacttaatacgtaggtgatgggttgataggtgcagcaaaccactatggtacacgtttacctgtatgacaaacctgcacattctgtacatgtatcccggaacttaataatacaaaccatctctcaaatatatcactcagagataaccactgctaatatttttatatacttgcttcatgatgtgtgtgtagcattttcccatgtcactaaaaataatttgaaaacattttaaattattgtacaacagtctagcatatgtgaaaatcatattttatttaaccatagctaggtttgtttctaattttcagtattaaaaataaagcttctttaaagttctttgcacataaatctttaaatgcagttatacttactttatcatctagggtaaagtcctagaaaaagaattactaggtaggaatgcatgaactttttaaagactttctaaatacacattcaaatggcttttgagataagttactaccagcaatgtattacaatttcaaactttactggttccttaccttcatttaatatcattactttttttttttttttttttttttttgagacggaatctcgctctgttgcccaggctggaatgcagtggtgcgatcttggctcactgcaagctccgcctcccaggttcacgccattctcccgcctcagcctccagagtagctgggactacaggcgaccgtcaccatgcccggctaattttgtttttgtatttttagtagagacggggtttcaccacgttagccaggatggtttagatctgacgtcgtgatctgcctgcctcggctgggaatacaggcgtgagtcactgcgcccggcctattattacaattttttaataagtgccagtctctggatcttactagcagaatgaacttggccaagttttttaactttctattcgttaattttctcatctataaaatgggacaatagtacttacttaagttattgtgaggattaaataaaacagataaatcacttgccacactgcctcgtttatagtataaattcagcaaacgttaactactcatgtttaaaatgtgccagtttggtggaaaatgggacacttactgttttaatttgcacttcttcaaatatttatgagactagaagaaattgatataatgaactgctagaattgtggatcattttgaatgaacaaaatgaataagcacttaaataataaaacacttatcatgtgccagatacgtttctaggctgtcatgtttacatttgctcatttaattgtctcagcatccatattacatactgttttctgcatttagcagataaaggagctgaggctcagtaaggctgttaacttgcggtaggtcacatatccaggagggggcagaactagactttaaatttaggatgtataactctgagccctgttttctttcgtcttaccacagatgctgccactttattagattgtaggtctctttagttttattactctcaagtatataaagacactcaaattaggttataaataatccagtgtgattaaagatcaaaaacatgtaaattagatgtgattcaagatcatgtctgtaaatcagtgctttgagtgtgttagaaaattcttgacagtattagcataaaaattcaacggacttcttgaaatcttatttgtgccatcattgaaaattgggctaaagaaagtgagcatcagcctagtccttaaccaaacttatcacaagttccaaaaatctgaattatttagcttttactgtaaaatagaaagaggtttggccagctgtagtggctcacacctgtaatcccaatactttgggaggccaaagtggtaggagcacttgaggccagcagtttgagaccagtctgggaaacacagtgagacctcatctttacaaaaaaatttaaaaagtagctgagtgtggtgtacaccagtagtccaagctacttgggaggatgagttaggaggatcacttgagtccagatggtcgaggccgcagtgagctatgattacaccactgcactccagcctgggcaacagagttagaccctgtctcaaaaaaaagaaaaagaggttttacttctaatgttgattaatactggctgaaaagagaagtatttgcagaaaattataaacagttacaataaacatatataaacataaacatcaagttagaaataatatataacatactatttttttgctctttttttctattaaaactttgaataacttccaacctatagctgaatatatatttattataataattttgcatgaaaaattatttgtcacaggtgtcaacatgaaaacttagtagaactacttggtttctcaagtgatggagatgacctctgcttagtatatgtttacatgcctaatggttcattgctagacagactctcttgcttggtaagctatttgttcatcagattgtttggctttttgtttatatgctggaatattaatattcattttgttactggattatttaaaccaaattcactttcatatttttcctgctctatgaaaattatacagttgatatgtcaacaaattatacagttgatatgtcaacaactgggttgccattttattaggtggtaatcttaaatgtagaattcagttaagactatactaggaagatgcttttatatatttttatcttcaaataacaaatgtaaacacccatttgagcttatttagatattatttttaataacttaaaaatgtagtcctaaattattaatgctataacatcatcttcagttgttgcctagaaaaatattctgtgttatatattctctgtagattttttattattctttctcatttttaatttggtttatttctttataaggatggtactccaccactttcttggcacatgagatgcaagattgctcagggtgcagctaatggcatcaattttctacatgaaaatcatcatattcatagagatattaaaaggtaaatgctactgtttaaaagtttttggaaagctgtctttaaagaataatttgctgtcactctattcacgattcatatgcaggtcttaacctagagcatctggacttttttcccatcactccatgaaagctcttctcaataaggacatctataatctcctttattccaagcccagtgacctacttccagtactcatcctacttgaccttttttgtttgttttaatagtagtttattctgttcttcttgacacttttgccttatggaaattagttgttttcttagtttatggatcactattcttttctgaatcaccttcatcctccatgagtacttttcagttctctttctttcttgtgtatttatctagttaaatatttacctactataagtaacatattcatatatagagctcaacatcaatcaaataagcacaaaataattatagaatgttaatatgtacagttcacatatatattatatgtattattattatatagtatagtacataggattaatataaagaagggtttccaagaaagtgacatttaagcagagattcaaagaatgggcaggaaataagtagacacaatttgagggtaactgtagaatggatgatggggagaagaacattctaggcagaaggaactgcatttgtaagaccagtggtgagacagaatatgggagcatgatgagttacaagaaatgaaatatgctttgggagccaagataggaggatcatttgaggccaggagtagcagacctgactatgttccctgaacaacatagcaagacctcatctctacaaaaaaactagtcaaacgtggtattgcatgcctacagttccagacactagggcagctgaggagggaggaggcttgagcccaggagttcaaggttgaagtgagctatgatcgtgccagtgctccccagcctgggtaataaagtaagactctgtctaaaaaaaaatgaagtaaatgcagtatgactgagatgcagaaagttatagggtggtggattggagataaaactacagagaagtgtaggaagctaagtcctataggacttaatagatcaaggtaaggcttttagttttatcacaagtgtaatgagatgccgttgaaaattttaagtaggaatatggcatcatatttaagttttgcaaagatgattttaactctagtgtagagaacagtttgtaagaagaggcagttagtaggctatcataggtggcagttcataagaagagaggggagcagattagaaagattaaaatggcaaaacttgttgataccttggctatgcaggggttcaggaagagcgaagtatcaggaatgactcctggaataatggcatccagacttgcattctggaatgattatggcatgattcacttatgtagaaaggactgaaaaaagacttggttaggttggggttagagagatggttagaaaatgtgaattctcttttgtacatgttgtgtttggggtgcttttaagatgtagtagtagagatggtagacagtgtgatatacagatttggagctggaggtctgagctgaagatataaatgtgtattacttgcatacaggtgataattgaagtgactgtattcacttgaggggagatgtagattaagaaaaggtcacaagattaagtcttggggaaccctaagacttaatggccaaatagaagagatgatcacaaaaaggaatctaaggaagtacacatacagagaagggtaagatgaaaacctggagagtgtggagtccctgaaaacgaggaaagaaagtgtttcccaagagggagtagtcaaaaagagtcaagggctttaatcattggattagcatcaccatggtctttggtgactttatggaaacccatttccaggtagtagttggtttagaaatcacattgtagttgagagagtgagagctagagaactgagataggagtatagacaagtcttttaagacattttactagtgaaggggacagctagaaatagataagtcattcaggaaactttttttaagctggcagagattaagctgtgcttatgtgcctataggaaggatccagattaaaagggagaggatagtatggaagagagaaatgagatgatgtgttcagtagggttactgagaatgtagaaagcagctcaagcagaggaactgaccctagatgagaaaagaaacgccatctcctatccttcatggattggtactttcttgtgttcttatatcattgtctcttttctccctgtatgttctttttttttttttttttgagacaagtttcactcttgttgcccaggctggagtgcgatggcgcggtcttggctcactgcaaccgtcgcctcccgggttcaagagattctcgagcctcagcctcctgagtagcttggattacaggcatccaccaccacgctctgctaattttgtatttttagtagagatggggtttctccatgttgatcaggttggtcttgaactcccgacctcaggtgatccgcccgccttggcctcccaaagtgctgggattacaggcattagccacccgcctggcctctctctgtatgtttttgctgagtgatattatgttaattttaactgctacttatatgtgagtgtcttttgaatctgtattattagcttccaatcctggatttttagtatccccgtaccaaaaacacttcatctgggtatcccacagtagcctttaagtcagaacattagaaatcaaactcatcagctcttcccaacctaaagtcttcccacatttcctttctgatccagtgaagtcactgttcattctgtctctcaaactgaacacgttctcattctctatatcatgctaattacaaaattctgttgtgtgagcctcaaaattttcactttccatttatcccatgttatgaccatttaaaccctcattatctcccatttgctttgttacaaaccttcgtagtcaacctaaatccagcctatcagttctcatctattcactaccacactactaggtcatggtcctaaaagttaagtctaataacatcagtttcctactgtgaaaactttagctggtatcctgttgctcacaggataaaatgcaaattatctccatgtttcttggacactcgttccttgaagttgaccatgtataccatatcatgtttttgtcactttgtacctgttactccatttgcctggagtgcctttctttccctcatataactattaacttctaataatccttcaatactaagcacacttttcaccctctgtttgaaatttttcctactttttccaggcacatggttgttctctcagcattttgtacctaatattaccattgttttaaaaaattatttatgcctttgtcacagacaagattttaagactccgccatgcccagcagtgagcttaaatactacacaacatagggagttctcaataagattgtgttgaattaaagtatgaaagcacataatgaattaattgagatattttggccatatttttttctcttcaaaagccagatagtacagaacaaaagaataaagaaattcataattgagatactttggttggaaatttgttttgaaatgaattgatacatactaagaaaggaattaataaaggtgccttggaagactttgtagtaatttaccctataataaatgatttgtggaataatgaaaatatctcttactaatgtagacagttttatttcatttttattctcctaaatgttttcctcaagaaacataaaaaaagaggacagttgcttctctttagctataatctgaattctaggtttatttctataaactttaggcttttatgatgcatactataaaacgttacactctgtaaatatgtatgtacatatgcatgtatgcatatacatatatacatgcatacatacgtacatctagctaaggaactgtttgacttttttggggtgggaaaaacatttttttcttcaaactttacatttttttcagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggtaagttccgtatacataattattaaaaataatcattctgctataattgtgaaaatgaagagaatattatttaatacacccatcttgtttatctctcttatgtaacaatataagtttttcacattaacctctacttataccagaaagtttataaaaacttcttccaatgtgtaaaacttttgagttgatttttgaaatgactacaagaaatgattttcttgccatctgtctttatgaattagcatgacacctaatgcattaaatgaatcatgtcatacagtatatactttagtctcacattttttgacatttactaatctacctctctattcccaataacttttaagatagagcaagagataggtgtgggtggttgaagaagccgggggctttttcttcattttattttttcatacgtgtttcatatatggaaatttaacttcatagcactgaaaataaggcatagggctatagaatatgcctaatgtttagaaaataatattctcctaagagccagagtaaattattcttgtgaagaatccccaagaggcaggaaaaggattgggagtccttagaacatatgttgagtggggctgactctttagtaagttgccaatagaaaagagctgcttatggtcatgttggggtccaagatgtccctgaaggagggatggtgagaaatgcccaaagctcatgttctttccactttaatatctaaaagacatagctttgtatagaatgattaatcaaattttgtaagcaagattcatattcattctagtttttgtcttgagtattatatatataatttattaatatcatgtataatatatatattttttagagagacaaggtctcactcagtcacccagactgaagtgcagtggtggaattatggctcgctgtagcctcaacctcccaggttctagtgatcctctcacttcagcctcccaagtagctgggactacaggtgtgtgccaccacacccagccaatgtttttttaaaattttttgtagagacagggtctcactgttgcccaggctggtcgtgaagtccggggctcaagttatcctcccacatctgtctcccaaagtgctgggattacaggcgttagccactgtgcccagcctatcttgtgtattatattaatgattttttttgtcttcataggttttactagaaataataactggacttccagctgtggatgaacaccgtgaacctcagttattggtaaatgaaatattcattttcctcaatccttttttctctgcttttgtagtctaaatttatatggataaatttgacatctaaaaataacattttctattggcaatctttccattggctattacacgacagcatatggaaaaagcattaaatattttcattctcagctctcccatgaagtatttgtgaagcctagaaaagtcacttatatattctttgttctgatttctttgtgggtaaaatgagaatagaactaaatgatttctgaggtcctctttagcttatgtttattttgtgtcacttttggggtggctactgttaataacagtgtttccagcattttcagaggggggaaaaaaaaggcttccattcaaatttctttcagaataaaattgctagtaaaagttatcacttatttctatcatggggtattttatttacaaagttacaataaaaaacataccaaatttgctattgttaggaaaaattcatatcatgtttttcctttgctctcacaccacaacaacaatcaacacagaagatttctgtgaccaaatgcgactgggaagggtttctccccaccaacaagcaggcaatctactttgcagcggaagtcagctggatctcctccaatttaattctgacactacattcctggacatagcatcagagtcagatcccacaggttaagagctcagtccccaagactgccatcccaccagacaccagttgtaagtttaggcctccagaacttctgaccaactgccttcaagttggagttcctatgacctcctctgtgggtatggagggctcaagattgaacccagattgattcactaagttgcagcatatactttacctaagttttccatcgttttgcctaagactttttccttcaaaatatataaaagcctcaaaactttggcttgagtaagaatgaaatgcagaaaaacataagctgtatctcagtcacaagttttgcatttcatcatataatagtgaaaatcataaatctttggagaaggttttactctttcacccattcttaaggtttgactgtgatgtgactctaaagtaataagattttcatacaagcacagtttttaaaaaagtgatcatctgaagaaccgttatgtcactagattctgccgttgtcaaacattttcagaatttatctttgaaagtggttttgaagagtttacatcctacctctcatgaatagtttttttcatctgtattagcttcctaggactgttataaaaatataccaaaaactgtgtgacttaaagcaacagaaatttatttgctcatagttctggaggccagagtctgaaatcaaggtatgggcaagactatgctctctctggagactccagagagaatcttgccttgctcattggatgtagggcttacctccaggattagccataatctggaatgatctcatctcaggatacttaattacacctaaaagggcccttcttttcctaataagatcacattcacaggttccaggaattatgacatagacatgttttgggggaccatgattcacccaactccacgatcttattcctacacttctctccctgttaatttttttttatcatggcctgctccctattttttcccctccttttttctctttgattcaacaaccttagtacccatagagaaatttgttgggtacagggaggaggagtcagggtccaaaagttggaattgcgctattagaagcacatcaagaagcagaccaccctgtgctgcccacctagtaaatgctgctaatgggaacatataagcaattagctcataacatagatataaaaattggaaggcaaatgggtggaagtatctaggaggtataaataattaaatatacatttgtatatatatatgtgtgtatatatatatatttatatatatatatatacacatacccagccatgtgttgcctaatgacaggaatacattccgagaaatgtgttgttaggcagtttcattgtgtgaacctcatagagtgtacttacacaaacctagatgatatgacctacgacatacctgggctatatggtattgctcctaggctacaaacgtatgctatacagcataatactctcctgaatactgtaagcaattgtaacacactggtaagtgtttgtgtatgtaaacataaaagaggtacagtaaaaatacggtattataattttatgggaccaccatctatatgtgatctgtcattgaccaattgaccaaaatgtcattttgtggtggatggctgtacttatttacataggatttgtcctgtatgtcttcaatttttttttttttttttgagacagagtctcgctgtgtcacctaggctggagtggcgtgatctcggctcagtgcaacctctgcctcctgggttcaaacgattctcctgccagccttccaagtagctaagattacaggcatgcaccaccatgcctggctaattttttgtatttttagtagaaacagggtttcaccatgttgcccaggctgggtcttcaattcttaataaggttttaagataagatagtaaaatgagagcacatgttattacaaagtagattaatttaaataattaaaatatatattctattttctttcactatgatttgaagctcttaaagttttaacactcattttaaagctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggtatgcattttttatacttatttaaaaagtgaaaggggtggggttcatcatattttccagagtgtatattttaaagcaactgtataatgtggttcttttgtttttttctttctttttaaaaggttcaacagctgctgcaagagatgacagcttcttaaaactttattggaaaagactcttgactttttatatacacctatctcaaccatttttttaactgatttttttcctaaatattcttctttacctttaacaaggcataggctgttgcaggacagtggttattaaagcatgggttgaacttccaaaatataaaaatagagccaccatatcaacacttagccctacccattagtatcacccccagttcttacagtaatccctgagaaatctccttcaagcatcaccaaacacagtttgaaaattacagggttagcaaaaagagcctgggctgtatgtagggtggaaacactctgatctgaagcccagctgactccactactaatttgctgtaaagctttggacatacacttagctgctgtgagccactaataacattgggctaatatctgctgtgcttctctgacaggtagtcatgaaaatcaaatgatgcaaaatatatacaagcactttgtaaattgtaaaatgatacaaaatttaaagtttatagagccagttacaaaatcctattagtcatatatttatagattgtgttcacagcaatcatttaaccacaaataaaatatcccttgatgatactgccataatgatatgtccattattagattatgttacatgacaaagttgaaggaatttggcagatgcagttaaggttcctaaacaactcactttgagactgttgaaagggcctgacctaatcaagtgaacccttgcaagaagaattctccttgtaagccttgaagaagtatgtgagagggccacattggctaaaacctaaaggtggcctctaggagatgagacctaccttccagttgtcagcaagcaggaaaaaaaaattgggacctcagttgcaaccacaaggaactgaattctgccaaaaatctgagtcagcttagaagagtactccaagcttcagatgataaccacagcctgggctgacacctggatttcagctttgcatgatcctcagtatgagaatctatctgttctgtgctggacttctaatatatagaactgtgagataatgggtcacattggctggatgtggtggctcatacctgtaaatcccagcactttgggaggccgaggcaggcagatcacctgaggtcaagagttcaagaccggcctggccaacatggtgaaaccccgtctctactaaaaatacaaaaattagacgagcgtggtggtggacacctgtagtcccagctacttgggaggctgaggcaggagactagctggaaccagggaggtagaggttgcagtgagctgagatcgtgccactgcactccagcctgggtgacagagtgagactccatcataaataaataaataaataaatgggtcacattaagcctttaagtttgtggtaatttattattcagtaatagaaaacaaatacagatactctcccatgatgtttttcccatgatgatttcccatgatatttacaggttttgcccacatttgaggggtatgtggaaattatacagagcatgtacagcgggaggcttatagtgtacgtactgaaatgtggggttggagccccaacacagagaccccagcaggacactgcctagtagagctatgggaagggtgctgccaccctccagacttgagaattgtagagccaccagcagcttgcactctgagcttggaaaagccacaggcactcaacttcaaccatgagggaagccacgcaccctgcaaagccacaggagtggagctgcccacggcctcgagggcccaccccttgcaccagtgtgccaggatgtgggacatggaatcaaggaatatgttagggcttttttttttttttttttgagacggagtcttgctctgttgcccaggctggagtgcagtggcacgatctcggctcactgcaagctctgcctcccaggttcacgccattcccctgcctcagcctccccagtagctgggactacaggtgcccgccaccatgcccagctaattttttttgtatttttagtagagatggggtttcactgtgttagccaggatggtcttgatctcctgacctcgtgatcacccgcctcggcctcccaaagtgccagtatttaaagtttaatgtcttcccagctgggtttcagacttgccaggatcctgttgcccctttctttagccaatttctcccttttgggacaagaatgttttacttattgcctgtaccaccaactgtatcttggaaataaataacttatattttatttcagaggctcataggcggcaggaacttaccttgagtctcaaatgagacttaggacttttgagtgatgctagaatgagttaagactttgggaagggatgattatattttgcaatgtgagaaagacattagatttggggggctgggggtagaatgacattgtttagatgtttgtctccttcaaatttcatgtttaaatgtaatccccagtgttgggggtggaggtggggcctgatgggaagtgtttgggtcatggtggatgatccctcatgaatggcttagagccactggtgatgagtgagttctcactcagttcgtgtgagatctggtggcttaaaagagtctgctccccctttgccttccattgtgattgtaaccttcctggggccttcatcaaaggccaggcaaatattggtgccgtgctagtatggcctgcagaaccgtaagccaaaacaaaccttttttctttataaattacccagcctcagttattcctttatagtgatgcaaaacgggctaactatataaatttgtaatttttaagttatagattgtttttattaaacacttatgaatactgtt

SEQ ID NO: 1811 - DNA, 30600 bp, Homo sapiens; identical to SEQ ID NO: 1810

SEQ ID NO: 1812 - DNA, 30600 bp, Homo sapiens; identical to SEQ ID NO: 1810

SEQ ID NO: 1813 - DNA, 30600 bp, Homo sapiens; identical to SEQ ID NO: 1810

SEQ ID NO: 1814 - DNA, 30600 bp, Homo sapiens; identical to SEQ ID NO: 1810

SEQ ID NO: 1815 - DNA, 6307 bp, Homo sapiens
tgatcatagcaggaaccagtttattggttgaggtggtggggaacaggggggttggaggcacaccatgaggagcgagggctcagctctccccagggccctggaaatccatgccctccaccaagtcctgcaggtaggccttgtactggtcggaggtgagggagagtgggtggctgttggaaatgtgcaggtccacagtattctccagggaggaggcaccccctacccgggccatttctaccaaggccctgaggcacgtgggcacaacctgcaggggaagtggggacaggagtcagggaaaacacccagccactgtccaccaaggtaggagtcagggcttggaggactacaactccctgcagcccctgctgtaacctaggatgaaccataggcctagggctgctgggagttgtagttttacacacacacacacacacacacacacacacacacacacacacaccccctgctgtaactgaaccataggcctagggctgctgggagttgtagttttacacacacacacaaacacacacacacacacacgtcagggctgagcagtctgtgatcttgactcctgggagccacagccatggcctcacaatggcagctaaaacttgagtccaccagcttctacatggtttagagcaggggtccccaacccccctacggcttgttagggaccaggttgcacagcaggatgtgagcagcgggtgggggaatattactgcctgagctctgccttctgtgagatcagcggcagcattagattctcagaggagcacaaactctatcgaactgcgcacgtgagggatcggctgctccttaagagaatctaatgcctgatgatctgcagtggagcagtttcatcccgaaaccacacctccctgtccgtggaaatattatcttccatgagactggtccctggtgccaaatagtttgggggccactggtttagagagttcaaaacaggttctgcaggtgaggccatgggaaggagctcccggggatgaaaaactggttattgcagagatcttggaagttgcagttttttagagggccctctgggagttggagttcctgggagcaacctcttccctctgtaaggccacccctttcagccccagggactcaggtctgcaggcaccttgaccatcacgagcctcttggtccacggctggtcctggggccatgactcccccacacagaaccagagggcatagcgtggtgagcgtccgcttccttccgtgaaggtaatcagatctgggggcccaggagcctagtcagggatgagaagaggaccctctacccacccttccccgtaaacttgaatgataacccccaccacctcccctgacctaaggccctctgctgcctcgaccaggggactgcttgtttggggaaagtcccctccttccctccctccctccctcccatcagggtggggttgttggaaggccacacccccaagcccccaagcctcagcattcataacaggcccagagtagggggcccatgctcccaaggatgctcagtgaatctggagaagctggttggcattcagtcctgtctgaggctgcattgtccaattgcagccattagtcatgtaaggttatttcagtttaaattgtaaccaattaaaacgaatcacgtcctggttgcactcgcctcacctgagtgcttggcccctgtggctagtggctgctgcaccggacagtgcaggtgactgtcatttccatcatggcagaaagtgccactgcacagcgaaaccctaagggatgtagctttcctgctattggtctgttcaccatcattagttacgatgatgatgacagtggcagctaattccctgagcaggctctgtgtactgggcctgtgtctcaccccagcgctggcaggcaggtagagagaggagaccatccttggattccacgggctcagggcaaagtcctttgcctcggttatacagcgggccaagggcagccagcgtctgaattcagtcctaatcatgagttcttttttttttgttgttcgagatggagtcttactctgtcaccaggctagagtgcagtggtgcgatctcagctcactgcaatctccgcctcctgggttcaagcaattctcctgcctcagcctcccgagtagctgggattacaggcacgtgccaccacgcccgactatttttttgtatctttagtagagatggggtttcactatgttgaccaggctggtctcgaactcctgaacttgtcatctgcccacctcagcctcccaaagtgctgggactacaggcgtgagccaccgtgcccggccaatcctgagttgttaaccactgtgcaggctgctttgtactggccaggtcgaagcccctgtctcactcacctacaatgaagggccccaggtcaaacacgcctccttccttgtccttggggacctcgccatcaggcccatgcccgctgttggggagcagctcctcgctcactgcccagtatgtgtggcagtgccccagccgctgggcccagagccactgcccggcccgccagagagccagtcccccacccaggcagctcagcacatgcctcacgtagctcatcactcccctgtctgtcagggacatgccagggtctggcagtgtgactggccatccaggcagcgtcctgtctcccacttcggaccccaccagccgcaggccctccgggcaggagatggtctgctggaagacttggcggccccggtagaaggctgtcacctcgaactcccactctgagcagcggcagcagcggcatgaaggggagaggggttgagaatcaggggctgccgcccagacctcagccctcccagcctgcagctgacactcaccttcccccggcaccaacagccgcttcagtgggttctcagagggccccaggtttgggaagggagtgggattgtccaagctggggctccgcaggggctgagggcagggctcaggggctacagccaggcttgggggtcccggatctgggagtggggccaacaccatgttacccagtaactcatccagaatgtcttcctggagggaaacaaaaaaagagaatcaggcatttccatatccttttctggagacttcatatggaccaggtctgttctcagcaacgcagggaggtcaggcttgagctctgccttcaaggggcttccagcctggggacagagccagccatggcatcaacagccaaacaaacactaatgaacgccaggtgctaccattccaacccaaggatctggctctatgcaggtaagacctgggcaaagcaggctgggtagaatttcagaggggatgctcccccagcttgggcctcagcaggatcaaggtgagggagtttttcagttcccaagaggctgacagccccctgcgaatcgaaatccatgaaatcccgggaaggtgtgctcgggccttgaatgctgggtgaagacttggaattttctcctgaggagaccggggcagggacagacagggtcagcactggctcaggtgaggggcaggctggaggcaggggagtggggggatcgtctagagggagaggacaaggcccatggagacaggtcggagactgaggggcatgaaagttgggcacattctcacctgggtatcagaagtactgcctccaccattggtgtccggagaggtgtctggctgggaaaagtccccaactcctgttgagaaaagtggtgaggggagtaggagtgccaggaacccttggggccccagcctcccacacgaaccccaagctggcagacctgagttcacaaactcgtagattttatgtgggtcgtgagggtccttgctccggtcctctgctaaacgcaacccttctttgcggttgagggcagagcggaaattcctcttccaggttggcaggtctggcttatccctcccgggaacatatgcaccagtggcctcggcccaggcctggggcaacagtggtgtcaggatggtgggggaggacgacttagatcctgctcctggggccctaaccctgtctcccgagtcctaacaccaccctctttccctggcaagttctaactctgcaaggtccatccccaaatccccccgtcccacctacctccatcccccacctctagttttcaaaaggctttttttctttttgagatggagtttcactcctgtcacccaggctggaatgcaatggtgcaatctcagctcactgcaacttccgcctccccggttcaagcgattctcctgtctcagcctcctgagtagctgggattacaggtgggcaccactacacctggctaatttttgtatttttagtagagatggggtttcaccatgttggccaggctggtcttgaactcctgacctcaggtgatccgtcctcctcggcctcccaaagtgctgggattacaggcatgagctactgtgctcggcctcttcaaaagcctttgaaacctctttggtttttgttttgtttcgcttttgtttttaaagagatggagcctatgttgcccaagctggcctcaaactcctgggctcaagcgatcctcccgccttggccttgcaaagtgctaggattacaggtgtgaaccaccgcccccggcccaaaaaccttttctttctaagccaggcttccaagtccaacttggtgtctaatcccgtgcaccacctgccccgcgacaccctctgtgataaccccgcccctcacactgtttaccacctctggcatatactaattcggtagttaggaacctcagatttggggctccaggcctcacctctgatgtttcaagaaccatcccccagtatctatcctacaaccaagagccccggcctctagaaagccccaaacccccaggatgcatttcctttgcgtactaaccggctttcccggttttattcccgtaaccctgcagctccaaccctgcttgcgccccaccatcagtcagcggatccggctagccccgcccctcccgttctagccccacccaccagcgttggcacgagcccgcccctcgcgcgccacctccgccttctcagccgggcccactaggagtcctttccgcccagcgcgcagctccgggtttccagcgtcccaggtcgtcgcacgcacctggaagattccgaaatcctcctgctgtgcatcctgccgtaggccgtgcttccaagggatgcggaagcgcgtgcggctcttgttcacccaggccacgccctccagttgccccaggtccagctgcgacaccagccagggcaggatccgtggctttggggttcccatggtccggcctgcgcgtatagggcatttcctgggcgcgaccggcctcccccggacccacctggcctggagtttccgcacccagacctccttctcacgggccacggcacaggtccttcacccatattttcgggggtacaaacaggaaacctcctcttcccatcctcccatcctcccgagaggctctctaatcagctagggttccttcccatatccatggcacatccttccccagcgtcttcagtgcagaccctccactccctcaattccgccagtatagacctcctccctcccccacatcatcgaaagtaagtatccccactttcagggtagcatcctctttccctagttatttcagtgcagaatcgattcacgtgtaagcctctacctcctgcacttaccccaatgtagacccccttccacagtccccctacagaagatctcccaaaacatttccaacacagaacttccattcaattcccctccgactgcccgcctccctcctccaggacagagcacgccccaggtttcgagactgaactacccccatctacggagtccacccctccctctctagaaccccctcagtgtagacgcctcctcttttcctctttcctccctactttttctagtttttctgcagccgacctccagcgtcggccactgtagctccttccttgctccactttccccagagtacacagcctgcctttccactctccgtgcagacccatcctctttcccgctcctcgctctcggacgccaccaacgctctcccgggctcttccgcgttacctacgatggaaggtcggggcgtgcgggcagctggaacccacccctgtcttggagctccgggtagctctcaaactcgaggctgcgcaccccctttcccgtcagctgagctctagagcgctggggctttctttttgatcgacttcttgaaataaaaccaactttatcattctttgggtaacagacccaaaagccgatgggacggcccgctgggctgttcccgcccctatgcccttttttgggtttcc

SEQ ID NO: 1816 - DNA, 6307 bp, Homo sapiens; identical to SEQ ID NO: 1815

SEQ ID NO: 1817 - DNA, 6307 bp, Homo sapiens; identical to SEQ ID NO: 1815

SEQ ID NO: 1818 - DNA, 6307 bp, Homo sapiens; identical to SEQ ID NO: 1815

SEQ ID NO: 1819 - DNA, 6307 bp, Homo sapiens; identical to SEQ ID NO: 1815

SEQ ID NO: 1820 - DNA, 6307 bp, Homo sapiens; identical to SEQ ID NO: 1815

SEQ ID NO: 1821 - DNA, 6307 bp, Homo sapiens; identical to SEQ ID NO: 1815

SEQ ID NO: 1822 - DNA, 6307 bp, Homo sapiens; identical to SEQ ID NO: 1815

SEQ ID NO: 1823 - DNA, 6307 bp, Homo sapiens; identical to SEQ ID NO: 1815

SEQ ID NO: 1824 - DNA, 3445 bp, Homo sapiens
tgttctggagttctttttattagactgggcggccgcggccagctctaggtgggctgctccagctttctggagttctcattagactgggttctaggcgggctgctccagctccataaggaagcactcgatgtcgtcatagaggctgttggcgctggacaggcagaggctgaggctgctgctatccagggaagacacaccctcacgctgcgtgccctctaggtgcactcggcacagccagggttccagctgccaggagggatcgggcgtctgtcagtgacccggcgtgtgtcctcccctccccctccccaggctctgagggcgtcgggcgtctgtcagtgacccggtgtatggcctcccctccccctctccgaggctctgagggcatcaggcgtctgtcagtgggcctgagcacatggcctcccctccttgaggctctggtctcaccttcaccaggaccaggctcttctccttgggcctcccagctgacaggtcctgcccgaagcccaggtagatggtatagcgtggggagccacggcgctgccgtgcccggaattccaccagctctgaagaaggggactctgctgagtacctggcaggcaggtgctcccaaggacccctggagacagccccccaggcaagggcctcactgaccttggaagaagactctgaagtcgaagatgggggtgtcacagttccgaggcagcaggcaggctggggtggaggggctggcggagcctgggggtccgcccacctcccagtacaccttgcacttgcccatgcgccgggcccacagctgtggcccccgaagctccaggtgcaacccaggggccacgtgccgcagcagttcctccgtgtagcgcagctgcttctggtccgggagctcggcagggctggggaatgctacctgctgggggtctgtggcccggacagctgggtctggggggccgtataggaacgtgcagctcgggtgtcccaccaccttctgcagcaccgtgcggcccttgtacatgatggtcacgtccagcgcccctgggctgggctctgtgtggagaccaagctgtgagtgacgggggtgggcggggacaggctgtgagtgacgggggtgggcggggacaggatgtgagtgacgggggtgggcggggacaggatgtgagtgatgggtgggcggggacaagccgtgagtgacgggggtgggcggggacaggctgccccttcctgggatgcactcaccttgcaccgcggtgcaggcgcttggggagggtgacaggtacggctctgcctggtgcggggactctggggccgcggcctcgcctgcatccggaagggaatcctgtgctggcacctcatccctagcctctccctgtgccccaggcctcccaacccctacccctctcacctgtcgttagtgccgcgggctggggcccggggctgggggtcgtctctactgcccacccgtacagctccccagcagggagccctgggcctgaggaggggaggacagtgggaacggtggtcccctcctaattctccagctccccaatccccagcccccttctaaagtgtccgtccaggtgcactggcccctcccgcgctccccccctccccgggcacgcccacacctccagcacaggccccagtcaggggaagcccttcttgtccctctccaggagccttggttgggactggatctgccccccatgacgctgtcagcagatggtctgccaggcagctctgttgcactgcctggagcaggaggtcccccttgtcaccagctggggcagggagggggcctggggcttggagtccagcatgtgtgtgtgccaggaatggccctgggggcccaccctgcagggaaaagtcagggtgaacgtaagcagctccgcggcctggcaggaggagaggcaggcagagagaagggtacctgtggtggtgggacagctgcgggggcctctgcctcagtctggtccgtgcctgggccttctgagagagaatggggcaggcgttaggccccgacaccagagtgagagatacaaggagagcctggtgtagcccccaccagcttcctggctgtgaacccttaggctgtggcctgaggaggtggggatgtggctctccacctgtcctgggcctgctggcagcctctcccagaacagcttctaaaaccacaaatctgacccagagaatgttcccctttgcccaagcaggacgaatgccaacgcccttggcagccggcgtcgctcacctcgccagcacagctcccggctgagcgcgtacaccttgtgcgggtcggccgggtcccccgagttatcccgcagcatcacgaagcgacgcgtgctgcgcagtgcgcagcggaagttggttttccagccggcgcgctccgcagtctcagcctcggggggcgggccacctcccctgctgctaggcggccacctgccgcgggccacagcccaggcctgaagagggggacagaacacgtgtgccgggcccgcggggtcctaggcgggctctcccacccggggcggggcggggctggggtccccaccttgaagatgcgcgcgtcggcctcgctcaggtccttgcgcgcgaagtgcttccagggcacgcggaaacaggtgcgggcctcgtccagccactgcagcccctcatagcagccgctgctgatctctccaaggagccactctccgaacagcacgcgtggggctgccctgcgggtgcccggccgcggagagtcagggccggctgcagggcgctcggggactggcatctggagagggtgggccgggctcttacctctcaggagccaaggccattgctccttctgcaggggcagttaggtggcggtcaggtgttataacaggggaggtaagggctcctgtcgcagcagacgccaggccgcggccacaggtcgtgtggccaggtgtcacaggtgtccacaggtgtggactgagggcttgtagccaccgacgctgcctcggtatggatctcttggcagagggggctacaggtgtgactgcaggtgtggccggcgcgcacacatgaagtcacaggtgttgaaccagtgtccaggcctggcgggaaggcgcaggccggaccctgcggagacgggaaaggcgacgtcaggggcgggtcaggctcccgggaaagcgaaacctaaacagtggcgcttcgcaccctcctcgatcccaccccgtccggttctcagctccgcggaaccccgcctccgcctccgcctccctccccgcccgaccctcatctctcaggctcccccagctcttggctctacccctccggggtcacggagcccccacggaggctctcgctcccggcctgcaccgcgtgggtctggggtccccagtacctgggtgccagagccgccgggacgggaagtttcgtctcgcggggaagcggagggccggcgcttttatggtggccaggcgggagtttc

SEQ ID NO: 1825 - DNA, 3445 bp, Homo sapiens; identical to SEQ ID NO: 1824

SEQ ID NO: 1826 - DNA, 3174 bp, Homo sapiens
tgttctggagttctttttattagactgggcggccgcggccagctctaggtgggctgctccagctttctggagttctcattagactgggttctaggcgggctgctccagctccataaggaagcactcgatgtcgtcatagaggctgttggcgctggacaggcagaggctgaggctgctgctatccagggaagacacaccctcacgctgcgtgccctctaggtgcactcggcacagccagggttccagctgccaggagggatcgggcgtctgtcagtgacccggcgtgtgtcctcccctccccctccccaggctctgagggcgtcgggcgtctgtcagtgacccggtgtatggcctcccctccccctctccgaggctctgagggcatcaggcgtctgtcagtgggcctgagcacatggcctcccctccttgaggctctggtctcaccttcaccaggaccaggctcttctccttgggcctcccagctgacaggtcctgcccgaagcccaggtagatggtatagcgtggggagccacggcgctgccgtgcccggaattccaccagctctgaagaaggggactctgctgagtacctggcaggcaggtgctcccaaggacccctggagacagccccccaggcaagggcctcactgaccttggaagaagactctgaagtcgaagatgggggtgtcacagttccgaggcagcaggcaggctggggtggaggggctggcggagcctgggggtccgcccacctcccagtacaccttgcacttgcccatgcgccgggcccacagctgtggcccccgaagctccaggtgcaacccaggggccacgtgccgcagcagttcctccgtgtagcgcagctgcttctggtccgggagctcggcagggctggggaatgctacctgctgggggtctgtggcccggacagctgggtctggggggccgtataggaacgtgcagctcgggtgtcccaccaccttctgcagcaccgtgcggcccttgtacatgatggtcacgtccagcgcccctgggctgggctctgtgtggagaccaagctgtgagtgacgggggtgggcggggacaggctgtgagtgacgggggtgggcggggacaggatgtgagtgacgggggtgggcggggacaggatgtgagtgatgggtgggcggggacaagccgtgagtgacgggggtgggcggggacaggctgccccttcctgggatgcactcaccttgcaccgcggtgcaggcgcttggggagggtgacaggtacggctctgcctggtgcggggactctggggccgcggcctcgcctgcatccggaagggaatcctgtgctggcacctcatccctagcctctccctgtgccccaggcctcccaacccctacccctctcacctgtcgttagtgccgcgggctggggcccggggctgggggtcgtctctactgcccacccgtacagctccccagcagggagccctgggcctgaggaggggaggacagtgggaacggtggtcccctcctaattctccagctccccaatccccagcccccttctaaagtgtccgtccaggtgcactggcccctcccgcgctccccccctccccgggcacgcccacacctccagcacaggccccagtcaggggaagcccttcttgtccctctccaggagccttggttgggactggatctgccccccatgacgctgtcagcagatggtctgccaggcagctctgttgcactgcctggagcaggaggtcccccttgtcaccagctggggcagggagggggcctggggcttggagtccagcatgtgtgtgtgccaggaatggccctgggggcccaccctgcagggaaaagtcagggtgaacgtaagcagctccgcggcctggcaggaggagaggcaggcagagagaagggtacctgtggtggtgggacagctgcgggggcctctgcctcagtctggtccgtgcctgggccttctgagagagaatggggcaggcgttaggccccgacaccagagtgagagatacaaggagagcctggtgtagcccccaccagcttcctggctgtgaacccttaggctgtggcctgaggaggtggggatgtggctctccacctgtcctgggcctgctggcagcctctcccagaacagcttctaaaaccacaaatctgacccagagaatgttcccctttgcccaagcaggacgaatgccaacgcccttggcagccggcgtcgctcacctcgccagcacagctcccggctgagcgcgtacaccttgtgcgggtcggccgggtcccccgagttatcccgcagcatcacgaagcgacgcgtgctgcgcagtgcgcagcggaagttggttttccagccggcgcgctccgcagtctcagcctcggggggcgggccacctcccctgctgctaggcggccacctgccgcgggccacagcccaggcctgaagagggggacagaacacgtgtgccgggcccgcggggtcctaggcgggctctcccacccggggcggggcggggctggggtccccaccttgaagatgcgcgcgtcggcctcgctcaggtccttgcgcgcgaagtgcttccagggcacgcggaaacaggtgcgggcctcgtccagccactgcagcccctcatagcagccgctgctgatctctccaaggagccactctccgaacagcacgcgtggggctgccctgcgggtgcccggccgcggagagtcagggccggctgcagggcgctcggggactggcatctggagagggtgggccgggctcttacctctcaggagccaaggccattgctccttctgcaggggcagttaggtggcggtcaggtgttataacaggggaggtaagggctcctgtcgcagcagacgccaggccgcggccacaggtcgtgtggccaggtgtcacaggtgtccacaggtgtggactgagggcttgtagccaccgacgctgcctcggtatggatctcttggcagagggggctacaggtgtgactgcaggtgtggccggcgcgcacacatgaagtcacaggtgttgaaccagtgtccaggcctggcgggaaggcgcaggccggaccctgcggagacgggaaaggcgacgtcaggggcgggtcaggctcccgggaaagcgaaacctaaacagtggcgcttcgcaccct

SEQ ID NO: 1827 - DNA, 23438 bp, Homo sapiens
agcgcggcagcaagcgtgggaacgcgggcggcgagacggcggcaggacggcggcaggtaggcacagtgggcgggtagggcgcccgtgtcccgcgcggtccggtcccgcggggtccccgacgccaggcggggcgtgggggtggaactacctaccgtaatgtccccgggcgcagctcagtggccacccgtgtccctctctgctttttgcctattttccagccacctaagtccaatctgaatgcccaagtcgttgattgtcgtttgcctgtttccaaagattggtagatagatgcctttttaaaaatctcatttttctttaaatctggtttacatggaaaacgttaggagagctcatataatgaacggcaatagcaaccccctatcttgaaacgcgctctatcatcccactgaaattctaccacgtggaataatgcttggagggtcagagttgtggaactgcccaataaccagtcgttactgagggttagtttgtgaaggaggggacagactgcttctaaaattctgtttaatgacagtcaattaagatttctgagtctggcttgagggcctttgcttccatcacagcccagtcgtccttggcaagagagtctgtatatgggccacagctcacaaaagcattgtttgaaaaaatttattgaaagaacattgtttgtaaaatgagtcccaatacataggacagactttcctaaggtgagatgtgttacttacccagagctgtgaaaggctttacggatggaaactagagactgaattttccagaattttaagaagtctccccaaccaatggccccccactttctttttttaaaccaaaggtaagaactggtagttaaaatgacagttcaaagcttgtccttttgggttacggcagcttcctctatgaaaagatttgggagtgattcagtcacttgaggaaggttggtgccagagagagaaatggctttggtgctttctggtctagtgatgcgggtatgctaggccagagcgagtgccctgggccctccgaggcgggggagagggtggggtctgctgctgccagctcaggtgtgacctgtaatctggattaggtgggcccagggcaacctcttatcacgtccctcctggaaagcctgactgctgtatacatttctagggctgcagatagggcttggccaatagattacctcaaaatcaagaagaggaagttataaacatgtgattagacttattaatttttcctggctgggcatttggtggaattcgtttgttaatgtttaataaatcattatggatcataactgtagtagaatctcaggcttttgatgttacttagaatcttggaggagaccacgaaggacacacagacgtggctgcacatgtgcagagatcttgtaacgtaactatggcttttctctgcaccatgtgtgaaataagctgccgctggcgttggggcgccggcctgggttccaacacagtccgctggctgcctcggtatttgccgtgcctctctgggcctcagtttttcctctcttaaataaagaggggactggattagatgatttctaaagtattttccagctttcagatgctatgacttactcttctctttttccttttaaaatttctttttcctgtaaatcaccaagatagttgtcctgaacagtttagatgttatgaatccattaggaatcctgataagaaagtgttgaccctctttctagaaaaatgcgtgtactaacaaaattttgcttttggttgcaggaggctcaggaactgtggattctagtttaagaaacttgtagcaaggaaatcaggggagttgaaagtctcagaagccaacccctatgttgtgttctggccacctctgtgcagctcattcctcaatctaggagaaatttttctaccttgccccaggaaagagctgctaacttgttttcggggagtgtgggggggtctttggtattggtgttccatttctcttctcaggtaccctctcccaagtctgtcccttctttatgataaacacagtggcctgctttagaattctgggtctcttgagatacagcctctcaacttacaggtgaggaagcctcagggagaggttcaagtgacgtcacaaggtctggttagagaaaagcctttgccagagttcagagttttcaaaccaaggtctaatttgggtgggcgcagtggctcacacctgtaatcacagcactttaggaggctgatgtgggaggatcacttgaggccgagagttcaagaccagactgggcaacatagcgagatcctgtctctaaaatgtatatctgggtgtggtggcatatgtctgtagttccaggtactcaaggggctgaggcaggaagatcgcttaagcccaggagttccaggctgccgcgagctatgatggcaccactgcactcctgcctgggtgacagagcaagaccctgtctctaaagaaaaaaaaattgaactcatccccttttaaatccataaacgcacaactgaggttgttggatggggaatttaagaaatcccacctcctcctccctgggacctggccctgtttcccgtctcatggccacctgcagggtggctgaagtttccagaatgcgtacttcttgtgaaggttctgattgatattttgctttctggaccagtgtggctctaccatattttgggatgttatgtcttgttactgctgattgtttcaaactcgtttgcccaaagaggtcacattttaatcagaagaacaaaaatgctatttttttttttttttgggtgggcgtctatccagctgtcttggggatttccagcactgttcttggaaatgttggctctaagtcgataggtcatgctagttctctctctctttctctgtgctgttggggaagctgtctgcttgggtgagagtgttcttccaaaggatgtctttgggtgccctgggatggttaggtccctagagtgggacatgttctggaagaggagcccagtgaactttgccctgttcggtagctgcagtttatttcctcactcttgtccctatctttcagttggtcgtaggagttgcccaggaaggaagtttggataataataatgacatctggcatgtaaggtccaggccctgtctcagttgctttccgtgtagcatctgaattctcttacaaccagtacaggtagtgttttgttagctgcatctgggactgggtagctgatgccctgagtttaaatgctgatccagcgtctcccagctgagcggtggcgggacttgaatgagatcgcggttctgtctcattctcaaactgctgctcttatcactgtgaaggaacagctatttagatgggctggcctgagggcctcctctttcccagacggcacggacgcagtattctatcagggaatgtggggccagctgggcatctggtagcccagttggttcttcggataatgggctgctcagtgaaggaacctggtgctgtaaaagtgattccccctctccttccagtcttgggctaaaactggagctgttcactgtggttgtatctgcctgaaaggaaagggcagatgaaagctggaaggagcacagccagcacagtgggaggggcctgcagggggctgctggtggctgcaggtttcccacggagctttcagtttgcactcagggctgtgaggtcatggaggccagcattgccttctcatggcaggtgtcccggagtccctgaatctgtgggtttcccccaagccagcacctttgctgcaaacctctgagtttcctgttagcagtttttgggttgctgtgatgaatgagacaatatccgtaatatcacagcgtgtatttctgtctttccaaggatgtgtgaccggaatggtggtcggcggcttcgacagtggctgatcgagcagattgacagtagcatgtatccaggactgatttgggagaatgaggagaagagcatgttccggatcccttggaaacacgctggcaagcaagattataatcaggaagtggatgcctccatttttaaggtaaagagcccagctcccttccccactgtgggcacagtgtctcctttccctcatggactagtggagatgttgagtgacatctttctcatttacttaaaaattaatccagttttttaaaagcaaacattggttcaggagtgctgaatgtgtctcagacatgtacatgagctgatttcacatcttttgaattacggagtcacttttgtggtcgcttgtattctgatgaggagatcgaaggctcttttcttctcttttctgctgcttccttttcctgatgagccaagtgggagaaaatacttcgagaccttcacgctaagacctttccccacgggcttccattagaggcgatgcatataccagggaaggtttcagtccttgttctttcaaagctgatacttctgcctggcattgtagggccagctcaggagggtgagatgccatctgtcattcctttgggggctgggccgtgtggggggttgtgaacctgcagcagatgtctaaaaatagtctcacctcccttgagagtaatcggttccccatgcgtggagagacgtgatggagggtttgttctgtgccaggcctggcccacggcttgttttctgctcacatgatcctgtgtggtagatgctgttcccaccctcattctatagaggcactgagaggagaagtgacttgttgaggtctcacagctcttgtatgacggagccagcattcagatgcaagatggcccaactgtgaacccttggtcctaactccagaatagctgatcaacagagatttcttgccattacacctagattcagacagaggaaccaggaattagggcagcccagctctgcagaccagctgggctatcgaatcccttgtgggtcatcagagtcctgtgtgggcatctctaaggctccagatgtccaggtttcacctctgggagattcggagcccaaggtcaaggtcaagctagacttccacgtttgccagtgtggacactacacgtagtctgagtcctagcccaggttataagccattgccatgtgtgcttattctcttgcatttgggggccagagatggggaggggagagtgagtgtgggagaggggtgaaaggggctgagttgttgggggccagaatcagacctgagaccacaaacaaggtgtggagggggtcaaggctgtaggagcccatgacagtgctggactcccagccacagatgactgtcccctgacaccagagaacaaaaatgacaaaagatcacaccttaaccccagagtggaccataaataggtcaaaggtagcttaagatgcattttggtcctgcacgtctctgcctgaccgatgtttgcagtggggctgtgcgtttcagtaattctgttaaatctgcaatttgaggttgctgatcttcttgagaatctgatgcccattactgaccacgccaaggaatatggggacaagggaacgctttgcactcactttcgaggggtcccttggtgcccccacacgttccagattctttctgatcaaggaccccaggtcagggagcctcagcaccaagaagttttgtgatgccactgcctgcctcctcacccttagtgccattgtggatttctctcttgtttgattgcagatcttttttttttttttttttttgcctttggcatcatggtgaacttctcttgggaaggactgcaaatgtaaacagtgccagagtcccattcagtcggttgggaactctgcattatagataaccccaaaagccggaatttctctgcctcgccactgttgatgtctgggtctgggcaattctttgttgtaagggttccctatgccttgtgggatgtttagtggcatctctgacctctacccaccagatgccagtagcatcccctcccctactgtcacaatcaaaaatgtcttggacattgccaaatatctcctggtggggcagagtcttcccctccccattaagaaccctgataagagctggccactgccaggatcaacagacttaaccagaggtgttgggtgctgaaggcacagttgcaggttggacatcagtaaaacatctttaagacatggcagagggtgctggactaggctgtgtagccctgacatgtggcatgctgacggagacgaagcttctcccttcaccccattccctacttcaacttgtgctcggggggtaatgaaataaagccccagatttatacatcttatgcaatgttcttcatggccgtttcaacagtgttgagaaaaatgtgcaagattcccaatgtttccgttggttacgcagtcgcctgatgtggcaatctgaaatgagtctaccatctcagcaggaatggggccaggagggagacgcgggtgcccactggagcagggaggccatcgggagggccaccagtgccggtggagacatggcgccagcaagagcccatcatgtgcttccctgagctatgcttcttcccatccatcctctgagaggcctgtctctgtgacgttggccggatagatctttggctgttggatgaagtcaacctcggtcaggtagagccatcttagggattttccggttatgtagacacttgtttctttcaactgttcaaagaaaacctttcaacaatttaggagttaagaaagaaatttatgagtttggtttcttccgtaataagtggatggtaaaaggggccacttataccagaaaatccctcattgtctgcaggcatcatcctgaggccggcctcatggtatagatcacagaagagaaattgaaaaaacattgagctcattttgtaccgaccctgagtacactgatgaggccctgatagcaactcatttaatttttaaaaagtactttaccttcttgacatgacgacaaggggggaaaatctagttaagtgaggattatgattcatggttattccaggcatcgtaacagtcctgaatgagttaaagctcacttagtagcacagatatttctcattcagcaggccttgaagggaaaaatagcatttaattaaaaaaatgcaacatgaaacaatcatattaaattaggaagacctcctggtcttagttcagtgctgtcagcctgagttgtgcgtcaacaggagaaataagttatggtggaggctgaatgagccatagtgactgttgctggcggcaggggtgggggggccctgaaatcactctcatgtctagtttttgctctagctcaagaaggatctcgagagatcatcaagctaagttgaccttttaatgctggccagagaggctgggagagggccaggtgcctgctgtgtcacagagttcagggcaggcggcaagccaggtacccgatggtggccctggatgcttcctggccgtgggccctgctgtgatggatgatgtggcctggacttgctcgtggggtgagtgtgagcttggcgtgaacgagtgagtatggcagtgccttgcaggcaccgcggttgcgtatgtgtaccagcggatcacaacgttgccatgaaatctgtgcatttcaaggcccgtttgggatgtgggttaactcagtggttctcaggtgggggaggtatcatgatttaccctccagggaatacttggccatgtttggagaccttttttggttgtcacagctaggggaggggtgctattggcatctggtgggtcaaggctagggatgccgctgaatattctacaatccacaggaccaccccgccacaaagaagggtcccagctgatatgtcaggcttgccacggtggggaaaccctgatttaaagtaataaaaatttgaaactacagttgatttagtacatggtttgctggtttatttctttaaaaataaacaacagcaacaaaacccaaattaatgcccggtcagtgatgcagtcaatgaagagagcattaaagaccgtgtgctttaagaaatagttttagaggggagttttacatcaatgtcacatgaggaaactaccacttatgctcactaatgggaatgttcttccagtctctttaccccaggtagaggtgcaacattttgcatcaacaaagtaggcagcattggccttgaacagtaagcattcttgtcttttttgagaggaaaaacagtctgggctattttaaaggagctgtgactcatgggggcatgatggagtttctggaagtgtggtctcctgggtagctaaatccaaatccctggaatactggctaaagacagctacctgggccgggcgcggtggctcacgcctgtaagcccagcactttgggaggccgaggcaggcggatcacgaggtcaagagatcaagaccatcctggccaacatggtgaaacctcgtctgtactaaaaatacaaaaattagctgggtatggtggtgcacacctgtagtcccagctacttgggaggctgaggtaggaggattcgcttgaacctggtaggtggaggttgcagtgagccagattgcgccactgcattccagactggtgacagagtgagactccgtctcaaaaaaataaaaaaactaaaataaataaaaataaaaaataaaaaaagacagctaccgagacccaacctcccttccccagtgagaatcttgaggggcaaggcccaggaatctgcattttcacaagcttcccaggggcagggggttggtatatgcattaagcctgagaacacttgctgtggtggggaaactgttgggttggaagtgggtacagctggcatttaatcccagactgggtggccttgggaaagttacttacctcttggaattgcattttcctgaagtgggtacagctggcatttaatcccagactgggtggccttgggaaagttacttacctcttggaattgcattttcctgaagtgggtacagctggcatttaatcccagactgggtgaccttgcgaaagttacttacctcttggaattgcattttcctgaatgggatcgggatgtccctacagatctcctatcattttaggctggaggacactgcctgatttttcctgaaaccgaagataattctcatctgactgtggttacctcctagttggtgtgtctgtattccaattttgcaagcttaaaatctgtccattcacctgtcttatttttttaaaatctgtactgccccattctacattatgactttaagatttcagctttgaatttctggtcctagttcagatcctaaggtttggaaaagtcagaaaacagatctattaaaaaaaacacacacacattaaagggaaagtacttcattacattttaaacagcacctggggggaaaagtctagaataaatgcaaaaatgcaaaacaaaatttctattaaaagtaacagggcgatggatgaccattttgactttttgcaaatgttcccttttcatgctaaattttaggggttgatctgaaaaagcaacaacttgttctttgttttgaacgctctggtgaaaccatatgcaacttcctctttgtgctgtgtaaacctcaggtgtctccagctcttcagccaggcaagggcttggctaaaaggtgcactccagggttggaggagccttcagcctgggttcgacttctgactcagctgtatgaacctgggggaccccctccctggcttgggtctttccacatctggtccccagatgtgaaaagactcaagacatctgattggagtctctttgggtcctgaaattgaatgagagttgatggccaacaaagattcatgggaagggaaggatgtgtggggtcctggtcatggtgacggatatttgtgattggagtcggccatgaatttaatgtgcttctgtttctttcttcaggcctgggcagtttttaaagggaagtttaaagaaggggacaaagctgaaccagccacttggaagacgaggttacgctgtgctttgaataagagcccagattttgaggaagtgacggaccggtcccaactggacatttccgagccatacaaagtttaccgaattgttcctgaggaagagcaaaaatgtaactatcctttatgggcatgaaaccttccagaagctgccctggcctgtagccttcaccacagaacttgggtctggggtagacacagggtctggggcacatagtttcagttaaacaaagcagttctctccttcgtgtaagcagaaattgagatctctttccagtgacctcagagggaagggcggaggagattgggtgctgcccaacctgtgccccacttgctgcctgaccacagacatttgtagggcctccctggacaggaacaagcatcctccagcagtttctgatgaggaatcctttcattttccagcagcttgcagaggaggccaggggaaaatatggtgaccacagaaggcctggatcatgagggttgggagtaaagctctcagatgaagttgtcaaagatggcaccatggccttcgttgttggagatgggatatgcctcagtgtgttactagatcctgattgttatttgggaactccgggatgtgatcattcctgaggtttcttccagctctcaaatcccaagaaagcatttgtgacagattaaagcaggacagcaaaaacatgccgcaccctggtcctacatcactaaaataaatcccaaagtactgagctgggatctggcctcagaaggcttctcaaagccctgtgctgtgccgctgccatgaattgtagctgatttatgagataaaacctaattaccagcgctggtttagaacatgcttttaacacattgattttcttagccacttgatgaggcttttagaataacccactctggctttctccttctaagcttctgagtagtccacgaatgcctgtaagaaacagaaacccccaaaacttcttggggctgtgcagaagtttgaagtttgcactcttcccgctgtgggggtgttgacttagaattttttaagaagttaaaatggtgattcaaacaaatctatagtgaatctgtgtcagagagttgtgtaatcgtcatgaaggaggcagcatgatggtaaagatggtggacagagaatccgaggtgctggtgaatgtggcccatgaacgagaaagctgagccaaagccgatgcccgacccggacagtacaattgcggtttggggcgtttgtagcctaatcgtctgcaattagcacctaactctactgagcgtgaaccctagtcaatactaaatagtaaggccaacaaactgaccttcccttggagaatcgggtgccctttaggaggaaacctctatataatagtctggggtgaccctgaaaggctaagcagtcatctttttgcctcatttcccagttttggacaattttttttatcaccaaaaagtaaagtgtgatttgaaggaatagagaagtttcttttggcccctactgccacccccaagatcagtcaggcttgaaccggcaggtgaccccaacttgtttatagcatggggtgcagccagcatcacctgctagtgatgttaaagaagcagcaggaggttctcaggggtgaagcaatgtagcatttgcataattgcctacaggggcccactcgcctctaacctcagtggtttgcaggctccatggtgggcgccccacctgctccctacttccccatcagtagcttctcagtgaattctttaatctatcgaaatggaatcaaaattcagccaggaggaaacagtgggtaaattctgtaggtcactgggaataatgaatttttgtaagtgttggttgtgatacgtctcacactgataaacttcataaggtaagttgtcgactgaggaagcggcatgagaagggaaagagcagaggctggcccagcgtgcccctgtggacactgtgcacctttaggcggtttgtgattacggctggtgcccactgggcatcagtgagggtgctgcggtgtgtgtgtgtgcatggctgtgtgcactgatgcacatgtgtatatttggaaaggccaaaaagagatttcctgccaactggcaatacaaaaaagaccccaacctgccaacacgttttgccaggaaatcggtgagtgttttcaaatgccctgtcttataaatgtaaccttcttaagttagcaaatgcttgctgtaaagtatatctgatacagactcattttggatctcagaaaatagaagaaagagaccaaagtgctgtctttatcctttaaaagtgttagcagaaacaaccaccaccaccaccaccaccaacttctctcttttgactttgctgatcagatgactgaagcatgggaaaaaaattctgtgcctttcccaaaccaatgaagacactcactaacttaatgtttccttaaactcagcatttacagagtagattatggcttcagcaaaggctgtgatgcctccgtgccatgtgtcatggtgtttgtctggttttctgtaggcaaactaggcgtggcaactgctggctgcgtgaatgaagttacagagatggagtgcggtcgctctgaaatcgacgagctgatcaaggaggtaagcagaggcagcatttcaggggtctggccctgccaggaggagtctcatgtcttctggcagggaggggcaccgttcttgctgtatgaaggcagccagaccctcgggctcgctgaggaagtggcatctccacctgtacagatctggaacggaaggactggctgggcgccccctccccaggccagcttctgccgacaggtcaacccctcacgccagatccctccttcatccctagggctgggcctgagctgccggttatgtgtcagtgaagttccttccagctccaaactgttcgaacactttggacagcagtcttttaaatggcatcgtgaattcccttgccttcctagcaggctacagagaacaaaatgtaaactttccttgctgcctgcgcttgtcatgatggcgggtgttgttgtaccagctctcatggctatttgattgcttcctttttaatgtgcagtttttattccttaacggattggaaagctggataaccaagcatgttcacattgcacataaattcctaacaggctacaagggagagcataatcggggcctccttaggcaagaatacatggcttttgtatacccatttcagctattgggatgcccttttcttctgtctttggcctcttaactatgcttttcatgggtattacaaggtggacatttgcatgactaaacctcgtgcagcctttgcaaaaggttgtgtgtgagtactgcataaattcttcttcttaataacatagcaataatggaatccttaagagtagcttggctgtcagagaatgaagataacagaatgtaacctacccgaacggccttgctcttctgcacaggcagctgccaagtgtctgggtggtctttggcagccgactgagtgaattcttggcttcgtggccctccaccaatgtcctgttttctgtagaaggcttttctgctgactcagctgagagagtgagataatcggattgccacaccggggtcacaagaaaagcaatttcaaaacatttcataattggatttatcagcctcctttaaggaatgggccagagattgaacatctgcatgtggctcgttgagcgagattcttgaaagcatggcagcctttggccagcatcactgttcactggtgtctcagagcttgtctgcgtgtccagggcgttgagggcaattggataatctggaacactgggtctgcaacaggcaggtcgtggaaagggccaagaaacttattagtggcccccaaagagcctagtaatttggccacatggtttgaatgctaagcctggtagatttaaggcctagggcctttcaggttgcaaagtgaaacttgacttttgtctcctgagataaaggtgacaatatggttttacttacacatgaactgttcatttttacaaacactggagccccaggtgggagatcagtgactgagctgccctcctctccctcccctgactgtgcagccttctgtggacgattacatggggatgatcaaaaggagcccttccccgccggaggcctgtcggagtcagctccttccagactggtgggcgcagcagcccagcacaggtgagggtgggtggcctagaattgtcaccaggcatggcctgaagggtttacggcattccaccagccagggacggagtgggggtggttgttgctatcatgatccatgtctcattaaaggtagctcagccctgagaggtgaagaacgatggccctggtttcccaacatgagggcagagcccagctgtgcctttggccctgctctccgctgcttctcaggagggcacaagctgcttgttccctaggtgatgtccatgccagctctccccacgctcctgggaaagtccagggaagagggtctagtgaacttgtgtaaggccagagggaagatgcagctcttggccacgctggcgccccctccctgggtactcccttaggtcggccagtctgttacgacattaaggaccccctcagaaccaaagagagcccagggcatttggaggagaggagaactcagaccaggaacaggaagtttgttcagagccctagatttgaatcccacgctgggaagttacagatcttgagcctcagtttattcatccgtaaaacagagaaaccaggacttgcgccatggggtcacgagggttaagtgaggcattcatcctttgattctcttttgatgagccactcagaacccccagctgcttgaaatgcccccgcccccgccaggcccaggcttctgcagccggtgaatgtgtttgcttcctccctcggcgtcttccccctagccctacatcccctgtgggagtctgggaggtggcagctggccccggaggccttgaaggttgccaggccttgggtgtcgagtaagaggtccctggaaaggcacctctgtctgtgctgcaggaacaccatccggaaagctagcttgcacccccaggctctcccccagagataagccctgggtggtgggtatgcagtccagtggtattctgggggtaagtgcttgaggtgggaaggaaatgtggccccacagtgtcacattgacacatggtcagaaatcccacagcatagaggaagtccccccgacttgccactctggttttctgcatttgtgaaacaatggctctctgctctggtggggaaaagcactgaattcagcggaagcctgtgctccctggagcctctggcacgccatgtgcagccttttaagggacttttggagaaggagcgattggggttactccctgtacaccacacctgggtggctctgagcttgcttttctgtttctcctgcaggcgtgccgctggtgacggggtacaccacctacgacgcgcaccattcaggtacggggtggtccgggctgagaggggcgtgggcactgtttgaagacaaagcccagataacccaagcagggttgcggggtttcgaggatgagcaggacctggtgtggaagtctaggcctggttccaaggatgagcaggacctggtgtggaagtctaggctccgttccgaggatgagcaggacctggtgtggaagtctaggcctggttctgaggatgagcaggacctggtgtggaagtcgaggctccgttccgaggatgagcaggacctcgtgtggaagtctaggcccggttctgaggatgagcaggacctggtgtggaagtcgaggccccaatttctcctcctcaccatttggtcaggagctggcgagtggcctcttttgaggccacttttcttggactggaccagcaagtagacagagtactctttgaggctgtaactgtgcaggagagacagtgagggacaggccagcgtctgtcccagcgctgcctctcttttggggctgcaggtggagtggtggagcctctcagagcctcatctcaggctcccctgcccaccacctctaggtggatgcagctgttcccatttcgcgggctcaggtagcttgtgtgctccagactgggggcctccccgcggtgggcagaggtggcctttgtgtgtagtctcagcggctaaggaccctggctgcacttctgccagctgcccctggaagtgacgctcaggcgtggtgacggcatcttctgaacaaggaagctggggcatcttccagcattggctggttctgtgggaggcgagcagctggtctcatcagatgggccacagaacgttagggctgggcctctgggcaggggaggaaatggggcagggatagaagcgtgctggctgaggactgcatgggacagttttgtgggtagcagaggtcggtgctcacccaggcaggaaaactgtcgagatggcaatgccctgtccatgaagctcttgtctatttcctggcagccctttgagctggggggttgttttcactccggcttcacagatgaggagactgaggctgggaggttcaggatctcatccaggtcgcgcaggcctctggctggagcctgttcttgaggcctccttgtgcccggcagccgccatgctcacagggtctcagttctgggaggcctgggtcatgaggctaagcctccgggctcgccagccactgggctatggcctgggagtctgctgaccagtgctttccgggggctgtggagtagccaggcacagaactgagccatctcggtgagatgcagaggcacaatttggggagagcatgtccttgaattagtccagcagggtcatagccactgcctcatgcacagaacatccttctagaagctgtgagctttggtacctctgtccagccccgcccccacctctatgtaaatccatgcttcagtttccttacctggaaaatgggtataataataatctaccttacagggttaaatgtgctggtaggtcccaagccctgggcacagcacctgatatgagctgtgtagaccatagtctgtggtttataacttcaggagtcttgtctgtgtagataagcatttgtcctgttacccagtttctttaactggtgcttacctgtgccgagcacaaatacaagctccgataatcctcacagcagcccagtgaggtggatgctgtttttatctctactttgctgatgaaaagctgaggcacagagtggggaagcggcttgccccaggtcatccagctgggcagcagctgggctgggaccgcacgtcaggcaggtgggctgcagggtctgtgctgcgggtgtctttgttgctgcctctgtggtcaggccgttccccagcaaggctgttcttgtgggtgagtggctctataagggcagggctgggtcgcagcaggcccttactgttgcagaaggctcacctgcctcaccttggcagcccttggtgagctgcttctcacctgtcaggtacaagcctgacagctggaaccttctcttagcataagacgttctggggtgtgtggtcactaagacactcctgcttaggcgtctctgaagcacttagctgttccgggtgaagctgccagttcacatgactgagaggtgctggtaccaagataaggccccggaaatgacagggcaaagggccaaaggggtgacggagttgcctgaagcgtttcattcatttggaacaaagttcgaaagttgcttcagggtaaagggaggggagtgtgtggagtccgcaggcagtgcagaagttgcagacttggcgtggggggaagatgatgagtgaggaagagcgagaccagcggggaagatggtgagcagggaagagcgagaccagtgctgccatttccttctgggtgaccctatctaggattcagtttcctgaagtgtcaaatcaatgaggtggaccagagcttctgcagctctagcttcctaccctgcatgattctagaacctgcgtaactccagcatggctggaaatggagcccgtgaatggtgggttgtcaaataataaggcagggagcagagcccaatgggagggtccaaggagttctgagtgcccagcagtgtcagcagggaatgcagatggactcagggcctccccagatgtggtcagccttgcacaactctagggggcgccgtggagttaggcacctcacaacttgtgtggctccacaaggcagcctcgaaccggtctggggtacttagaaggagctgcaaactcactaagctcattgctagcgtatgtaattcttttggtttaaggcaattaaaatgcagatacctccctgcatttacatgttatctgcattcctaccttagattagtgttttccaaactttggtcacttgaggtccagtgtcacaattggttttcacagcctggactgttactaacatcatgtttttcctcaaatcttaatcttaaaataaaacttaagtttattttaaatgagaacccactatcattggctgtaaaggaagacctgtggcacctggtataagtaggtaatactgtctggctagaattgattaagattgtatttgtctttcattgaatttgtcttgacctctgacaatgccctgaatttggagccctaagttcagtgccattattcaaaagggaggttgacaggtgttaggtgttagagagctatcagcaccaaactgaggcttgctttttgaggtaatcagaggttggaagaatattgaagatggaataatcttgtgattacatgtatcacccctcccccattattctgtgtgtgccacttttggggaacccctgctttagtttgagtgtttttcagactctttcctgagaacagatttggatgaagggttttgcagagattcttaatctgaaatccaggaaataccaagggcgctgtgaatttgttgagaaaaagattatgtctttattttctttaacttcaggtttaaattgagcatttccttttgttatgaatgtaggcagcagaccgcagtgcccttggcagtgcctatgagacggagtattgtcataagaaatgagttgtcgaaacatcgtttgccctcagcttgacgtgtaaattacaacagttaccagaccttctctagaccttgtatttaaagagtcagtgaagaagtacagagaacactgttgtagttaatatgttcagtcattggtttccttagtcattctgtgtatttattcatgcatataaaaacattacttctacaagcagtacatggatttccccagaatatcaaagtggttcaagacacacaaagagttacccgtgtaggtgtgagacagactgtgcacttgggcaggagggaccctgtatgtctccccgcagcaccgtcatcgtgtccctcttgtccacagcattctcccagatggtgatcagcttctactatgggggcaagctggtgggccaggccaccaccacctgccccgagggctgccgcctgtccctgagccagcctgggctgcccggcaccaagctgtatgggcccgagggcctggagctggtgcgcttcccgccggccgacgccatccccagcgagcgacagaggcaggtgacgcggaagctgttcgggcacctggagcgcggggtgctgctgcacagcagccggcagggcgtgttcgtcaagcggctgtgccagggccgcgtgttctgcagcggcaacgccgtggtgtgcaaaggcaggcccaacaagctggagcgtgatgaggtggtccaggtcttcgacaccagccagttcttccgaggtctgtaccgtcgtcaccttgctgcccccacatcttagagatcacgcctcctatctgtgtgccatttgcagctcagggtggccctgtggtctcatggagggatgtggaggaggagtgaggggcatggtgtggcaaggaggtgctcctttgaatggcactctgccctctccactgagcgatcctggggtgcttctctgtgcctcaacttccccatgtgtacagtgggggtgcagaatcagtaccctcatcaggtgattgtcgggagggtaaaggaacttaacctcatgtaccttggagtatgttccaaggatggtccctgagcgctggctagagacacagagtctgaggccctgctccagccacaagatccgaacctgcatcttagcaaggtccctggggatctgtgtacaggttttgagacacgctgactttccgcacactaagtgctcaggatggcagctgcacacactaagtgctgcctgttagctttcgttacgctgtagggaggatgtgtaggataccagcctgggtgtctcctggagggttaggatggcgtctcccttctccacgtccccatgctctctgctcctctccctgtagcagcacagcccgagatagtgtcaggtctcagctgccactggcctgagaactgccagaggaggggcctggaagggcgggtgcaggggtatgtgtgagctcaggggcataagccctgaggaatccccctagtgaggaggtgtgaggccgcggttatcacccctgagcaggcagagcggcacagaagtgcgtcctgcaatgtacattcccgggcctacctcacatcctctgattccatgggtctgaggcggggcccaagattctacatttctaatgagctcccagggaaggcgactgctgccggtccaccggcccactttgagaccctttcagttggctgtcagagattcgggtgagggctgcagccctccctgggtgtcctcaggtcggggttgccaactcagttgcctccaagggccaggcaggtaagagcaatgcacgaattgagagataagagagagcactgggcagctgtgcccatggagaggcgttcaaacgaggcattaaaatcccggcaacaacctggaatggccaaacgaacagctccttgcttggaatttggcccaagggccaccagtttgagatcccatggtgccctggcctaaatgctacaagccctgggcctcctgatcccccagccctgctgctgcgggagttggaggtcatctcggccttgcttgcaaacaccctctgcctgtgtcattccagagctgcagcagttctataacagccagggccggcttcctgacggcagggtggtgctgtgctttggggaagagtttccggatatggcccccttgcgctccaaactcattctcgtgcaggtaagtatgggcagctttttttttttttttttttttttttgagatggagtcttgctctgttgcccaggctggtgtgcaatggcgtgaccttggctcactgcaacctccgcctcccgggttcaagtgattctcctgcctcagcctcccgagttgctgggactacaggcccgtgccaccacgctcagctaattttttgtatttttagtagagatggggtttcaccatgttggccaggatggtcttgatcttgtgatcctcccagcttggcctcccaaagtactgggattacaggcgtgagccacctcgcccggcagtctgggcagctttgagccctgcatccaggtctcctggccctgtcatgtaaggatcaagttttgggctggagaagaggacacaaggacaagtttccacctgtgtaggaggcaggcctgggcaagaccttcaatatgcgggaagcggattcttgccatctccgagccatcttctggtgtctgggacgcgcacagtctgtgtgtgtgtgttttcttttttcttttttggtttttaaatctaagcctcttctccagaaagattctacctgttcagttgcccgaaggtctaagtgacagattagggcattgccagcccttatttcatgtagtcaagggaatgaatctctaatggtgggatcctgggtgctggctgtcccagctgggacagtactggggagtatggaacagttttggcaggagtactgcttgcccttccttggcattctggctcattcacttgggactcacgtggcactggggtcatcagaggacctggctagggtcaaagacagtgcccaccccctttggagcctccgcctctgcctctgactttctgcacctcccatctagattgagcagctgtatgtccggcaactggcagaagaggctgggaagagctgtggagccggctctgtgatgcaggcccccgaggagccgccgccagaccaggtcttccggatgtttccagatatttgtgcctcacaccagagatcatttttcagagaaaaccaacagatcaccgtctaagtgcgtcgcttgggcgccccaccccgtctgcgtcctgcatccatctccctgttacagtggcccgcatcatgattaaagaatgtggatccctctgtctggggtgggatgccttactttgcacttaatttaataagggcattctcggaggagtagacgtttaatacgaagtggcggcatagccctgccgagatgtcggtgatggcctggatgctgtaaccacaacctgtggctaaaaattttattttctatcctttacccgtcattatcattagttgctatgattctttctgcattttcggttaactatcatttccaaagacttgtcattcagtaatattagcagatagctgcttcgataaaggaatttggagtttaaaaatcaacttgtgaaaacaaggttgtttttgtctttatcgtttgttagagttatagatttatgatttcataggcttgattctatgtgaaatatctttttacttttatgcattttaataagatttaaaaatatttagattaaagccccctttaatgagtacaagaaaaactcttggcttgttagaagaaagtatattctttctagaatttggtgcaggaatatgtgttcatatccaggcaaacgggtgtgtttttatcttcagacaatgaaaccttctcctctggggctttgttgccaggaagattagaactaaatttatttttttcatttctgtcatgaaatcattccagatacctcttttcttctttccaaatggttttcacatgtgtttgaaatatttgtacttcgaattgtcggattttccatgtcctcctttctcctttgtgcccagcctgagtcagcaccaatcccgcattcagaacctcccagtgaaagggcagccttcattttgagaaggtggaaggtgttagggtttgggagacagctcatccaatctcccaagtctcatggtggatttgtgactgtgagagtttccggtttaaaatctgaaaagccagatatgcctgtttccttttcccagcaccatgcctgtggaggggacagtcagacccagaggtcctttacgtgtggatggagttcacaggcgaatagaggagaggaccaggggacgtggcttgtcccttttgtccaacaaagcattatatttttaagaatggcagacctgtttgctgaagtgttcataagataacaataggcttgaatctccaattcaaatgaatgtcaaagcacatatctttaatatgctgaatgaatatttatttttgtatccattaaaacagtatattgatctcttttattctttattaaaataaaatgctcttttttaa

SEQ ID NO: 1828 - DNA, 2147 bp, Homo sapiens
taacctgctcaggtccccttccatgctgtggaagctttgtttttttgcactttgcagtaaatcttgctgctgctcattctttgggtccacactgcctttatgagctgtaacactcaccgtgaaggtctgcagcatcactcctgaaacctgtgaaacaacgaaccccccggggagaaacgaacaactccagactcgccgcctgaagagctgtaactctcacttcgaaggtctgcagcttcgctcctgagtcagtgaaaccacgaacccaccggaaggaagaaactctgaacacatccaaacatcagaaggaacaaactccggacacgcagcctttaagaattgtaacactcaccgcgagggtccgtggcttcattcttgaagtcagtgagacgaagaacccaccaattccggtaggagtaggaaatcacatcaccttcttttaatcagtctcaaatacctggccccttgtggaacctgcaagagccaggtttggcgaatgcaatgataagcaattgtctaatcactgccttgaaaaagagcagagcatttgagtatgctgtctcctcctctccctcacttcagttgggcccaacatgacagtcttaatggaagctcgggggtcaaaggctggtggcttacttcacgtatattgcagcatttcagtactgctctgcacgtgtgctcccccgcctgatgaggtaagtgttaaacagggatgatcacagcttcaagtaagcaatgggaattggatgttttatgtcctctggcgccatcttcagcagagaaatatataggtcacttttacttgtctggttttggtcttgaaatatgtactgaaacttgtgaaggagcagacctatattaggatagagtaaaagagggaaagacaaaaacctcttgggcttttcaggagacttggttcattctctgcttttcaagccatctcatggccacatgcctgctttggaggctgactcggaggcacaaccggcctcagggcgttcctcagggaccctacctttcttgctccctgaagaaatgtgcacattgcttgaataaaaacaatcaaagaacactcagtcaagatcgtctgctgcagtcttcgttgagggctggggatgctaaaagtcagatgattcatgtgtaccctgtccatcctaactcacctgctcttctacttccgcagcttactccagtgcccacagatacgacagagtgtcccaagtgcccctcacactctattagctgcatccttaacctctttttgccacaccataagcattgggttttgtttgttttgagatggagtcttgctctgttgccaggctggagtgcaatggcgtgatctcagctcactgcaatatctgcgtccagggttcaagcgattcccctgcctcagcctcctgtattagctgggactacaggcgcacaccaccacgcgcagctaatttttttgtattttagtagagaaggtttcacgatgttggccaggatggtctcaatctcctgacctcgtgatctgctcgcctcggccttccaaagtgctgggattacaggcatgagccacggcgcctggccagcattggggtattttattgaagatggaagccatgaatgttgagaaagcctcagcagatgggaacttgccagaggtgatctctaacatcaaggagactctgaagatagtgtccaggacaccagttaacatcactatggcaggggactctggcaatgggatgtccaccttcatcagtgcccttcgaaacacaggacatgagggtaaggcctcacctcctactgagctggtaaaagctacccaaagatgtgcctcctatttctcttcccacttttcaaatgtggtgttgtgggacctgcctggcacagggtctgccaccacaaccctggagaactacctgatggaaatgcagttcaaccggtatgacttcatcatggttgcatctgcacaattcagcatgaatcatgtgatgcttgccaaaaccgctgaggacatgggaaagaagttctacattgtctggaccaagctagacatggacctcagcacaggtgccctcccagaagtgcagctactgcagatcagagaaaatgtcctggaaaatctccagaaggagcgggtatgtgaatactaa

SEQ ID NO: 1829 - DNA, 1073 bp, Homo sapiens
ataatagggccggtgctgcctgccgaagccggcggctgagaggcagcgaactcatctttgccagtacaggagcttgtgccgtggcccacagcccacagcccacagccatggtaaggcagatgtcacaggtggggggaggtgggctctgtgccagccaattttcgtctccctcccccagccaaggtctcccaggggtgcagggagagcggagctgctcagagcttggccaggttctaagtgtgctcctgaaagcaggtcacccctgagatcctcagggtggggcacagaggggcaccctagcaggtaaagggaggccacgggatggcggtgggcagctggccttctagtaacgagccctcagtgccttctgtgcctggggtccctgccggcgggatgtagaggacagacaggagggagcactgtccctgggtacaggagctcgccctgcagccagtgccttgtgtgtggtgggcctggggctggcgccgcagtctctgaacctgtgtgacgcctgcagggctgggacctgacggtgaagatgctggcgggcaacgaattccaggtgtccctgagcagctccatgtcggtgtcagagctgaaggcgcagatcacccagaagatcggcgtgcacgccttccagcagcgtctggctgtccacccgagcggtgtggcgctgcaggacagggtcccccttgccagccagggcctgggccccggcagcacggtcctgctggtggtggacaaatgcgacgaacctctgagcatcctggtgaggaataacaagggccgcagcagcacctacgaggtacggctgacgcagaccgtggcccacctgaagcagcaagtgagcgggctggagggtgtgcaggacgacctgttctggctgaccttcgaggggaagcccctggaggaccagctcccgctgggggagtacggcctcaagcccctgagcaccgtgttcatgaatctgcgcctgcggggaggcggcacagagcctggcgggcggagctaagggcctccaccagcatccgagcaggatcaagggccggaaataaaggctgttgtaaagagaa

SEQ ID NO: 1830 - DNA, 74203 bp, Homo sapiens
tgcattctttgccccaaaactctttcctttggttgtgctaagaggtgatgcccaaggtgcaccacctttcaagaactggatcatgaacaactttatcctcctggaagaacagctcatcaagaaatcccaacaaaagagaagaacttctccctcgaactttaaagtccgcttctttgtgttaaccaaagccagcctggcatactttgaagatcgtcatggggtatgtgagcagtttcatttgtcttttttcgcatagcattttatgtttggactgggctaatgcaaaaatatatacatagcataaaatagagcacaggaaacacaaacatgcttattgtaacaacataaaaagtacagtaaaagtaatcagaggagaatgcagagagcagtcaagaggtgaaatggtggtgctaggtgatttcagttctaaaaactgtaaatttaacattcatcagctttttccccctgcaaggttatgtttggtttttaaattatgaataacattttaggtagcaagtattatgattcgataaaacttgaactttctatgaaacatactaaatttaatgaaacatactaaatttaatgaaacatagattaatacaacactagcattcaatgggatgatctaccccagctttcttattttttagtggaagaaactggtgtttagaatggttaagttttgggttcagtgttaacgttttcatgaataactctgtttgtctcaatactcgtcgctagcctgatcttgaaataagatttcccaggcatttaattatctaaaagttgtaaggcacaatggcaaacctcttcatctcttgatagacttcttaggacaccagggttattaagaacaaagtttctgcagtgcagaccagcggttcttacccagaaggagtatggctgctttgctaggtcagtctatctctttatctaaaaatagtcttgtgcttcttaacatcactaataacaaaagcaacaggaataatcctaataatgtagtttggtagaaaaagcattggacaaagggtcaggagaccaaactctacttctcagtaggtgatccagtctgggcaaatgtctacctcctgtttcaggttctttcttcataaaatgaaaaaactggaaataacaaccttcaagatccctttcttcttcaaaacttctttgctttatgcagtggctcttgtttagccctatgctgcaatttttcaaagcatgtttgatttcttactgtatggttatattatttttacatcattagtggggtaggacaaggattatcacttatattttactgaagggaaaataatattaggtgcctgatggtcacttagaaacaaaagtgctccagttctttgttggagtctgacttagtaggtggtggcatgagtttgggattctttggtgtgccagggtttaaagcacttcatgagatggagctccagaggaggtcaggctgggtatagagcctatggatgcctcactttttaaagttgcaggtgttgcatgtcttttgtgaattaaaaaaatacagaaaacaaaaaagttgcaggcgaaatagctctgcctctttagaagtgaaaagaattgcttgtcttattatcagactcttactgataacaatttaccagtcaatcagaaaacacatggaattacgtgcaagtcctctttgctaggtggccaggagcccagtttgtgaacttgggggatttatcatgtagagctaataaatcgcatggcattactcaatgcttttttgtgaatggaacatttaaagtttttgtttcatattgaaagaacagtcatgtacctttaaatatttttttcaaagtccattttgcagttttcaccagttcgtttttctgattcaacatagtatcatctcatttagttagtattaataattccttagcccaactgctatttgtgaactgattgtgaattcagctcaatattatttgtaagtaatcacaaaaccagatggccttaattcagaatattattggtcataatttgcatgtagacaaggttgtaaaatcaccctacttctttatctgagcattatggaaaatttcaagacaattacttcattctggggagccctaggctacagtttctaattcttccatgtgagatatagagaatacatgtccaaacatcaaatttcttgttttctaatgccttttttactcttataaataacattttaaaagtatttctttaattatttaattattatagaagtttattaattagaaatttatccaagttccctgaaaaaggtaatatatgtgaattattattgttcatgtcttaggtatactacatggtttcaggccaccaatttgcacacaaggctgcattaatattactcataagtaaataacattacacttatgggaagaacattttcatttttaaattaaaggcttcattttcaatctgtaaaatgggtgtgataatagtacccatttcataggaagatggcaaagactcagaggtataatgtctttaggctgaactttttgaaattatttggcagatcgaatatcagatattagaagtttcaaacaattcaacttaatatattaggtacttagcataggccctgtcatctggtaagcatctagtaaaaattaaccattatttgtatccctttcatgtctctacagaagctagcaggctgtcataacaattcattttcaaattatgggagatattcaaggattcttcaaagtcaagctaagatcagggtcctggattccttctattctgtggctaaatataagttttgtggggtagatatacatgcattatgagctgtttggccagttattgcccctcttagggtgtcgggtgtcagagcttctttttctcttttctcatgtgtaaaattatgattcttgcagttctcatattctatgaatttataacaccatatgaaaaataacccttctacatactcaagaacatattctgtaattctagaaatcaagtatgtttattctaacctaaaaaatcatgcctattgtcattataatactaattgattgaggttttactttaacatggttttagttctggtgttcgatgcctgtttttcctgttgagatgtgcaagtgttttcagaggggccaagaagcgccttcatcttgctggagcagtgggccagaaagaagcatagatttggcaggtggtagcttgcagacagacatgatttcagaggctctcctgtgcctgtcaatttttttccaagttgtccctgatgcctgaaattctatgacagaggacaatgagagataagggcacatggatgtcctggtaaatgcttaggaatccgagtacagggcttgttggagagccctgattcatagtgtttgccaattcctttggtgtaaatattcccatcatggcccattttaaactaccaatgtgatgtctgctggctcacagattcctgaaaacttaacaattagctacctcgggccagtacaagccgagtccagcacaccgtcggcaagcctaagtacaaatgatccttggagaggtagccaccaactaaacagcatacttagttgcatgtgactgatatcggatccttttcagcggtaaagggaaaatggagagcctcaggcactttgagtaagcacaggatggaagaggcagcctaaatgggaataaagcatcatagattggtgtggctcacgtggccactttctagatgtgggatctcagaccagacacttgacctctttctgcctgtgtcctatttgtaaagtaaggaccccaacactacctacttcaagtgatgttgagtatttcatgagaaaagtatgttataagctttttaccaattgctacatggtaaggtgattattactcacaattttgcccaagcaccaccttggtcttctgaaagcccctctggagaactggaaaggttctcctattttgatgactctttgccccttagggatcaagtgtgctgtgctccttatgatgtgggaggcattatcatttacatggaacaagagaaacagtcaagatcaccattccagtaagcatctgggtgagggtctccactcctcatggccttttccctttagcctacagtcttatctagcaacagaaccatctcctgcttgcagcaagcatcctttctaaattaaagatggtaggtggggagatggtcccctttccttgcttttgaaagcattactgctagtgatcacaaacactgcttctggaatcagacagatctgggtcaaaaactagctcacatttgatctgtgtgattttgtataaattatataatgctgtgcaattctctaaaaagctatctttttttttttttttagacagagtcttgctgtgtcacccaggctggagcacagtggtgccaccttggttcactgcaacctctgcctcccaggttcaagtgattcctctgcctcagcctcttgagtagctggaactacgggtgcgcgccatcatgcttggctaatttttgtatttttttttagtagagacggggtttcaccatattggccagctggtctcgaactcctgacctcatggtctgcccacctcggcctcccaaagtgctgggattacagatgtgagccatcgcgcctggcctatgtttttaaaataattaagcaaggccagacacagagactcacgcctgcaatcccaacattttgggaggcctaggtgggcggatcacttgagcccaggaatttgaaaccagcctgggcaacatggtgagactccgtctccacaaaaaaaaaaaaaaagccagatgtggtgctgcatgcctgtagtcccagttacacaggagggtgaggtgggaggatcccttgagcccaggaggttgagactgcagtgagctgtgatcatgccactgtaatccagcctgggcaacaggctgagacctggtctcaaaaataaaataaaataattaaacattccttcatgatcttatttccttttaataagatggaggtcacctttattctcataagatagtaactaacatttactgagcacttactacatgtccaacactgtgcaaaaatgtgaattatttcacctaaccattataaccactctgtaagttaggaactgttattaccccaatttgtaggtcaagaaattgagacaaagagggtttaaacaacttgcctgatgtcccacgtctctagagtctacattactctctgataaatagtacttattaccatagttgttactcataggtaatcagggattccattgggttattacacagtatgcaatacattcttgctctgaagtccccagtgtaaaggacagtcctgaaaattggtaccccctgccaaatgggtcttctgcaatgaaatattttaggacctctacgttttccacaaatgccccaggacaaatccttgtctttattcacttcaagaagccccgctatgtgtcttaaaaaaaaaaaaaaagagagagagagaggcgggcacgatggcccatgcctgtaattccagcactttgggaggctggggcaggtggatcacctgagggcaggagttcacgagcagcctggctaatatggtaaaaccccatttctactaaaaacacaaaaagttagccaggcatggtggcagatgcctgtaatcccagctactcgggaggctgaagcaggagaattgcttgaacccaggaggcagaggttgcagagagccaagattgtgcgattgcactccagcctgggcaacaagagtgaaactccgtctcaaaaaaagagagagagagagagagagagagagagccttggcaagctttgcctcctaaagttctcctagaatctccccagattcccacaggatatctctcacctgggactgtcagcatatctatcacctgggactgctaccacctctcatgttgtccctgcacccgcttcacccctgcctgccacttcatcctccacatggcaaccagcaccagcttttcacatgtgactgtagtcaagtcctgatgaccttcatcagacgttgatgtgtccctacagcggctctccccattgccctaacgatggacaccagcagaatctaacacatggtctcgtctgtctcagctcatgtctcactttccctcatctctggaatccaaccacaccaggttttcttcaacgttaaagcctccgttttaagtgtcacttacttgggaaagccttccttgatgtccctagactaagtcatgtcctcctgtcctgttctaccacagcaccaggtgtcctttcttcacagcacatgctgaagttgtaactactcatttgttaatgtgatgatgtattaatgtaatttccccacctcaccctccattgaactatcagctttatgagagcaggcacccaagttgataaagatggccttgccagtgtctacaagagtgtctggcacacactattcactcatgcatcatttgtggagggaataaaaggagaaagggagaaaagaaaggagggagtaaggacataaggtatagattcagctggagaggttagagacacaaacgaagctcaaatagagaaggttcaatacccaaataatagagaccaaggcaagtgacataggacttcaaaagggagattactgggtgtagaaacaagtaacaaagactccctggaggtagtagtgtgtggcctatcgttgaacaaggaagaggaagattcagatattcaggtggttggaattttaagtgctgggtcagaaaggcacatgtaggaactagcaggagggccgggtcccagccctcaactctttttaggagaattaagcaactcttttctcctttttcctctgcctgtcttacccctccttccttgccttttacagctaaagcctccgtagataatattctttttttttttcttgacccagaaccttgctctgttgcccaggctggggtacagtggtgggatcacagctcactgtagcctcagcttcccaggctcaagtgatccttctgcctcaacctcctgagtttctgggactagaggcatgcaccatcatccttggctatttaaaaaaaaaatttatagagacagggtctcactatattgcccaggctgttctcaaattcctgggctcaagcaatcctcctgcctcagcctccaaaagtgctgggattacaggcatgagccaccatgcctcgccatgcagataatattcttaaaactacccaggcatttttacttgtgacattgagcagtcatgggctctcttctcttcattcccatgtcattcagttgccttccagctgggcttctgctggcatttgaagttttttacagtctgttatccacacaacacctagaatgaaccttaaaattttaaatcagatactactttctaccttaaaaccctccatggctatttagggtatttaaataaattctcaactatgcccttcaagacccttcatcctgtggtcccagcctgccttctttatttcacttcacaccacactccctttatgtgcttctgtcacatctgccttcttcctgaaccataagcactccaagctcaaggtctcagcagggcctttgtacagggccaggactagggtgagacaagtgagacacacacataaaatggcactcattctcaggatgcaggatctttgcattagctgtttccactgtctcaaacaccccagatttttgcaggagggtttgtttgtttgcttgtttgtctgaaacatggtcttgctctgttacccaggctagaatgcagtggcggaatcttgggtcactgcaacctctgcctttcagactcaagcgatcctctcgactagctgggactacagaagtgcatcaccacgcctggctaattctgttgttgatttatttcccatctcttcaaagcacatagataccttagtatctgcatttatttgttaggtttatggatctgcttccctgtttaatttctgtctgtccatctaatggaagggcagttccatgagagcagagatcttgactgtcttcttcatcacagtatcaccatcatctaaaacagttctgggcactggttagttgtagtaggtgatcagtaaatatccggggaatgaatgaaggtcacataactcatgttgcattcagaaaagcatctgaaagctaaaaatgtgggccttgtctagccacacagagacaagaaagggcccaagcaaagtactttgcaattgagacatgcacagtttgcatctgttttaatggagtgtcatcatgaattgatctttgcctgtgtaatgtgaggttaatgttttatggagataaccgttgtattgatattttcttttctcacaataaaattagatttgattcctactgttcagggactggtacacccattcatcagtttctgcagtagaaatagcccacagagaaatactataaacacgagagtttagattctgactcagtctgaaagaaagcagaagagctcagtttcagcctgggcacagtggcttatgcctgtaatcctcgcactttgggaggccaaggcgggcggattacctgaactcaggagtttgagacaagcctagccaacatggcgaaaccctatctctactaaaaatacaaaaaattagtcaggcgtggtggcatatgcctgtaatctcagctacttgaaaggctgaagcaggagaattgcttgaacccaggaggcagaggttgcagtaggctgagatcgcaccactgcactccagcctgggcgacacagcaaggtgctgtcacaaaacagaaaaaaaggaaaagaagaagagctcagtttcttgaactacaagctccatgtaaaacaagacatgtaaatatcaaacgtggaaatcgtgtctacaaaaaactattttaaagctcttcgcaaatgttcatggaccaaatagtaaatcctcattccaccctcattttcttaacgaactaataatacattcctcccattcatcagtgaattatgaggcctactggaaaaagtagaccttccaggacataattttcatccagaggtcagtttgggtttggcttcatgacactcagaggcctcactaaaagtgatcctaaggagaaaacaggtctgtaatgccttcccatgcatataaaagtccccttttggatcaacagtcttctcagttccttgaaattcagtaaaagttttctgtattttaataaaataagagctagatacaggttcttatgtcttatgttgccatataattcctattaacctaaagttatttgtaagtaggcttctcattatatttttccttttctgatatttaaaaagtcacagaaattataactgtttgttataaaaattcaactatagggatttttccccccaaacttcatatattttgccatatctttattatgattattattggtttgtttgtttttattgactctgtatcaaggaaacgtttctgtgttggtacatttcaatttattcatttgttccgcaaacattttgtaaatagctgctctgtgccaggcaccacgctagatgtgaggaacgcagtggtaagtaatggaggcaggtgtcttaggttggtgcacaagtaactgaggtttttaattgaggtcaattacttgtgcaccaccctaatagcttgcattctaggggatgggacagacagcaagcaagtgtataactgcatagggcagatagagaatgtggtaggttctatggcaagaccaggcagccactctggctgaactgggaggtggggtggtcagagaaggaatttatagctaaactgaagtttgaggaaataactagttaaatgaagaaatgggaaagagcattctgggcagagggaacggcaagtacaaagaccctgaggaaggaaaaagcttggcttgcgtgaggaacagagatttgaacatgcagagttcaagagaggggcacaagacgaggggcagaagccaaactctgcaggcccttgtggatcatggcaaggagtttggatttgattccaactcccatgaaaagtttccaaggttgaagcagtgggtgtgagtccctccatctagaagtgaactgacagctatggggtcagcagattatacaatggccaagaatagaagccaggaagctgggtacagtctcctgcagtggtctcctgggccattgtgtagtgtcccatcctacgagttgttcttcagttgtcttatgtttttttatttatttatttatttattttatttttttatttttgagacggagtctcactctgtcacccaggctggagtgcagtggcacagtctcggctcactgcaacctccgcagtggtcttatgttttaacttttttgtggcatccttcttcctgggggtactttgtccagaatcatctcactccatgttttgatgggaaagtgcctggtgtataacctgcgtcaggatcaacactgagctcagatagacagtagcagcaaagactgaaaccaaattagaattgagttaaatcagctttgattaatctcaagacagagcaaggaatattctgatcctcatattgtcaaaaaaaattaatgaaccaagtacattcagaatgttttctataatttggtctgaagacatcaatttactatctgtgtcagcactggtcttttccctcatgcagatgtatcttttgcagagttataatcataatgcatgacaattttatattctacttttctatctattctttcatataaatgtatttccatatatctacaatgcctccaaagtaatcatttttcatatatatgattttttaatggttgagtcagttcattgcaagaacatgcttatctattttatatacgtggaggaataggtgaacttatctgttagctatggttcaacattcaggttgtttccaggtataatgaaaacaccaaaaaaaagcagtatacataatatagggctgtctcatttttaaaatcagcttcttaggatagagtgccccaaataggataattgtgtcacaggataagaacattttctggtcttgatcatttattgctacatcatcttccaaagagattgaagaagcagtgtgtgggccaccaaaagcggcaccatgtttgttttcagaaccattagagaagattatgtttctaaaaaggaactaatagaaacaaaagaatctcactgttgtgattttcaagtactccattttgaatgttttagtgagagagaggggaaaatacgtgatcttttatacataggtgagatggtttggtttaaagtcagtgtcacatgtatgtagatgaacccaccacctgcatagttggatttaaggggtgccaaaaggtctcctactctgcaaaacctgaatgcccgaactgactgtcacagagtaggggtggtctgaaaggttcccatgaatgagctctttgggttaggtcatgaaacaccttatcaaggagcaaatgaaatacaagaaggtgtcacaggagccacttttgactgttccgtagaagttagttttaattttagacagggcctatgacactgaaattctcaggctgtaattccagaaaagcggatgaggtgagcaaggaacaacagggcagcctaatagaaaagagatttggacccgggtcaccgggctaattctttactctctctgggatttagctttcttgtccataaaatcaaaggattcagctgatcaatgctttttcaaaatttaaaaaacattttaatataaaattatacaagccatcaccatccccacatataaaacagagagaagtggaagttctctgcttgaagcagggcagggaaactgcccagaaccctatgccccttggcctgtcccttactttcagggatcaacaagttatcttccaactctgtgacccttccccctgggatgtaaattgaatagtagaaatgaaaagacaaagccagtttagaaagtcaccttgaaacctcattgtcctcatctctaacattataaagttggactgaatgatttctaaagactcttccagttcaaaaacatggaaacttggctcacatttgtaataccaacactttgagaggttggcattacaggatctcttgacggcacgagtttgagaccagcctgggtaacatagtgagatcccatctccacaaaaacaaaaaataaaaaaattagctgggcatggttgtgcacacctatagtccagctatttgggaagctgagggaagaggattgcttaagcccaggagtttaaggttgcagtgagctatgattgcaccactgcactccagcctgggctacagagcgagaccctatctctctttgtttttaagtggaaattgtgtatctctgccaattatatcaggaattcacaaaaagtgatggagattagccaaacatggaaatctttccaggaagtaatacctttagggtgattaataactgtgtggctcatgagaaagcatgttgtcaaaatacaagcatgaccccaagaacgcaccctaaaaatgaagtcagacatttcatgtgtaaccaatacaaaatctgaaataataacagccaatatttaatgagttctcgctgtgtttcatagcatcaaggttaagtgttttatatgtcttatatcataaatattcacaataaccacattcattatgttatcctattgttatccccatgtcatttatgagaaggctgaggtttatagaaactaagtatctctatctaggttacacatataggacgaatattaaaagttggattaaatgttcttcaatggacattttcagatctaagcttgtttgggtctgataagtcttttaatagaagctgaaaaggcagagttggggcaaggatttgttggtgagtttctaacataatccaatagaggtgttgagtcgggaccagcaggcttgctccagattgcccagcagacttacccgaaagacagcagaaacatcatcaacagcaacaattttttttaaaaaaccacaatagttagcatcactacaagaagaggactgaacactttgttaagtattttctcatttcctccttacaattctttgaacaagataaaagtaaaattttgttttggtgaggaagcaatggagctacgaggacggtaagtaatttacccaaggaagcaaagtgaaaagtgtaaaggcaacagcatgccttaggacataaggattccctatactttgctcctacatacattagtgtgacctgtcctgatatctctgtggttacccaagtagaattacattttgcaagaaggtaattctacttaccttcacgactgcgagcatctcagccagtttctcgctgcgagtttgtgaattcgccagtctttggtgactttgcagagtgtgtttccattcacctgaactctatgggctgacaaacatgagttcctggacttgtaaacctgaggatctgttcctggggtggcctctgacaaggaaagatgctgtatccgcctcagcactatttaattttccagattaacaactaatagcagcattagccacttattgagccttttctgggaataacattctgggaaagctatatccaaagtggtaatacaaggagtaccaggaggaaagtattagcctagcgaagtgacccagaaagggagtttgagggagctaataccaaacctcacccttttccacaatccatgctgaggccatttccatgacaatgatccaatttggtgtttcccaaagtggggtactatcaggagcacacaagatggcacatggacaaatctggttttaacatgtctttaatagttatgtatctactataatttatgttagaaataagtgttttaaaatttatggtggtaatttaaagtttcctcctagaataaatttgtttatgtggaaaaaataagtcaattgaaagaatactattgagcagacaatactatttgagggaactagggtatggtagaaattgccaagctaagttggaaactgaagcctgggagcactgaatccttgggataacaacatgaatcataattcattataatttgcttttaagtagttccaagagtgaaatgtaataacctccactggacatttggagacgcagaggtgatccacagagtccagggcacttgaagatattgggttgctgcaaaagtaattgtggtttttgccattaatagatataagcacagaggagcagggaagatggtcaaaagagatcccaggcccccacgttctgccagagcacagtgagcaaatgagcctcctgccacaaactgaacccacatttctctcaatccaagaaaaggctgttctaattccaaacaagctcattgtaaacctcaataacatgaagttagtattgttcacgttgctttccaactgtgtttcagatttatataactggttcctaacacataattaactgctgttggaatgaatctttgtccccttgcctccgtgcctgctggacttcatatctgtgtattaatagtcacttttgtttggcgatcttgtgaaaaatgcagactaatttttaatccttaaagagataatacattcacataattttatttttattttttcagataatggcctttcgccatgtggcacatttcaataattttaaaaaaacagttgcaaaatgttatgcagtaacaaatctcccatctttgtcccaagtcacattgctgtcctacatcacagcaaccacgatagttaatttcttataagttcttccaataatactttatacatatacttgtaatactaataaacattcttcttttcttcctttttaaatagtagtaacatactctgcacacacttcttaacttttcttttagttggttaacaatgtatcctggagattgatccacactgatacacaaagatattcttcattctgtttatggttgcataatacttcattgtatgcatgaaaaatttcttttaatgaaggttggtctgtttccagtttttgttattatgcacaatgagaaatgaacagccttgtagatgtgtcattttccataaatacttttataacagtggttctcaaccaaaggtgattttgcccaccaggggacatttgacaaaacctggggaaatttttggttgttataagtggggaggagggtgccaccaacatctagtgggtagaagctgagggtgctgctaaatatcctacaattcacaggacagactcacaacaaaaaattattcagcccaaaatgtcaataatgctgaggctgagaagctccagtctgtagaaaacatttctagaagtggaattgctgagtcaaaggatatttgcatctgttattttgttgactatgagcaaattactctctacagaagttgtaccagtgaacattccccagggccacatgtgagaagcatgttttctcaaaacctcacaaacaccattatcttatgttttgatctttgctaatctgataggggtttaaaaaatagtacttaagtataatttatttgcatttctgttgttatagtgacattaagcatctttccatatgcttaaatatattccttttgttcattttcctataagtttattagtattttatttaatttgtaggagctctttaactaccagctaaacactttgggcagactagttttaacctacattttcattgtcaagagatttttatccacctgccaatttttctggaaatcttattccaaatcatttccattaaaagttttgtcatagggttcacaataatcactttctgctgcatacttggttttacttgctgttccttcaatcaattaacagatattaattgaacatcgcctcagtgcaagcagttatttcctgaaatgcaatgaagtttttatgcacttatgtattttggctactggtccttcagtgcttaaaaagaagacacaaaaaatacgttctttcaaactcatttaacatttcatatttcttattctgggaggaaggtctttgaaggaatattcacagctcagagatactgacagaaacaatacagaggatgccttgagaatctactttatgcttggaaaatatcacttagttcttgctcctaatttccacataagtccttttctctctgctcccttttgtaagaaaatctaaacacacatgttttcaacatgctaggatcatgttaccttgatctagtaagaatggggcttggacattattcctgagttatcatttcacttataagataaatatacccatataaaagcacactgaattactttattagaatctatgaagaaaaaggctatccctcaagaagaacatgagagagactgtcatgtacttgaacccccatggatacagatgagcaggtggcaggtgctctctagctgctgctcactgctaatggggttatgcggttacaagggcgtgcatcatttcgcacacccagcatttgatgcataccccttattcctctcccataatcatctaagttgacactatgatgtttttgaaacttctaactgtattaaaatattattttcatttctctgcttttcctcctgcttcacactctctgtaaaaacttcaaatatcataagaatatataactttgtgaaattctgccacagtggaacctacaacaaagaaccagtgttagcagcttggaatgtttttcttcttgtattatttctttggatattgcatatactaatacataatctcttcttccaaaaatgggatgatgctccatctgttgctttaaatctgctctttaacacttggtatatacttttgtccctctgtatagatgaactttattatctgttaatggttacagagtagtcattatgtatgatgacgaatttaaccatacacagatggatgtttaaccataactaatttaaccatttgtctattgatggatatttaagtttttccagtttattttagtgtaataaataatgcttctgtgaaaatcctttttattacatctttatatattttgaacaaatgtttccatagaataaatcagatcagggaaatgtatttattcattttagttaactgtttttaatattataaaagaaatacacattcatggcaaaatattcaaagagtacagaaggatacaaggtaaaaagaaaagctccttgggaggccaaggcgggtggattgcttgagaccaggagttcaaggccaatctggacaacagagcaagactctatctcttaagaaaaaaaaaaaaaggaaagaaagaaagctctcttcacactccctactcccagcccccaggaccacccacacaggtatctgctcttcatagtttcttatgagaaaacacattttaatagatgatcctaaattgccctctgaaaactgtatgtaagaataattctttttcttttcttttctttccttctttgttcctttccttctttccttttgaaaagtctcacttttttcatttgggtggccagggtgttactattttcaaatggcaggttttaaaggaagtgaaattgttttcctcatagcacatccagccacatggtaacccacagtgcgaaatgctgaggtggagaaagccagccaacggtgggccagtgatgagtaagaggtcttatggaaaagaagagagaaacgaagacaggtgtgggatggatcagtttcctggctttaaggtggtccagggagccttgaaattaatggtcttagctccagactttcccagagctttagaatagagggaggttaggtctagctgaagatgggctggggagggaggaactaggaacagctcattgcaaattgctctggtgttttacaagatgctaatttttccatagagacagtaatgagcatatcttttttgttttgttttatcttgttttgtttgagacagtgtctcactctatcacccagagtgcagggacatgataatgactcactgcaacctcaaccccccaggctcaactgatcctcctgcctcagcctccggagtggctggtactacgggcatgtgccaccacacctggctaacttttaaaatttttttgtagagacagggcctcactatgttacccagactgttgttgaactcctggcctcaggcgaccctccttctttggcctcccaaagtgttgggattataggcatgagccattgctactagcatttgctagtaggtttatgtaattttaaaaaattctcttaattaacttaatgattcagagactattcttatgtcgcttttgaaaaatgaggcaactgagaggttgagacacttgcctcaggttgcacagctgataaggaatgaggttaggatgcaaacctgagtctgccctacttgaaagctccagttctcccctactctgccttaccagaggagaaagctgaaaactgctatttttttagaaacgtggagatgtccttttcccatgggtagcagacacataacttctcatcgacacatttgctgggctagtccagcagcaaaagagccaatgttgttggagcaaagaggagtggctattctgaggaaccagggagtgtgttccacctttgcaatccagcataagcattgctcagtcaaatgggacagaaacaaagctctgcgagtccatggcttggtgaaatgggtcacacaattgattttccagcactgagttcagggaatgatagtcttctgtggaaagtcccagcaagtgctaagccaggaagcatagtagttaggttatcaggctctggagtcatagagtggagcttgtacgctgctcttctacgtattaagagggttggcctctgtgaacttcaattttctcatctataaaatggggagataatatgttgtaggatcgtgatgaaacaggatggaatgttgaatgcctggaatatagaaaatgttcaaaaatagtatcattttcatgttttttcctgcttctctctttgaaacttataatccaagctctatttcataaaaatattaacataaaaagccgccctgccccctcatctatctatcaagcaatgcacatttatgggaaacctgatgctgacccatttgtaaacaacctgtttctgggttggggttttgtacatagcagagcagctccttctctgtgagatctattgaaagtcagcccttaatacaagggtttgttaaaaaagagaaaaagaaaaagaaggaaagaaagagagaaaggaaagaagaaaggaaaggggaaaagagagagagaaatagtaacataaaaagaaaaaagatataaaagctgattgcacaagcttacccttgtgaagatttgtaagcatcagcatcttgaattgtgtctgacacgtgtcagatgcttgggatgaaacatcagactatgaggatggcatatctttgaacgtggccaagaaaagagacaagggtaagcaaggtcctgtgactttcgccccaagtaatgcagacagaataacaagtaagaatgagagcaggttgtacttggcctctccctttctctggtggcttttgtgtggtttccttggaaagttttaccctggcatttttcagaaatagcacagttgtttgggatgattataggcaatcaccctttcccagagactgaactgtgtcgggctcattgaccagccaccccccggggaccaactagggaggacatagctggtcctgctgtttaccaagtattggatcttgtgagatgccagaagaaccaacctcagggtctttggaaagactgaccaaccagtcaggatggattgtggtggtggatcccaagcactcatttgggaatgagagtgacgttgacggtggaacatgaaatccatcccaacagaagagcaagcctgagagcaagctcatctgacagcctgttaaggcacaggcacaaaggaggccatgtgagttggtaggagaactcctccttggaaatcttggagtctcgctgtccactaaggtaaccactagcacctgaagtctactggcataggggtctactgagcacctgaagtatggcaagtgcaaattgagatatgcacaaaatatacaatttcaaagacttaagtacaaaaaaaactcattaatttttgtgtggataacaatttttttaatatactacaaccaagtaagattttattttcacaaatgcaatgttggctcactatcctaaagtcaattaagataatatacaatattacttgaataaatgtcaaaaaagaacatttcaataaacaaagaaaaatatttgacaaatccaacactctttgtgataaaacccccagtacactaatagaaaaaaaattttgagtcttgcaaaaagtcatctatgaaaacctacaactaacattatacttaatggtgaaagactgagtgctttatctgtaagtttgggaacaagacataaatttccacttttttttttttttttttatggagtcttgctctgtcacccaggctggagtacagtggcatgatcttggctcactgcaacctccacctcctgggttcaagggattctcctgcctcagcctcccgagcagctgggattacagatgcgtaccaccatgcctggctaatttttgtattttcttagagacaaaattttaccatgttggctaggctggtctcaaactcctgacctcaagtaatccacctgcctcaacctcccaaagtgctgggattacaggcatgagccactgtgcctggccaatttccacttttaacactctattcgacactgttctgcaagtactagccagataaattacactataaagtgaaatgaaattctccagattgagaaaaaaaagtagaactctttttcattgcacaccacataattttccacaaaaaaaaaaaaaaaaaaattgtaaggaacttcctaaaaacccactaggactattaaacaaattcatccatgtcaaaagatacaagatcaacatacaaattaatttttttaacttttattttaggttcagaggtacatgtgcaggttttcatataggtaaattgcatgttgcaggggtttggtgtacagattatttcatcacccaggtaataagcatagtacccagtaggtagattttcaattcccaccctccaccctcgagtaggtgccggtatctgtggtgcccttctttatacccatatgtgctcactttttagcccccacttacgagaacatgcagcatttggtttttagttcctgtgttagttcacttgggctaatggcctccaactctacccatgtcgctgcaaaggacacaatctcatacttttctatggctgcataattctccatggtgtatgtttaccacattttcttttcttttcttttctttttgagacagagtcttactctgtcacccaggctggaatgcagtggcacgatctcagctcactgaaacctctgcctcccgagttcaagcaattcttgtgcctcagccacccaagtgcctgagattacaggtgtgcaccatcatgcccagctaatttttatatttttagtagagatggggtttcaccatgttgcccaggctagtctcgaactcctggcctcaagtgatctgctgccttggactcccaaaatgctgggattacagatgtgagccaccacgcctggcctcacattttctttattcattcttttgttaatgggcatttaggttaattctatatctttgctattgtgattagtgctgtgatgaacatatgtgtatatgcgtctttatggtagaatagtgtatattcctctgggtatatacccaagaatgggattgctgggtcaaatggtaattctgttttaagttctgtcagaaatcacctaacaatttgaaatgataatattttagatattgggttaaacaaaatttattgttaaaattattacttgttatgttttgcatttttgaatgtgcctactggaaaaacttttaagttacatatatggctcatgttacatttctattggacactatcactttagaacttcacatagaatttttatccctgttcacaattccagttaatatttgcctccactgtctgccctcatcacaatgctgctaggctgttaacaagccagacttacccagtatttttctaccccaggattttgccctggctgcttgctctacctgggatgctcactcccctagaccttctcccagatggctcctgttcgactttttggtctcttcttagatgccctttctctctccagagaggtctgccttggccacagtttggtcacatcaactgttctattctctttccagcacttctttgttttgtctgccttcccaagtatactacgggctctgtgagagtctatcatgttcatcagttcatttcctgaactcagaatagcacctcactcatagctggccctccataaatatttcctgaatggctaaatgtactagccttaaatctgtttaagattgtttaaactgtgttccaacctgacaccctttgttttgagctaattaagctccactgagggccagccactgctgggcactgggtatatgggaagatgccctggtctctgaccttagggagctcaggacctagtaggttccaaagacaaaaatgtcagcaaatggagttgtcatatcacatgccatgagcctgttgtttttatttcactatgcatgccctaaagaaagaacccaacagaggtcaaaacacagcaacctcaagctcgtgcaccctgtttaccagtagctgcagacagttcttgaaaaggcagctccgctgtgctctactatttgtgaaaaaacaggttaaccattccaaagaactgtgattatgggcaggaccagagcttgcatttctaacagtaaatgagaagatagtttgagcccaaagggcacgtttgcagaggcttttgcgggaagacaaacctcctaatttagcattagactacaaaagcaagttctagactgatatgtagagcaagacactcattttcctttatatataccctataaaagtgcagggaaaagacaaatatactccaaatgattaactttggctacctcagggttatggggaagggtgggataataacacactataaatattttcttcacatgcctctgtagtattttgttttgtttgtttgcttgtttgaaacggtgtcctgctctgtcacccaggctggggtcgacggcaccatcactatcacagctcactgcagcctgaaacatatgggcccaagtgattctcccacttcaccctcccaagtagctgggactacaggtgcacaccatgaggcttggctaatttatgtaattttttgcattgtctcactatgttgcccaggctgctctcgaattcttgggctcaaatgacctcctacctcagcctctcaaagatctgggattggctgggcatgttggctcatgcctgtaatcccagcactttgggaggctgaggcgggcagattgcctgagctcaggagttccaagccaccctgggcaacatggtgaaaccccatctctactaaaatacaaaaaaaattggggaccagcgcagtgactcacgcctataatcccagcactttgggaggttgaggtgggtggaccacagggtcaggagatggagaccatcctggctatcacggtgaaaccccctctttactaaaaatacaaaaaattagctgggcgtggtggcacatgcctgtagtcccagctactcaggaggctgaggcaggagaatcgcttgaacccaggaggtggaggttgcggtgagccgagatcacaccactgcactccagcctgggcgacagagcaagactccatctcaaaaaaacaaaaaagagaaaaaaaaaagatctgggattacaggcattagccaccatactgagcctctacagtgttttcatttgtcacaaaaaacataaatagattttgtactttcaataatggataaagttgtttttacttaaaaaactaaaaaccagacaccacaaagctttcctgtatttgatagggtctgcttctcgcatcttgaattttttttatctcagttctgttcctcagctactaaatcaaagatcagcttccgggctgaggacccaaaaacaggaagtaaagactgaattcactttgggagaatttgatgatgtaatgggtccctggatatcaaccaagcacgctcatatatcacaaatctcttgcgatagttaaggcttccttaacttctttaattgggaagataccctttattgagggcatctgttataagccagttaatttgttgacatcatcctattttattccccaatcaactctcaaaaggtaggtattatccccacttatcagatgtaaaaaccagggttctgggaagtttaatgaattgcccaaagtcacagagctcttatagtaagaggcagagacctactttaaacatagctttcccaaacgtgtgctcatttcaccatcatttgctacctccttaaaaaaataaggtagaatggggtttgggccacaatcctgaacaccataatcccaaatattgaaatacaaaatgtaaaaatacccaaaaatataattctggaaaaaataattttaaaaacttttttaaaagacatttgtttacattttaaagtggatttatttgagaaacatatgaagacatgacgaaatgcttcataggccaccttgtgcaataaaataggcaataataatatacatatttttgcaaacataaacacccaagtatactaaggacagtcacatgggtataacagttatgagcagacaaactatattcctaaagaaatagctggtattcaaggggaacgccttcagctttcgcccattcagtatgatgttggctgtagtttgtcatagatggctcttattattttgacgtacgttcctttaatatctagtttattgatagtttttaacatgaagcaatgttgaattttattgaaagccttttctgcatctattgagataatcgtgatttctgcctttagttctatttacgtgatgaattacatttattgatttgcatatgttgaaccaaccttgcattcctaaagcctacttgatcatgtaaaaaaggattagccttttttttttttttttttttgagtcagtattgctctgtcacctatgctggagtgcagtgtcatgatcttggctcactgcaacttctgtccacctcagcctcccgagaagctgggactacaggtgtgcaccaccatatccagttaatttttgtaattttttgtagaaacagagtttcaccacgtttcccaggctggtctcgaacccctgggctcaagtgatccaccctcctcagcctcccaaagtgctaggattacaggcatgagccaccacgcctggctggattagcttttcgatgtgctgctggatttggtttgcaagtattttcttgagaatttttgcttcgatgttcatcaatattggcctgaagttttcttttttgttgtatctctgccaggttttggtatcaggatgatgctggcctcatagaataagttgtgggggagacgctcctcctcaatttcttggaatggtttcagtaggaattacattggctcttctttgtacatctggtagaattcggctgtgaatccatctggtcccaggctttttttgggtggtaggctatttattactgattcaatttgggagtttgttatggatttgttcagggaattaatttcctcctggttcagtcttgggagggtgtatgttgtccaggaatggattcatttttctaggttttctaatatgtgtgcatagaggtgttcatagtagtctctgattatttgtatttctgtggggttagtggtaacatcctctttgtcatttctagttgtgtttaattggatcttccttcttttcttctttatgagtatagctagtggcctatctatcctattaattttttcaaaaaaccaacccttggattcattgatcttttgaataattttttgtgtctcaatctcctttggttcagctctgattttggttatttcttttcctgtatcttaattacagagattatgacacaaatgtatacatttgtcaaaactcactgaaatgtacattggtaaattttattatatgtaaattatactttaataaagctgatttttaaaacaaaaaaactaatatgcaatatatttcacctttaaatttttttaaaaaagaaacagcttatataaccatggtcatctgaaatgctatgatagacaacctaagtcttttaatgagattaatcaaaaacagcagaagaaaattctgtcccaactctcagagacagactaatttgccttcagtatttgttctcttagggtccctggctgattcaatggtgtccaccaacactgagggcagatctcccccacctcgcccattctgatacacatactagtctactctggaaacaccctcacagacacaccccaaaataatgctttatcacgtatctagatacgtctctttttttttttttttttttttttttttgagtcttgctctgtcgcccaggctggagtgcaatggtgcggtctccactcactgcaagctccgcctcccggattcacgccattctcctgcctcagcctccagagtagctgggattataggcgcccgccaccacacctggctaatttttgtatttttagtagaggtggggtttcaccatgttgggcaggctgtctcgaactcctgatctcaggtgatcttcccgtgtcggcctcccaaagggctaggattacaggcgtgagccaccatgtccagccttagatactccttaatccagtcaatttgacacctaaaattaagtctacaagtccatcccttgtctatttggcacccatacatatcttaaaccacacgtaatttccaaatgaagacaataacaaagtaatagttctgcctaacaagatgcaactaacataatgaggctatcctgtgtacaacagaaaattcactaatcgtgatttttgagattttagatgttaaggacttagacttcagggatttttatcattcaggatttcagcattcaggactatgacattcagaatcgtgtcttttgggattgattggtagtgggtataatgacgtattttgcaactggttccatagctgaattccatagctgaattctcaatggcagctcaattctaggtacctgtgagaggcttcttccatccagaagcactttcctaactatctttccttggagcctgatagaccaccaatggaatttgttccattggctaaagcatcaaatcccctgagatccattctccaagcacaaggatccttagaaataggtaacatgtaacatcattataaatcacaaataccatcatgtgaattagttatcagggaaatacagctagcaagtttccaaggaaatgagacacaggcccagtagtatttgatggggaggttggggaggacatggagaagggatagttatagatcagagtcaggaatgtcctttgggagtgtcattgtgggactgcggataattaaaggacatggagaagccagaggcagaaaaaaaaaggtgccactaagggtatgcaccacaatccaggtcgggtccgagctcaattactatgctaatatggtcatggatagacacagagaagagaaaattgtcatatgtgtgtccatggatttctctacgcatctcagctacaagttctgccaatgctgccatttgtcacaagggcagtggggtacatgaccccgtgtctcactgagtggaaacctgtcaccaagaagaagactctaaaggcatgtgtccccaggagtctgctcagagtgtttatcccacacttagggccaggaggcagttttggatatttggtttggagggttggaataggtttaaaaagccaatggatcttatctagcagtagatttctggagcaatctggacaaaaatattgtcttctttcttacatgaatgggatgttcttctctccccacagaagaagcgcacgctgaaggggtccattgagctctcccgaatcaaatgtgttgagattgtgaaaagtgacatcagcatcccatgccactataaatacccgtttcaggtaagtccatcaggtgggtagttccccattccctggactgtggttaaaatcttcagtcacagccgggtgcagtggttcaagcctgtaatcctagcactttgggaggttgaggcaggcagatcacgaggtcaggagttcaagaccagcctggccaacatgaaaccccatctctactaaaaatacaaaaaattagctgggcgtactggcgggcgcctgttatcccagctactcgggaggctgagacaggagaattgtttgaacccaggaggcagagttttcagtgagccaagatcgtgccattcactccagcccaggcaacagagtgagactccgtcaaaaaaaaaaaaaaaaaatcctcagtcactgtgagagagggtggacacggatgactctctgcctctctgctccaaggttaggacttagacaaatcccattaggaaacgtatgtgttccttccatcagtgacatttatttgttaattctttcacttattgaacaaaaattaagcacaaaatcttgaaaaggtggttattccttatacccctttccctcatgtcttctcttcctcaaggaaagtcctaattagtgaaggaagaaataaagctgctatcagcggcctgaaacctaatgtgctttaagtgcagtttactcatgatttgaggcaacatattgcaattgctgggtatgaattgcttggagattctgaggcaaaaagattcagattttataatctgaggactatctggaatcgcactgtctagtacagtagccactagccacacatggatgttcacatttaaatgtattaaacgatattaaaaattcagcttcttagtcacattgggcacatttcacatgttcaatagcaggacatggctggcagctactgtactgaaacagcactggttatagaatgttcctatcactgcagaaattttttttttttttttgagacagagtctcactctgtcacccaggctggagtgcagtggcgcaatcccggctcactgcaacctccacctccctggttcaagtgattctcctgcctcagcctactgaatagctgggactacgggcgtgtgccaacactcccggctaatttttgtatttttagtagagatggggtttcaccatgttggtcagactagtctcaaactcctgacctcgtgatcgacccgcctcggcctcccaaagttctactgaacagagctggtggagggtatctttaaagtccttgtatatgaatcttggcacttctggcttcaaaggcatggatatctccttgcacatcccagggtaccattcctgcttgccaacctgagggatgaacatatttttaacatggcatagaaaagaactttttttctactagaaaagtgaccctcatgagttggaattttgaggactgaaaataaaaggaatagcatgtatttttcagttgttcaaaatctcaatgataatgagtgcctaaaagagaggtgaaatataaagaagactgcagtttagttaacagtattgtaccaatgacaatctcttggttttttttttttttaatttttttttattatactttaagttttagggtacatgtgcacattgtgcaggttagttacatatgtatacatgtgccgtgctggtgcgctgcacccactaactcgtcatctagcattgggtatatctcccaatgctatccctcccccctccccccaccccaccacagtccccagagtgtgatattccccttcctgtgtccatgtgatctcattgttcaattcccacctatgagtgagttttgaaagatgtgttgtggttacgtaagatgtcatcagtggagaaaagtaggtgaaaagtacacaggaactctgtactatttctggaacttcttgtgagtcttaaactatttcaaaataagaagttttcaaaactctcattgcacatttgtcatataatatctttctcttccatgtgccagaaatatttttttaatcactaaaaacttaagatgagaaataaatgtggtttctagtcaagaggagaactttctcctgctgtcttagtttagtgattgctctcttggggcatggaatctgagacgagcagctgaaactgcttaccctgtgtttttgtagcacccaaacacctggataaaaaggatactggccccctaattacccaaatgtttgcctatatgacgataaacacccgagaccccactctcggctcagtaggtctgctgtcagtcaactatctccatgcacgctgctcaccttgaactctgtgtgtgtgtctccaggtggtgcatgacaactacctcctatatgtgtttgctccagatcgtgagagccggcagcgctgggtgctggcccttaaagaaggtaattaaactcctttgccattgaatcactgacactcttgatcctatagtagggttgggttccacaatagaatagagtgtggtgtgagagcagctgatggctgatttctcttttggggttggtggaagttcccaagttttcatcctgggcccaggaagcaataactggtatcattcagggattgaccaaatccagcctgctgtctgttcttgtcaggctctgagcaatatttgtatataactcatttcaaatagtttaataagtacctacataagatgcttgattttgtctcatggtcagtaaaacctaaaatatttactgtctggccttttaagaacaaatttgccaactcctcgtatagtatgaagaagcagagcataggccctcatgtgagatgacctgggtttaaatcccagtctgtcacttgctatgtacacttgggcgagttccttaattgcctgtgcttcagtttcccatctgtttaaaaggaagaaaaggaagggataacagcacctgcctttggagctgatgtgagcaaagtcctagaaactaggttggcccatagacagcatgcaataaatatcagctagctttcaagcttttcagaccattggtaagggtatttcttaagccttaccttcctgatggcacagttagaggcagcagtgtttaagcacatgggatgtggagccaggcatgaaggtgaaaatcccagctctgccaatgattagcatgtgaccctgggtaagttccttgaccttcgtgtgtctctataaattttgactaaaaacagtcatggagctgttgtgagaattgaatgattgaggacttagaaaaatacccatcccaaagaaagccctggatcaatgttaccattattgttctttagcctgaagcactggatgtgtcagaagatctgggttcaaatactaatctgcctctacgaagctgtgaggaccaaggataagcaaactatttgttatctctggagctgcaattcctctatctgaaaaaaatgagaatagaaatacaagttgtatcttatcccgaggttgttgtgagccttaaatcggttatgagcagacaagtgctgggtgaatggggaagtgctctccgttcttacagtcttgggacatacagcaaacacaaaagtaagaagtaatcaaaatgggctgggcgcagtggctgacacttgtaatcccagcactttgggcagccaaggtgggaggatcacttgagctcaggagttcaaggctacagtgagccatgctcatgccactgcacttcagcctgagcaacatagtgagatctcatctctactaaaaataaaaacattaggcaggcatggtggcacatgcctgtgctcccagctacccgggaggctgaggtgggagaatcacctgagcctgggaggtcaaggctgcagtgagccaagtgagccgagcctgggtcacagagcaagaccctgttcttaccccaccaaaaaaaaaagaagaaaaaaaaggaatcaaaagggccccagctatggtcattggccatttgccctctgtgaagggattttatacacagggtgttaaaactggaaggaatattagagattagatatctagttctgtggttggttcatttatttatttattcattgagacagtgtattagtccattttcacactgctataaagatatgcccgagagtgggtaatgtataatgaaaagaggtttaattgactcacagttctgtatggctgggaggcctcaggaaacttacaatcatggtggaaggtgaaggggaggcaatcaccttattcacaaggtggcaggacagagaatgacagaaggaggaacttgccaaatacttataaaaccatcaggtctcatgagaactcacgtattatcacaagaacagcatgggggaaaatatccccgtgatccaattaccaccacctggtctctccctcaacacgcaggaatcatggagattacaattcaagatgagatttgggtggggacacagagccaaacgatatcagacagggtctcactctgttacccaggctggagtgcagtagcacaagcatggctcactgcagcctcgacctattgggctcaagtgatcctcccacttcagcctcctgagtagctgggactacaggtgcatgacaccatgcccagctaacttttttctttttttttggtagaaaaggggtctcgctatgttgcctaggctaatctagaactcctggactcaagtgatcctcttgcctcggcctacgaaagtactgggattacaagcatgagccactacacccaactctgttctgtgccttatgtatgtatttgtttcagtagcagaccccccttttttttccaaccaaaatcttacttcaaagccacaaacctagaagggagaaaaccaaagtggctgtggttaaaggtaggagaggtggggggtggtaattccaccttctcaaccttctcattacccttaaggcacctttgtagagcccagtgtttaacaatctcattgcatagtgggggaaactgaggctcagataagggtttgcccaacttaagaacacataactaatgcaaggcagagccagacgcaagcctagatgtgctgatgcctaaatgtaacatgaactaccccagtaaatagcacagtgcatttatgcgctcagatcaacccatgcttctgagtggtctgggcaatactcattcaggctcactcagccaggtctaatctcgaggtgttataaaattggtagcccttgatagactgacctggaaataactcttctgttggtgccaacctgtttcagaaacgaggaataataacagtttggtgcctaaatatcatcctaatttctggatggatgggaagtggaggtgctgttctcagctggagaagcttgcaacaggctgtgcccaatatgatccaaccaagaatggtaagagactgggaattccctctagtttttgtgaaatgaccataaaaaagtaaaagcttttggcctttaatcattgagggtgtcaggaacagaatgcaaaattctacattttcagaattttccaagaggaatcatctgtctttcctaccagcctgttggtgcttccatctcaaagctgatgtctacagctcctaaccacttgaagtgtgctctttggaccagcagcatcaacatctcctaggagttagttagaaatgcaaatgatctggccccactcatgacctactagatcagaattttcattttaacaagatcccaggagacttatgtgcacagtacagtttgaggagccctgctataacctgcatttgaatggcatggtctatttaaatcttaattaaagaggcagccttaagagatataaaatatttatgtcttacagtgacatcatgtcacacataaatttaattacacaaattcaactctatacccttaaaggtgagaggaattttttttcttttacattttactctgtgatttctccttgcctcctcttcaaacttgcccttgacctccacagtctcagagaggagaaggccgcagtctaaatgcaaagtgaaaacaaaaaaagctgtttttttgcctttgacagtaaaggctcaggtccaggggattgggctgcaactggattttattgatgactttggaaccttaacctccagtcgagtacaactccactcgaatgcatttcacatttattatgctcttgttcctctcaaccatctggggtacatggcgtgatgttaagggaatgggctgccttgagcaattcagtatgctccgggtcacaccgctggaagtgctctgcaaatccattgtcgaataggaataatggcccatgtggattgttttccttccattttcctctcttctcaacctcttttgccatagtttccctttctcatttattcttttgtgcgctaaaacttaatactgaaaattggcaacccaaggcggatgtaacacatggctaggttttctgtggcttcctgattcataggccctctcattgccactttaaaaaccaccacttttcaccctgcaccttggggaaaaaagctcttagacataatcgatccctgggcccagaagaacaatacttaacaagttttagaaattggtaactattcaagtgatcctacacattagtcctgtttaccatattcatgcgggccaatatttaataaaaatgaaatggaaagttttctctggataggatccaccataataacagaacggcatgggcttacctctgtgagtgaaagccctttccaaagtcagtgatctggtctccaaatttctgccaatgccttgctgtgggccctcagatgagtcacgtggccatcaagggccccaatgtcctcatctcaaaaatggcagggagttctgaggggcttaggatgaaataatacctaagcccttttccaattctgaaattctttgacttggtatttccattttgtaattttcaccatgcatgctgcagctattcctcttcggggcgcaagtatttccctcctccaagtgatacacatgtgactgaggtgctagggacatctgaatgactcaccagaatgccagtgggggaggactggtcatgctgagctgttccccatgtgaaaccagggcctgagcactcttggggtcctgctgtggttgtcatgcagtcactgtgctaatggttttgcttttgcattgcaacccattgccatatcctcctctgagcatctcctcactctaccctcttctgatttggttaaataacttcatggatctgagttttgcacagttgagagcagagttttcaagaagcacactgcactgtgaacgcagcttatggtcatcaccctggatgaaggctcacaggattcctggtaccgagcacattggcagtgcgggtctatgagcactgggctttggataatccctctgagcctctaagagcattttctcacctgcaatatggggataatgataatagatagctatgtgtaaggctgggagattcaatggtgttgtggaaagcagtacagctgccaacatttacagagttcttgataaatggtaattgtgtctacttgtcttccttattggtggatgaaagaatctgaggctgagatatagcctcagaacttgtatgggtctgggaagcagcagaagtggatgagtaaaaacagacccagccacacccaacccatagtaacacccatttctgcaaccagaactggccctgatctccccactgtggggagggaaaggaaggaagggaaaagcaaggccagaggacgaagaaagagagaccagtcatagaatgtccagggctggaagtggccaaggctcacagctagtattggtgaagccagagttagaacaccagtctcccagctccaagttgagttctaaataggaaccatacttcctattacaggggttttccttcttctgtggtcattgtatacccaggtcactatcccagcctactctttcttggcaagtctgcacgggactgggctccagtgtcaatgtgtgactctcctctaccacatccctgatgtgagctgtccaacttcaagtcaacctcatacagaaatgaggaactcatcgtctacctatgcagcccattctcttcccatctctcgttattaaggacgtctttgtattagcctgaagtctgtgcagtgcctcccgtaccacagagagccccagacacagccacacacctttgattcattgagtccaggaatggcctttgcagagctacaaaggagaaatagtgagagatgcatatgaagagatgagaggaaggagagagagaaagagaaagagagaggagaagagaagagaaaggaggaaagagggaagagagaggagagctaaacagacggagacatggaaacagagataagcagaaagacaaagacagagagatgctggggttggtatagtttgaaagaggcagaaagaacacatattcagatgccttaaggcaactaaaagtggatcccagcccactcaaaaagcagcacaatgacctcccacctcagccaccccctcctcaagcccacaaccatatcaggaagctagtgagtcactgtccccctgagtcaccaattcccactcctgagcttagcaggtggcagagacattcccggaagtctctatgcctacagggaagggtgcaagtctaaccccactggcaggcttttcctgggaatacagaaagagagggcccccgaatatggacttctggaagcttctggtgtgtactagaaaagggaatcagaaaccagcaggcccaaggagataaaagacagcttctgacaaggccaagtcaggtttcactgtgtcttattgctccttctggccccctttcttctgttgttttcctgggccctttttctcagaaaaaccccctggctgctcacttccggttgggtccattagttttcatgctcattttttcttttcctgtttttctcttttcagcttcaaagaagcctcttcctcctactcctgaagacaacagggtgagtgagagcgctagctccgggtgcaggtgggcccacaggctacctgattggcatgttcctatttgcatgtccccctctccccatagttttcaaaccctggctgcatgcagcaggctgtcatgattcagcagaactcaacacattgggtatttttgggcttgaactctcttggggggtctgtccacttaaaggaccattcagctgctaaatctccatctcactttatttattcaacaaatactgatatcaaattgggtggccattcacctgaccactttggagtatagtagcagctcactctacataaaagtgtgtctggcatggtggctcacgtctgtaatcccagcactttgggaggccaaagtgggaggatcgcttgagcccaggagttcgagaccagcctggacaacaaagtgagacccccatctctagaaaaaatttttaaaaattagctggtgtggtggtgcacacctgtagtcacagctacttagcaagctgaggtgggaggatcacttactcccaggaggtcgagactgcagtgagccatgactgtgtgccactgcacttcaacccgggtgacagagcaagaccccgtctccagaaaaaaaaaaaaaaaaacaaggtgcacatctactcttcgcaagcattttggagacatacatttgttgatattttatatatttcaaagcacttccacccctttattatctattttaaaacttactatccgttctatccacttcagagggttttagttttattctcattgtaaagcttgggaaatcaaatcccaagacaggtcttgaggcttttccaaggccattcagcaacttagtaggatgcaaggtttctggcgtggtggtctttaactcgagtggtggttctcaaagtatagtccatggaccagaagcatctgcatcacctgggagcatgttagaaatacaaattcttaggccccacccccagacctgctgtgtccaaaacgctgggggaggggcccaggaatctgcattttaataagcctcctcactgatctataatatactgacttacaagtcttagatggcatagtacctactctagggcagcttattttgttaaggagatgaaaaaaaaaagatgggggaaaggatcatgacctttaggtagggaatatgaccctgaccttatgataatattaacaccaatatccacttttctttcttttttttttttttttgagatagagtcttgctcttgtcacccaggctggagtgcaatggcgtgatctcggctcactgcaacctccgcctcccaggttcaagcgattctcctgcctcagcctcctgagtagctgggattacaggcgctcaccatcatgcccggctaatttttgtatttttaatagagaccgacttttaccatgttggccaggcaggtcttgaactcctgtcctcaggcgatcaacccacttcaacctcccaaagtgctggaattacaggcgtgagccactgtgcctgaccaatacccacatttgagtactcgctcttcattccagagcaagttctttaacaagagctttcagattccatttcctcatgcttcttcctgaagaatgagctctgccttttttcccttcagccaaaatggtgacatttcaaaactggcagcgtccccataaaggaagctctaaatcctcaaagccccagcctggtgtttagatctgtcatcagcctactccctcacaacatgagagaaatgtactgaaactgtagcagagaatgagctctctctccttttctttcactgaccttctgcagactatttcaccatcccctttgaaggcctggttcggaaccctactgccctcccttgcagacggttccctcaacagtcccgcctaaacccacacctcccatcttaagtgaggctgctcttgtgtctttatttttggtatcaatgaaggtgaaagccagaaaacactgctggtccttctctccctacactctgccatttggcttttcagccttcttggaggagcatcgtggatactgttttgagtgttctgaccacaaaggttttggaatcattgttctagtttcaaccgcatgtctaaatccaatgcaacggttctcttgtctgagccacttgaaatcatttctctcctcaccttcttgttctgctgcctgagtggtaatgacatctcgggttgtcatacagagaaactgtttttaatccagtctgagccaacaggtctcatgctctatgtgagaaacactgtgagcagggccagtcctccggggactggccagtcctctgggggttgggggatggctattttggttcaagatgtaaaatatccatggtcagagtgaaggacaatcctaggcctcttttgcctatggatacaaacaaggtcgtatatcacattgaagtacaaattccgattcctcttggccccctgcatccatgggaactcaagtcttcctcttacagtccctcccagtcaacccagggcttgctgaggggccactagaatgtgtctgcatgtgtcctttcttgctggctgcctactaaggcaccctatccctgccactgctacctgggctctctgtgagggcccctcagccccgtggagctcttcccacctggggccagcagaggtcctggggggtcaggttgtgctgaggcctgcagcagagtggtcaggaggcaggatcctcattcctttcatgcctcaccacatcatggaggctcccaaacaacccttcctgagcccacagactcagtttctccaaatgccatcccttgattttctcactcaaatctaatggttcccaaccttatcaaactcaatcctgccttttaatgacagatattttgtaaggttccttttgttatcctgaaaagaaatttataactaatataacatatatatacacaattttttaaaattaaagtacttaattaaaattttttgttgctttgagacagggtgtcactctgttgcccaggctggaatgcagtggtgcaatcatagctcactgcaccatctgtctcttgggctcaagccatcctccctcctcagcctccgcagttgctgggactacaggcacttgccaccacacctggctaacttttgtattaaacatactttttaaaaagaatcaacaaatgttctaactgtaatatttaaaaaggaaagaaaaataatatatataacaaaatatgtgtttctatataaatattgggacatgactgcactggaagacagaatgaaatagtcgaattcttgcactggcaggtaggatccattggatttggcatctcgaatgcaactgatacaaaatgtggtattgggactcaactacagcattaccaccagtgatataattttccaaaatgatgaacaactcttagtaaacttctgaaccaaagcatagtcttccctcaaagtacaaggtagttgcattcttgggaaatccagtactttggatagggtacagctaggatctaggctcaggatgttcttatataattactgtataagctggtttctcaccacatgaatgtttaccaggatattcgaaagttgtggggaatgtgggactctacagagcattttgcattaaaggcctatagcatacctcaaactgtgatgttcaaaataacccccatattccaagcttgcatgattattagaaaaaaaaatacatgtccagtgtgcccctacagaaaggtactatcataatttgagggccctgctctgacctttctcttcacagctattaaccaatgagttgacctgcagtgggatgaatgccatagctctgtttcttcttcaaacatccttgaacactattcctccctccataagctcttagagcaaaagcctcaggccatccactcttgtccatagcaccccatttacacatcctcacaagctccacaaatatctagatttcaaattccaatctgcagccgggcacagtggctcattcctgtactcccagcactttgggaggccgaggcaggagggtcacttgagcccaggagtttgagaccagtctgggcaacatagtgagaccctgtctctcttaaaaaaaaaaatccgatctgggctcagctgagatgacatactacatcaaaatgacgagactcttttttcagctccagtatttttatgccactaaatgcttcaatgtactcagagaacttgtgacttcctaacactaaaccacattctagtgaggaacttaatatttccctacatttactctcacaaagtctgctaacccatagcaggcgtgcccatcctgaactctggcgactatgcgctttgtggtcttttcttcatgtcctcaatatggacatgaagaaagggactgaggaacagagacatcagcaatagagcctacaggagaaggaagggagacaggtgctagagtagagagagtcttagggctaattcaagtggtagattggccaggtccatttctccatctgggcctcagtttcctcatcctaaatgaaaaagtgtattaagtgatctgttagaggaattccagctccaataacctatgattccgtagatctagataaacccacaaatcatattagtaaagcacaaactgaaagatttcatgttgactgcatctcctttgccaagggcatgatgcatccagcagagaggctgctgcatataacatagtgcagatagagaaaccagcagacttttgtgaaaatcacgtggctgcttggaattcactgtggtcagaatttacctcatagaatgagcaatgtgatgaattccaagcactgatgtctttgtgtcatgttcagcgctgtaactctaactcataaagaaagtctaccagaggaaggcagactgtctccccagacaccccgatgaaaggaggcattttacctccttttttatgtctttgcttggttttgttgtctctcttccccagcgaccactttgggaacctgaagaaactgtggtcattgccttatatgactaccaaaccaatgatcctcaggaactcgcactgcggcgcaacgaagagtactgcctgctggacagttctgagattcactggtggagagtccaggacaggaatgggtaagtcatctttgtggctgctgtccccgtgtttgaggtgtggtgcgaacaaataaaataccaggatgatttgtcctatctcccacagtgtaaccacagcactgaggtgggagaagagagcagaggcagaaggaagagggaggaagaggaagtagttgaggctcatttttcctcttctcagaagtggctctgaggcagtcacttgctatgcttgttccctgcaccccatctcaggcactccagacccaaactcatctaaaaaaccccctggatttttccactgacatctacaatttgggagcttggcaatttgttctgcaaagtgctattgttcctgagtgttaagtgaggctgaaggtacatcccattaggaagtgcttatttttggtgaaaagaaaatgtgtgtatagagatggtacagattgatagttatgttaggacgcatcagaaagaagacactaaagatttagttacaatcgcagtcattgaactagccatccacatgactcagggagaaaataaggttgtacaaatactactttcccactatgcaacttttgaatgaaaaaaataccaagcatgagattcacactgccttttaaggtttttttttcctcttaatatatccgatgtattaacccatgctctggaatattttccagaatctgagttcaatagttgcatcaatccagccataaatgtactctaaattgcaaattcccttgttgaacacttaggttatctccaatattttgcaaatattaacaacactgcaacgaacatctttgtatattaatattaggggtttaaatgttttcaaggtatgaggttattattaattttaaagtataaaaaagaaaactgtccttgcaacatatagatcatttatgtcaacattttacttaactaacagtagagagaaatatacataaaaaataagccaccctccatttgcccccacatcaagtccaaaagtaatcactatttggccgggtgcactggctcacgcctgtaatcccagcagtttgggaggccaaggtgagtgcatcacttgaggccaggagtttgagaccagcctggccaacatggtgaaaccctgtctctactaaaaatacaaaaattagcatggtgtggtggctcaagcctgtaatcccagctactccactggctgaagcatgaaaatcacttgaacccaggagggagaggttgcagtgagccaagatggtgccacttcactctagcctgagcgacagagcaagactctgtctcaaaaaaaaaaaaaaagtgatcactattaataccttcttgtgtatcataaataaaagttatacctgtgcaaatgcatccttttttcacttgtaccaagtggatccattctgttctgcatcttgcttttaatttttaatgatattaatacacattgaagatcttttcataccagcacatgcaaatctacctcatttttaaaatagttgcatgggccggccgcagtggctcaggcctgtaatcccagcactttgattgggaggccaaggtgggctgatcacctgaggtcaggagttcaagaccaacctggccaacatggtgaaaccccatctctactaaaaatacaagaaattagctgggtgtggtggcaggcgcctgtgattccagctactcgggaggctggggcaggagaatcgcttgaacctgggaggtggaggttgcagtgggccaagctcacaccactgcactccagcctgggagacagaatgagaatccatctcaaaaataatcataataataataattgcacaatcttagaatgtatgattgtattattagtatttaaataatcctttatggtgagacatttagttgccagtttatttgtttcctctgctgtttcaaacaaggctttaatgaagatcttgtattcatgtatcttggccatctttggaatacaaacatatatatatgatatatatttatcacattagttttccttttcttttttttgagacagggtcttgctctgtcacccaggttggagcacagtggcactctcacagttcactgcagccttgacctctcaggctcaagtgatcctcccatctcagacccctacagagctgagactataggcacgcaccaccatgcccagataatttttgaattttttgtagaaatggggtctcattatgttgcccgggcttgtctcaaactactgtactcgagaaattctcccgctttagcctcccaaagtagttgggattacaggcataagccaccatacctggcctatatgtcacatttctaactgtgcaacagttaagtcagagtatgtgatatcttaattttgccacataatttcctcacaaagcttgccaaatttaccttcctgctaacagagttatggaagtgccaagactgggtatcattgaacttttaaaaaaagtcaatctgatgggttaaaaaaaaaaaagaggggcacaaatatctttaaggataagactttaccttttacatacaccagaatttacattttcaaggtgccttctctttaagtaggcttatcaaccccattacagggggaggaaagacagaagtgagacagggtaaaacgtgatgagattcagaaccatggtttgagaggcagtgtggtttgctagctaagaacagaccccaactcccctcgtctggaacctccctttctagttgattcatgaagacaattgagctagtcacatcaccttctctctgtccattatagacaggcccatatccgaaataggttcaagactgtctacagggtctacaaacaccgaagggacctagaaattcattagttcaatcaactgactttacttagcacacctaatgtaccaggaaatttgttctcctaggccttacttccccaaatgagagttaaacccttcatttggtgacctgtggaaaggcttaactatgcacttcaaagggcatcaaagaggacaccccagcagccagtcagcattatgggaatttccccagtttgctttgtgatagtgtggtatagtggaaagcacacaagatggggagacagaggacttggactttatcagctactcttgtcatatgaagctgaggattcacagatgaccatgtcatatgtgtgaccatgtcattcacagatgaccaagtcacttttcctctgtgaatccatttcgtgaactgtaaaatgcagctgataatgtcagctttgtctacgtcacagtgttgagaaaatcaatgagataatggaagtgaaagagctttggaaattctacatatccacatacaactatgagagttaccatttgtgtagatgacccagctttgggtggcatatgctattcaaaagcaaaatattatttgatgcattaatataattgtaaaagtatagtatggcaaaagtagacataattaagggaattccaagagtgatacagaaggaatggcaaatttcagaataagctgactttcttccgttggaatggctgccttgagcactgtatgaaggatgattctgagggcagatgtccaattctccaaagaaagtatgccatgattgattagcaatgtctgccagaggagtaaaatataagatgatcatcctgtatttggcacctacagtcttgatttcttcactcttcacaactctgaactgattacacatttcccataaacataatcactagattgaaaattggccttattataagaaaattaaaacatgttatggaataaagagcaataaactatcaggcatctttttttgttttgttttgtttttttgtttttttgagacagagtcttgctctgtcacccaggccagagtgcagtggcacgatctcagctcatggcaacctccacaccactgcccccacccgccaccacccaggttaggtgagtctcatgcctcaatctcccaagtagctgagactacaggtgcatgccaccacacctggctaatttttatatattttctagagacagggtttcaccatgttgcccaggtttgtctcaaactcctgagctcaagtgatccacccacctcagcctcccaaagtactaggattacaggtgtgagccaccacacccagcctatcagtcatctttttacagattgacagagtatggagtatctacttaaactagattttaagtataatatagtttaagcccttcatttgacgggtataaagtcagaggtccagagagtagaagggatgccgctttcaccctgtggtattaaatgagataatgaatgtgaaagtgctttgaaaactacaaagttatacacaaatgtaaagaagtttgatattcttattttgtttattatgttttttgtttatgcacaattattaattcttgctcaaaagtgactcctgatccccaaatctagcctggctttatcctttttttctcgtgtttataccgttcatatctgaagaagctcaattagggaggccttaaattaaaaagcttacaatgccaactggtagtgtcttttagaatctgtggttggaaagtcatcttttatattttaattattttggtttcctgactataaaatgatagtactaaagtggaaaaaatgttgattatcacacaaaaatgtttccttatagaaaatagacactgaatattaatctttttttccagtagaggaaatttcacaatgaggagaacagcaaacagagctttttaagtaaaatcgccacttctttttttattatgtttcatatttcagtagtgaaatcaacctgcctttaacagacaagttgctattattttttaccaattccttttttttttttttttttttttttttgagacagagtctcgctctgttgcccaggctggagagcagtggcacgatctcggctcactgcaccctccacctcctgggttcaagcgattcttgtgcctcagcctcccgagtagctgggactacaggcatgtaccaccacacccggctaatttttttgtgtgtgtgtagttttagtagagacagggtttcagcatattggccaggctggtctcaaactcttgacctcgtgatccacctgcctcggcctccaaaagtgctgggattacaggcatgagccaccgcccccggcctaccaattcttgtattctaaactttaaaatgtcttatcgcaaatgccaaataatgtgatattccccaatctttaaatgacttttaatggattaaacctataaaatgatataaaacttagttctatgtaagtctaaacattaattttccttttaacaggcatgaaggatatgtaccaagcagttatctggtggaaaaatctccaaataatctggaaacctatgagtaagatattttatttgtttttggaaaatacagtcctaaggaatcctccttaagttaggaataaattattggttgactgtaaaaataccagatgatccctactgcaacagcaatgttcacacataccatccagctcttgatacctaaataaggctttccactaaaaaaaccaggactttctggagaaaaggcttggggtagggatagaacaaaaaggaacttggaacatctttttgtgccagaaagtaaagaagtacttaaaaagaaatttttcttctttaatttttttttttgagacagggtctcactgtcacccaggctggagtgcaatagtgtgatctcggctcatcgcaacctcaacctactgggctcaagcaatcctcagcctcccaagtagctggaactacaggcacatgccaccatgtccagctaatttgtaaattttttgtagagacaggatctcactaggttgcccaggctggtctttaacttccgggctctagtgatcctcccattatggcctcccaaactgctgggatcacaggtatgaaccgctgtgcccagacaaaaagatgtgggcgtgtcagatgagcacagaagttggctctaacaggctccatttgatgaaatctgggacaatttgagtatcaaaataaataatgactattaaaataagtaatagactacaaaccattgaataatataagaatctgtaataaatagatagactgatagataaataaagaagtaaataaataaaaaggaaagggttttttcttatagtagaatgccaactaatgaatgataaagtttaaaaatcatcattttgtaacccagagtatcaactgattcaggcaagaatcctcaatgaatgtcaccactagcaagttaaagtttgatgagctgtggcatatttacatagtctcaaagtatctcctcacaaatcacttgtaattacaaagtggaggtaactagcaggcccgtctgaaacagtcaatccaaatgcacataaataatggagcaaaaaggtatcttgtgtctccttatgtgatgcactgagaagggcacacatcacttctgtgatattcctgctcaaaaaatgcacaacataaatttacttataaggatatattcataaggatatattagacaaatccaaattagggaatattctctaaaattaatgtcctgggctcttcaaaaaaaaatgttaatatcaggaaagacacaacaggctgagaaattggtccacattaaaaaagactaaagaggtcgggcgcagtggcccacacctgtagtctcaacactttgggaggctgaggcaggtggatcacctgagatcaggagtttgagaccaggctgaccaacatggtgaaaccaccgtctctactaaaaatacagaattatccgggtgtgatggcacacgcctgtagtcccagatacttgggaggctgaggcaggagaattgcttgaacccaggaggcagaggttgctgtgagccaagattgcaccattgaactccagcctgggcaacaagagcgaaactccatctcaaaaaaaataatagtaatagattaaagacacatggtaactaaatacagtggtgatcctgggctggatcttgacccatacaaaaaaatattttttgttataatatacattattgggacaaccgatacaatttgaataagatctgcagttaagtaatagtgttatgtagatcttaaatctcatgacttcggtaattgtactgtggttagataagtgtatactctgtgtcttaggaaatagacacagaagtacttaggaataaaagtcaattctcaaatagttcagaagaaaagtcaatctatgtctatctaaagagaatagtaaagcaaatgtataaaatatcagcaattggctcatctgggttatgtgtatatgatggttcttttacactattttacagcttttctgtaagtttgaaattatttaaaaattttaaaaaattaattactcactaaatataagataccaggcctaaagaataaagctaatgaggacacctattaacgcattagggttcttaattcaaatgtggtcgtgttatttgttgctgaaattctagtagattctttagtgaagaaccgtcattttctggagtctctcaaccttgtttgttttgataaagtatgtgtgagtagcccttccctcagtgaacagaagggtcatcagttctaagaatttttgagctgaaataaaacatatagggtatatgcttaaataaaataaaaaatctttataggcaatacctttgaagaaaaaacaataagcatttatttcaaatgaccactaggctatgtagttttgtttgttcaactttgcttttaatcagaatctctttgtttatgatcaaaggagcaaactcaaaattccaacaggataagcaataggaaatggtgaggtctggagcaaataaaaaaagtcattcacccacctaaaggtattttaagccattttaaaaataaaacactataccatgcaaacaaaacaatctagttatactgtgcactttcagtttgcattctccagattatgaatctcagctggaaaataacatgacttacaagcaaacattcagatatttagtatataactggatatatgaaagattccagtatgataactttttattcgtgaacttagtgttgtctagtttcaggtgagatctgcctaagtacttaaaaatgtaccacctggtaacatagtcatgggttggtaaattgaatggattcaggtctcctgccttggtttgcagccatgaccttgggcaagttacctcaccctatttgagttctgatcccttctccataaaatgaatgctcagacaagatgaaggaaggcaaatcatgactctcttgctggcattcccttcccatgcactgaactcaggcagacatcaccctttgatagtgaagctatttacccaccatgctggtgacaaccttttcaatgcacagctctaggcagccactactatcgctgatggcctgtgtgtgagatgaagcctatattttcccaatcctcgattagataatctctaagagcccatgttggtgtcatgtactgttctgtcttataatgttcaaaacctctaacgaatccatgaattcctttagtcatggctactctcaagtagccaaacaagtttgttaagtggtattccttccctacccagaacttctctcctcctgcatttattaattttcaaaactgattattaaccgatgatcagtctgcctcctcttacctaaaaagcagccagagaggttaggatgtggctaaatattgttaacaacataaaaaaaaaacttcatccctaaaaatcatttatattcttctttaccattttatagttgtttttcaccagacaacaaaattataaaaataatgcaattacttggcagaatgtctggaagagcagtcttaaagaggaaaatactacagttgttttaaaaggatatttgctaaactttcaaactggtattacaattttatagctgcactagcaccctcctccttataacgaactgtctactgacttatgaaacgaagaggaaaattaatgttttctaaaactttattttagaaaatttccaatgtatacaaaagtaaagataataatataatgaatatccatgttccccaaacctagcatcaacaatgatcagtattttgccaattctgtttcatatgtttctttccaattaaacattttaatacctggaaatgaatcatgcatttgcttttgagtttaaacgcactggtagaaacatacgtgtgcagacttgttaaataaataaaatacacttaaaatttttttaaagcactggtagaaatagaaaatgaccatatgattttctagcattgtcttttataagtaaataatgaaactttaaaatatgtcattgacatatgacttttccttgctttcaggtggtacaataagagtatcagccgagacaaagctgaaaaacttcttttggacacagtaagtctccttaacctgtcttttgacataaaataaaatgaattaagtgcactgtctcatgtctggaatcccagcgatttggcaggccaaggtgggaggatcacttgagcccaggagttcaaggttacagtgagctatcattgtaccactgcacttcagcctgggcaagatcaagaccctgtcaaaagaagaaagagaggaagggagggagggagggagggaagaaaggtaaaaatgaaagaaagaaagaattgtactgttttttcagctttgctgcgttttatgccaatgcagtgggttgacatgttggattaacgatagttttcatgtctggtgaaaatattctgggaatttacaggactagcaaaccacaggataagaaacctgggcttggcattgacgtggagacatcatcaccgctgcagcagtctttgtgagtggtgatggctggccatggggtgccatcagggctggtcagtcatgccttcttctcagtgtgggtcagagatgtctgtgactctgattcggcctgactcagctgtgagtccagaggaaacatagcacttgttttaacttacatttcatcaacagttatcctctaaagccatgcagtgtgcatagcaggaccgattttactcagggatgtcaagattaagggcgaaagggaagagaaaagtagaaaagatggtatggtggggcaggtactgggctctagttcctgttatgtcaccaactcattgggtgactttggggacctctcttcttccttctgggcctcggtttctcagtgagtagaagggcagaattggattaagtcagggatcacagttacccagccctcatcctgccactttctgctccttgtcctgtgaccaacacagctgatctcagtccatggcattgggactttattgggaaacaagacaaatgcagaaaaaagagcaagggaataatctaaaataaactaaggtaaactccagaggagttgggaaagattccatgaagaaaaagaagttgagctgagtccttactgaactctggtctctccttggctctacatcaactcagcacttaattatttcctgtgggttccccaaaaaaacacacattagaattgctgggaaatgttcaaaaatacagattcccaggtcccaccccagatccacagaatcagagtctctagtgttagttcccgggaatctgtactttctcaagttaaatttacaatgcaaatgtagccaactcaaacctggcgctgccaggctgtgttattggataacaaagtagaacttgattaatatgaactaattgagtggagtgcaaaattagctaaaactctgaattacactgtgtttaaacaagtatagttttgttatattaatcacacatcagttaatgacgtctatggagcacttcaaacagcccacattaatgacttctaaaagatgattcctgtattacagcagttcttgtgaggtgctaagtgctaagtacattttgcttgctctggcagttgaaacattcctccttactgatacatatatatatatatatatatatatatatatatttttttttttttttttttttttttttttttttttgagacagagtctccctctgtcacccaggctagcatgtagtggcatgatctcggcttactgcaacctccgctgcctgggttcgagtgattctcctgcctcagcctcctaagtagctgggattacaggcatgtgccatcacacctaactcatttttgtatttttactagagacggggtgtcgccctgttggccagactggtctcaaaactcctgacctcaggtgatccgcctgccttggcctcccagagtgctgggattacaggcatgagccaccacgcccagcctccttactaatattttgagctactttaccaaattctcttctcctccttaggtaaatatgagggcaaacatcaatgggtccctgtcagactcagcccagattctggatagaattgaatgacattttcttgctatttttcactttttttgtgtgctgtttttgaaacaatagctgtattatttctaggtgtatttagagtctttttatctaataagtataggacctttaagagatgaattcctgcatagtattccatggcgtatatgtgccacattttctttgtccagtctatcattgatgggaatttgggttggtaaaaggatgagttcatgtcctttgcagggacatggataaagctggaaaacatcattctcagcaaactaacacaggaatagaaaaccaaacactgcatgttctcactcataagtgggagatgaacaacaagaacacatggacacatcacacaccaggaacatggatacatcacacaccagggtctgtcagtgggtggggggctaggggagagataggattaggagaaatacctaatgtagatgacaggtttatgggtgcagcaaaccaccatggcacatgtatacccatgtaacaaaccttcatgttctgcacatgtaccccagaacttcaagtataataataataaaaaaagagatgaattgattcattacacctttttatgaactaaaactcctggtgtactgccccatacatatttcgccactagactataaacaatttatcttgttcctgctgtacttaggcacccaaaagtgtatctagcaccttgtagttgttcaataaatatttgttgaatgaatgaatgaatacactgaaggcttaataaatgtttttaaactaacaactccacttaagggggacctgggtgatcataagcatcactgcaggagctttttaaaaatacaaattcctggactccaggcctatccagtcagaacctcaagaggtggcacccaagttattctgggacttacctacatttgggagccactaaaaagcatctcctaatgtgccatatcagttcttccaatgttgcctcctcccagaagtctctcatgccttccctcgccctagctatggaacgtggtttttcttgtctttgaacctttatgggtcaaatgttattatcagtattattacttctccagtggctctgttctcactctgcctccaatctcagcagtttctcttctgtctttacccatctaggtagatggtaaattccttgcaagtgggtaactctcttagaacaccttacaacatctcacacatagggtgacctgaagttcagacattctaaagtgtcattgaagactcaatgttgacttaataattggtttgtttcaagagaagaaaagcaccacctccagaatgaaagatggctgtatttcagagacactcttaaagtataatgcagcataacaagactatgaattatcagtccatctgttcacaataacttaccctgtgtgttgagattatcttctgaaaggtcaccttcaaattatatgaacagaaagaaagaaaaatactcctaacacaaccaacatgtctcagatggagactgacaatggaataattacttccaataagtagcaaacttagcatgtgataataatggccaataatactctaatagttcttgtcctagtattgtattccaggagcaattctaggcacattacctcagttctcccatcaaccttccaaaggtcattttacagatgaggaaactgaagctcatacagttactcatctttataagttccttttaaggccaggcacggtggctcatgcttgtaatcccagcactttgggaggccgaggcaggcggatcactggaggtcaggagttcaagaccagcctggacatcatagtgaaacctcatctctactaaaaatacaaaaaattagccaggcgtggtggcgggcacctgtaattccagctacttggaaagttgaaggaagacagtcacttgaacccaggaagtggaggttacagtgagctgagattgtgcaactgcactccagcctgggtgacagaatgagactccatcttaaaaaaaaaaaaaaatccttttaaacccagagattctggaattcaaacaaatagcatgggccactgtctgtgtgtgtacacagatatgtgcccacaggcaaaccatcattttagttgtgggatagaaggatttgtgttgttgtagtttctatatactttgttccttatactccaagtgtatgccctccgcacaaggatcttgtctaactctgacctttacttagggccctcattgtgactaagttaagtgaatcataatatttggcttaacaaatgttaccagtgcaagtttacagcggggtaggaacagagtgttagataggaagtacttaaaatagacttcagattttttaatttccaccaagaatgaataaaatggtatgtccatttattagtgcttatttcatcagtgctggcaaaactgtcagggtggcgaaagttacattctcagggcactcccttcttcccacctctctcatgaaaccaggagcttaatgttctttttccttccgccctgcagccaaattctcattctggaaagggcctaagaaatatattatcattaagagaatccttatacactgttggtaggaatgttcattagttcagcccctgtggaaagcagtttggtgatttctcaaaaaactaaaaataaaattattattcaacccagcaatcctattacagggtatatacccaaaggataataaattattctacctaaaagacacctgcactattcataatagcaaagacatggaatcaacctaggtgcctatcaacagtggactggataaagaaaatttggcacatgtacaccatggggtaacatgcgccctgaaaaagaacaaaattgtgcattctgcagcaacatagatgcacctggaggaattatcctaagtgaattaacacaaaaatggaaaaccaaacaccacatgttctcacttataagtgagagctaaacagacatcaagatagtaacaatagacagtggggactccaaaagttggaaggaatggagagtggcaaggatagaaaaactacctattgggtaatatgttcactatctagcaaatgggttcaatagaaacccaaatctcagcaacacgcaatatgtccatgtaacaaacctgcacacatactccctgaatctaaaaaatttttaaaagttatatattcccattaagacactgatgaagttttcaggacagttttgtgcctttgtagggaaatggagaagcagcttctaacattctttgaaaggaggcatcctggagtagtagaccaaggctgggctttgctcacataccagagttcaaatccgaattctgtcactttctagttgtgggtcgtgggaatgccacttaagctctctggcactcagtgtcattggcggttaaggataccaatatccagatggcaatattgtggtaagagttggaaaatatctgtaaagagtctgatacatggggagctctaaaagggcagagcttatgtctctgtctccattcatggttcatgtcagcatgagaacagtctgggatccatgtaggagaccaagaaatatctacggaaggacaggagtaaatgaaacggtagccattcttactgaaatctgctctatgccaagtgggcctacagtatttcctccttctgtgggcaagaaagtggagctggaggcataagcctggtttcctgagatcactaactttccattctttctaaccattccagggcaaagaaggagccttcatggtaagggattccaggactgcaggaacatacaccgtgtctgttttcaccaaggctgttgtaaggtatggagctaactctgctcagcaaagtggagagaaacacttctgaagtgtgtgagcactggggaaaagacaacaaagttagacagtgcaagaggtagaggctcactagaaatggtctgttttccctctttactccgagaaaaccaaagccatggagatcaaggatagaacttaagagacttagaaagtgacagagctgggagtggatgccaggtcctctttcaattagcatctccaattttagagttctaaagacataaaatacttggcactgtattggatgagtatataatttaatacatagaataacagaagagatatttctatctggaagcaaaaatatatgaactccagttctggctctgctcataaaactacctaccattaactgagtctttattatgtgccagaaaatatgcagaccatttccaatcctaagaagccctgaaggcaggtattactatgctcatttcacacagaagaaaccgaggttcaggagctgatggtgcctccctatggccgtgggtctgaaggggccaagccacatccaggctccagccaactggactgcaagatccttcctgcttttctgcccctctgtacctgtttcttctctgtaaaacaatgcctaagaacctatctaggtctcaaattcccttctaattagaacatttgttagaactaagctgtttgacaatgaccaaagtgcagtcagaattaagagaagagacaaataatttttaaggtgtcttcggaaaatttttttggaagactgaggatgtgagcaggacgtggagcaagggcaggtggcaaagaggaagggcccgatccagggataggagggaacacagtgtacatcacagaggggccgtgcctctaccatggctgggagacagtaaggaggtgacctgcaaccccacaggtatgacggagaagggatgaaacaaagtctgtgtcgaggctccccacaactacccccagcttcagggattcactaggaggccttccaggacaaagacttattgagatttaatacagcaaagtgatacaaagcaaaatcagcaacgggaaaagacacatgggacaaaatctagaggaaacaaaacacaagcttccaagagtcctctcccactggagccaaacaggacgtgcttaattccgccagcaacaagttgtaaccacacgttagcagtctaccaggggagctcattagagactcagtacccaaggcttttattggaggctgtttccacagacagcccctgcctagcacatgccaaagttccagatacccaaaaggaaaacaagcgttcaccataaaacacatgtttctagcagacggtttaggtacagctcgccacccttatcagttagggaaagagccctcccgaaatccaagttcccaaacaccagccaagggttaaccatgcaagcaggtctttctaaggagggtagtcaggcctgttatgttcatcctctgcagcttatttgacttatgaagtcaaataagggtgaaggggtcagagaggctttctcaatgtatgctgacaatcagttaaattcatagaataggcaaggcaaacacatagcaaatatttccattccctcattttgtggcaatggaagaaccatcaccaatccatcacagcattgctgtccactgggtccagacacaacctcagagtcctttttaacacagtactgcagcacccaggcccaatctgtcaagacagacttataagttgaacaatatctgccaccttgtgagaggttataagacaaagataataagaacttaatactcgtagacttttttgtgtctcaacattgcttcttaataatcattacatttgtgtttcatttgtttaagtgagaacaatccctgtataaagcattatcacatcaaggaaacaaatgacaatcctaagcgatactatgtggctgaaaagtatgtgttcgattccatccctcttctcatcaactatcaccaacataatggaggaggtaagctctagagcaggggtggacccgggccgcccagcaggaggtgagcagcaggtgagcaagcattactgcctgagctctgccttctgtcagatcagcgtcattagattctcataagagtgcaagccctattgtgaacagcacttgtgggatctaggttgtgtgctccttataagaatcaaatgcctgatgatctgagatggaacagtttcatcctgaaagcaaccccctgccacatccctccatggataaactgtcttccacaaagccgatccctggtgccaaaaaggttggggactgctgctctagaggacaaagccagagggcacctgggttagacttttttgaattgctatcaaggaatacctgaggctgggtaatttataaagaaaagaggtttaattggtccatggttgtataggaagcatggtgccggcatcttcttggcttttagggagccctcaggaagctttcagtcatggcagaaggcaaaaggggagcaggagtatcacatggcaggagcaggagcgaggagggagaagatgccacagacatttaaacaaccaggtcttgcatgaactcagagtgataactcatttattatcacaaggacagtgacagcaccaaggcatttgtgatggatcccacctaatgacccaaacaccacctcccatcccaccaggccccacctccaacatagggcttttcttttcttttctttcttttcctttcttttcttttctttcttttttttttttttgagacagagtttcgctctgttgcccaggctggagtgcagtggctcaatcttggctcactgcaacctccacctcccaggttcaagcaattctcctgcctcagcctcctgattagctgggattacaggcatgtgccaccacatcccgctaattttggtattttttgtagagacagggtttcaccgcattggccaggctggtcttgaactcctgacctcaggtaatctgcccgcctcagcctcccatactgctgggattacaggtgtaagccacagtgcccagccagggattacatttcaacatgagatttggaggggacaaacatccaaactatatcagcacccacacaggagacttaatgaaaactggcaaaagctcgccctggcttctttttgactataaataataaataaatatacaaatagaaaaatatgacaaatatttaattatattatatatcttctattagcaagctatcttgtggaaataatggaattttaccacttgcccatctgtgcttatgatgttttcaaggaggatatgatatcaataattaggctttgggatttgttttccagaataaaattagcttttgcgtctgatgatgattattattttttttagtgatttaagttagatggttgctagagcaaagccctaaccactgcttcttggcttttcaatcaacccaggcctggtgactcgactccggtatccagtttgttttgggaggcagaaagccccagttacagcagggctgagatacggtgagcagtacaatcaggaatgtaaactcatgtccctaaaggtctggggcaaattctgaataaactggccatgagcctacctgttcctcagactacaaatcaccattaaaacaagtgtattatatatctagagatgatggcactaatgaatatttacattgtgtgtaagagaagtacatatacaagcacatttctctaggtcaaaccagtggccattggttttagtgaagagttcattaatgaagtgtttattaagcacctactttgtacagagcaccctactaaatgctattagaaaaatattagaaaaccatgccttagcactgtgtttccacctatcttctagaacttttatatcatctagttggttgagtagcagactattgccagaactgcaagttgagagcatctagaagtgtttctctgcataagagagtgttaaaattctttggaatacctttaggcgtggcatgatctccagtgccgcagcccctactatgttttcttgccctacggaattgcttcactcacttgggattacctgcctggactctgaaggcatttggctttgcatcccttggtcccaactgtgtgctgcctgtggagaaggctggtctaattttcatttcttatctcctagcttggtggttctcaaatttcagtgtgcatcaaagtcttctagaatgcttattaaaaatgttgactcctggctcctatccaaacactcaccaaaacacaatccttgatagggtcctggagtctacttttttttctggcatgatctccctctgtcacccaggctggagatgcagtggcgtaatcatggctcactgctgccttgacctcctgggctcaagcgatcctcccacctcagcctcccaagtagctactatgcctggctaatttttaaaaattttttgtagagacagggtctcactatgttgccctggctggtcttaaactcctgggctcaggcaatcctcctgcctcagcctcccaaagtgttgggattacaggcatgagccactgtgcccagctgagtctacattttaaacaagcatgctaggtgattttgatacaagtggtcagagggcaatactttgagaaccactgccacgcatgggcttctttatccctaaccagcaccgtgtccggcacacagtaggtgctcaatactgcctgctgttgagtctctgcctcaaagcagtggaaatctggctgtttaggtaccagaccaagcactggggaaagagtgcctctttagcctccttatgaaaataagggtattctaataaatgtagaatcttgatgtgtccgtgctggatgggatttcagatattacctggtcagcctactcattttgttggtgaggaaattgagcctcggaatctcgtatttgtttgttaaacatttcttgagagcctcccatgtgccagacactgtgctagcttgtgcctctgcacaaattctctttaaatctttctctttaactgcccctctgccccagtaaggcctaatagggttatgtgtatatagcaggtgctcttaatagatgaatgaatgaaagaatgatcagctcaatgaaatttacttagtgtgaaaaatgacatagaaaaatgggacattgcaagaaccctttctttaatattttgattaatatggtttctttaatatcttcattaatgccactctccttctttccatgttaccttcccacacatattttcatagttttctagcatatcctatgttattatgtgggaaaaagataatttatttgccatctttgaattatattaacaataggctaaaattctagttagggctttatagtcccctggtatcccaataccttatatctactgcttgctgaccccagagaactctctctctctcttccagggaaatgggtgatcgacccctcagagctcacttttgtgcaagagattggcagtgggcaatttgggttggtgcatctgggctactggctcaacaaggacaaggtggctatcaaaaccattcgggaaggggctatgtcagaagaggacttcatagaggaggctgaagtaatgatgtgagtgctcagaacaaggatatgcagaaactctggggggaacatcggttcagtgttcttgaaatgccattcaaacgccagggggtactatctccctgcgcaaactcccagcagtggcttcctattgcacagagaatacaatcaaactcttcacagtggtctccaaggcccaccataatctgatcatgcccacctcccccttctcagctcctacccatctctcctccagtccatgacatgccagccacactggcctctgctcatcttcacacacacagctgactccttgccatttttcaggtctcagctccaatgacatgtttttgttttggggagggaatgaatattattttcatccaaaccataaattagacaaaatgaccattggctattttggtaccataatattttcggcatttttgggagactgagtttaggccatctcaccccttgtctttttcctccaggaaactctctcatcccaaactggtgcagctgtatggggtgtgcctggagcaggcccccatctgcctggtgtttgagttcatggagcacggctgcctgtcagattatctacgcacccagcggggactttttgctgcagagaccctgctgggcatgtgtctggatgtgtgtgagggcatggcctacctggaagaggcatgtgtcatccacagagacttggtatgagcatgcagggtgaacacccacaggtccagggtaaagggacagttctcactgaaatgactgggaacgcattaataaataatacattacagataatctcctttcctttctcaacttctcccttccttcacctactttgggtggtcctagtggaaagggcttcatgaggacttacttctgggctctgatcccagcccaaactctttcacctcctgcatttcagtttatattcttccaaaatggagataactgccactccttcttaacctctctgtgactcaatttcctcctggtaaattgaggaaactgagtttgtctgaaggtattattcaagggtctaccagaatcacactggggaagcccttaagctactctcagaatctctggtggctgggactcaggaatattcattttaacacattccccgtatgatttgtatgcacattaaaatttgagatatgcagctgggtgcggtggctcatgcctgtactcccagcactttgggaggccgaggtgggcgaatcacgaggtcaggagttcgagaccaccctggccaacatggtgaaaccccatctctactgaaaattcaaaaaattagctgagcttactggcgggcacctgtaaccctagctacttgggaggctgaggcaggagaatcacttgaacccaggaggcagaggttgcagtgagctgagatcaagccactacactccagcctgggtgacacagtaagactccatctaaaaaaaaaaaaaaaaaaaaaattgagacacactggagtgttatctccaatggctttttcaatgcaacagtctataatactaattaggggtcaggtactctccctattgaagaacagttttaagaggattaacaacatcaaaacattcttaatttagtcaactgggagatgctttcttcctgttatccctgatgttaacatttcctatcacatcaggttgcattagagcctatctttggttagacaacaccaaggatttctaattagaactcaagaatgaagataaacttactcatcttgatagtggatcttacacattcaactttccagttaacttccagcggcatttgtgaggcttaattaacatttgtaaagctccatgatgcccttgtatgacagcactgcagtaaagcaaaggactgtgattataggagactccttaactactgatgactcatcaacagttttcctctccgcctttgtttgcctgtctcctctccaggctgccagaaattgtttggtgggagaaaaccaagtcatcaaggtgtctgactttgggatgacaaggtaaaagagggatgtggtgccggtgaagtctcaggaatgggactgaggcccccggaacattctgaccttctccctccactctcttcccaggttcgttctggatgatcagtacaccagttccacaggcaccaaattcccggtgaagtgggcatccccagaggttttctctttcagtcgctatagcagcaagtccgatgtgtggtcatttggtgagtgtcatgctgggccccactgccccatgatctgggcttcaggccagctgtttcctttatcaaatgcagacaaccctacccacactgaaccctgtatcatatcatgagggtgtcccactggagggttgtgtaagaaaggccccgaaaactatgaaagggccttcatcattttgtttgtttttagagatactggacatggtggtgggagttaattaaaagtggaaacaagagttctggtgccagctgctgtgaagtcaaaagctggagaagtcaggagattcaaatatgagccccttgaaggcagggaccatgttttgtccaacactacatttccatacttatctctcaataagtattaatatttattcattcattcaacaacaattaactgatcatctattctatgccaagggctaatctaggtgctgaggatgcagtggttcatagaacagaaaagacttctgttcttttggaactaaatttgagatgggaggggagacagaaaatcacaaaagatcataataacagtcataaacaataataataataaacaagctaagggatagaagataaagccaggcaatcataagtaggtgctatgaataaaataaaacagtaatggggcagagtgactaggatagagagagggtctgctttgaatagtgtggtgtgggaaggcctttctcagaaggtaattcttcagcagagacttgaatgataggagggagctgtcaccatttgaagagccagggaacagtgtccctgacagagggaccagcaagtgcaaaaacttggtgcatccaaagaacaaggggtactgacttattgggagaacaacaggcaatgaagctggtaggccatcataaggaattagaatttctaaaaagtgcaaatggccatgaagggatgaatgatgttggtattgcaggatgtgccaaatgttcttgctggatttgccatgtcacctgaagtcatagtttgtgcatactaaagtgtgcaaaaaaatataccagacaacctctttgatttggattacaagaattatactgtggacagaaactacttgaagattgatttttgccattcggtatgaaggaagggtttgacaagggcttactagtagtagaaaccaggggggagtttggctaggtaaatcttttaggagaagaatgagtgttaaaaatcttctgcagcattttagtctatccatctctaggagccaagtggtttgttcattatgagtcctacctatttcttaaaacagtaccctattaaccaacccttgcagctactttgttaaccaggtttaagttacagaatggacttgaaagaaattgtactaacagcatttttggatgactcccctctccccagtgtgtataactaggaaggttggggctgatgtgcagtcatctcactatgggtgatgaaactgatcacactgcaccaagcaagcaagggccccacaatgagacatttggagcaatggccactttagcacattcaccttctgactctgaatggggtttattcagccaaagggtgtcagcctgggaatttcctggggcatattaccattacagggttgggctgaaattagtccctgtctaggatatattatctgaagagagtccagaaatgaggttgatggatggatgcagaattgagagatcaatggaaaaaagtgtgaaaaaactgggggtaccagcctaagcaacagaaacctggatgagctgaaaactccatgcctgcatcagcccattggactttgtcctacgttttaagtttctttgccctaattagcagtgtgctattcagaacaagtcaacctctttgtactttgctcaatttttttatctatacatttctcatctgtgtattaaagcaatcattctgaaaccatgtttcagcatcggcacattttcaaaaaaattttcactaaaaattatggtgtcttggggtgataagcattcttatttagggtcaggttctgaatttccaactcctgaggcacctctgagtaacatctagagattctgatccactgggtttgggctagggcccaggaatctgccatttgaacaagactctgagatgatttttattcaggtgttttggggatcatgctttgggaatgtctactctaagattctctggaacaacctttgaaaagctctgaattagctgatttgcaagcagccttcttgctctgacaacctgtgaatatatcagcacatgataaagacaaagctaggtgtcacatttctaccaagggcagaagaggaaaagaaagggattaaatcagaggtcaaaaatagacaagcaaaagatgtgttttgcttggtctacatggcattttttaaattcaagaagttcaactcttaatttttgacgtcttttttaaaaaaatcagaaaatgtgccaattctgatccctcattttcatgtgccatactttggttggagtcaaatcatagctgtctccttaagacagaactgtttatctcattttccacaatcctccccaatcccaatagtgtcacacctcctgcactccattcatttacatcctgcatcttggcatttgagtctacaactcttagttgtagcatttgagtttggtacaacaaagggtccatcttgaaaatccttctccactacaaaggttgggaaatttcagttctttaaaaataggacaggcctaataagcctcaggtagacttgatgcacttctggaggtagcacatgaatcctaatgcaaggagtctgtaatttctagaggcaggttggtttgtttgctgtctgtgggctttgtcattcactgtgctgtgctcaccatttcttgtaggtgtgctgatgtgggaagttttcagtgaaggcaaaatcccgtatgaaaaccgaagcaactcagaggtggtggaagacatcagtaccggatttcggttgtacaagccccggctggcctccacacacgtctaccagattatgaatcactgctggaaagaggtcagtggaggaagtgcttccccatgcattgtcgtatacaatttgaggacctccctccttccctagagaaaggaaccctctcagaaggatgaggcaggagggataactaatatagattagcaacaacatgactttgaggatctgttaacgggatagatcccccatccctaaaggagctgaaggcgaccttaaatattatttggtttgctacataatgtcacaagctataagcatagcttcagagaggaggatggggtgtggcctatgccagcttccttctcgattttctgagaagagaaaaaaagtctgtaacatcataaaaccattaaaagcacaggaagttagttctataacttggggaacaaagttcacttgcactatgaaaatattaaaatggcttaatttgagttcattttattcattctgcatttaaaatggggagccaattcctctgtacccgcccaggtggctcatttaccccaaccttggattgcaggccatggcttgagccccatcactatgagtcttagtctttgctgtctttgctgagttagaaaatcatacatttcagccaaagtggaaagttgctgaaacagagaattaataaaaattctgatcattgtacgacaacaaggtggaatacaaaaaatttggaacactaggattttgtctcagctttaccatttatttgccattaatctttgacaattctctgaacttcctttttcttactgttaagagaattaaataatgcttggtctgtgagttcatagagcttttataatcagaaacaaagaaacaatagagacataaaggagggcataaaacaaatcttatccacttcataaggattagctacaataataataatgatggctgacattcagttggcactttttccctcttttaaccatcatttattgatttttttaaattaatagtctttattttttaacaaagagtacagagttctcatatgcccacctcacctgaacagtttccctgttcactaacatttggcatgagtgtgatacatttgttacaattagtgaacctctattcatacattaactaaagttcatagtttacattaaggttcagtctttgtgctgtagagttctgtaggttttcacaaattcatgtatccatcattatagtatcagacagaatagttttactgcactaaaaatctcctgtgcttcacccatttatccctctcctcatccccaaaccactggcaactactgatcttttcactgtcttcatagttttgcctttctcagaatgccatatattggcatcatacagcatgtaggcttttcggactggtttctttcatttagtaatatgctttaaggtccctccatgtcttttcgtggcttaatagctcatttctttttgttgccaaataatattccattgtatggatatatcatagtttatttatttacctaccaaaggaaatcttggttgttttcagtttttgtgtttgtttgtttgggtttgtggggttttgtttttttttttgagatggggtcttactctgttacccaggctggagtgcagtggtgcaatctcagctcactgcaacctctgcctcccagtctcaagcgatcctcctacctcagcctcccaagtagctgggaccacagacatgtgccactaggcccagctaattttttgtatttttggtagaaacagggttttgccatgctgcccaggtgagttcaggcaatcaatccacctcaggcctcccgtagtgctgggattataagtgtgagtgctcaggcagactggtttccttcacttagtaatatgcctttaaggtccctccatgtctttttggcttgatagctcatttctttttattgctaaataatattccattgtatggatatgccacagtttgtttatctatttacctgccaaaggaaatcttgcttgctttcagttttaaacaattatgaatacagctgctataaatgtttatgtgcagatttttgtatataaattttcaactcaattgggtaaatgcctaagagtatgcttgctgaatcatatggtaagactatgtttaactttttaagaaactgccagaatgtcttccaaagtagctgtattattttacattcccaccagcaatgagagttccttattagcattcattgttttggatttcagtggttctaatagatgtgtagtcatattacattgttgttttaacttgcattttcctaatgacatatgatgttaagaacattttcatatgcttatttgccacctgtatatcttcttggtaatatctattcagatcttttgcccatttctcaatcaggttgtttgtttacttattgttgagttttaagagttctttgtatattttggatacaagtcctttatcagatatgtgttttgcaaaattttctcctagtctgtggcatgtcttctcattctcttgacagtgtctttcacagagaagacttttcaaatattttaacaaagctcaacatcaacttatttattcatgaattgtgcttttgatttacatctaaaaactcattgccaagcccaatgtcacccaaattttctcctatgttactttttattttatggaagttttataattttgcattttacatttaggtctatgatccactttgagttaattttcctgaaaggtgtcaggtctgtgactagagtcattgttttacatatggatgtccaattattacagccctgtttgttgaaaagactataccctttctcctctgttcctttgttaaatgttagtttactatatttatatggatctatatctgggctgatccattaatctgtttgtttattctttcactagcaccatcctctcccattactgtagctttagagtaagtcctaaagtcaggtagggtcagtcttctagctttgttgttcttcttcattattgtattggctctctgggtcttttgcctctccgtataaatgttacagtcagtttgtcaatatctaaaaaaaataacttgctgaatttttattaggattatattgaatctataagtcaagttgggaagaactaatattttaacactatagtgtcttcctgtccatgaacatggaatatctgtccatttatttagatcttctttgctttcttttattagaatttttaattttttctcatttagatcatgtagatattttctgagatttatacccagatatttcattttttggtgttctttagcattaatttcttgatatatttttatatgtgatttattgaattctcaaaacaatttcatgaggtagatactattattatctccattttacaaatgacaaaactgaggttcaaagaggttaaataacctgctgaatgtcacacagctaattagtggtaaaactgagattaaacactagtcccttggattccagaatacctgctgttaacaactaggacaatgtatatggaatacagtcaacatggaagcacatacaaaaatccacaggggatgctgctattaaattctggtttgttttggatttacctatgacgcataagtacaaggaacttacagagttcttttttccctctccagagaccagaagatcggccagccttctccagactgctgcgtcaactggctgaaattgcagaatcaggactttagtagagactgagtaccaggccacgggctgcagatcctgaatggaggaaggatatgtcctcattccatagagcattagaagctgccaccagcccaggaccctccagaggcagcctggcctgtggcatcagtccctgagtcaccatggaagcagcatcctgaccacagctggcagtcaagccacagctggagggtcagccaccaagctgggagctgagccagaacaggagtgatgtctctgcccttcctctagcctcttgtcacatgtggtgcacaaacctcaacctgacagctttcagacagcattcttgcacttcttagcaacagagagagacatgagtaagacccagattgctatttttattgttatttttaacatgaatctaaagtttatggttccagggactttttatttgacccaacaacacagtatcccaggatatggaggcaaggggaacaaagagcatgagtctttttccaagaaaactggtgagttaagtaagattagagtgagtgtgctctgttgctgtgatgctgtcagccacagcttcctgccgtagagaatgatagagcagctgctcacacaggaggccggatattctgagaagcagctttatgaggttttacagagtatgctgctacctctctccttgaagggagcatggcgagacccattggatggattggggtgaacagttcaggtcccatgcttggagcattgggtatctgatgtctgcaccagaacaagagaacctctgacggtggagaaccatgtggtgcaagaagagatcttaggtctcttcttttataccaagctcatcttttataccaagctgtgcaggtgactatgcctcctcttctgcacagaatgcttccaccagcatcctgagaagaaatgattacttctgaaaaacatccttttttccagcctctgggaatcagccccccctctctgcactatccgatcctcatcaacagagggcagcattgtgttggtcaatgttcccttggcgagcaattgaaacttgtttaggccctagggttgagcaattttaaggttgagactccaagtctcctaaaattctaggagagaaataaagagtctgtttttgctcaaaccatcaggatggaaacagtcaggcactgactggggtgcttccaagaggcatgagagtgcctactctggcttgagcacttctatatgcaaggtgaatatgtactgagctaggagacttccctgcaaaatctctgttcaccctgggttcacatccccatgaggtaatattattattcccattttacaaataatgtaactgaggctttaaaaagccaagacatctgcccaaagtgatggaactagaaagtctagagctggtattctagcccaaatctgtctgaccgcaatacacagattctttattcctattcgacactggcttctactgaaaatgaaacggattgcagagggaataaatacaaagatggaaagccagtaaagaagtcagtatagaaccactagcgaatagtgttgctctggcacagaccactgtggttgatggcatggccctccaacttggaataggattttccttttcctattctgtatccttaccttggtcatgttaatgactttggagttattcagttaatgaccctttaattctcacaaccaaccagtcatgttgcttgaagccatttatagacgagcttcaaagcaactttaaaagattcttctgtagaagtatgagttcttcctttaattatcattccaactttcagctgtagtcttcttgaacacttcatgaggagggacattccctgatataagagaggatggtgttgcaattggctctttctaaatcatgtgacgttttgactggcttgagattcagatgcataatttttaattataattattgtgaagtggagagcctcaagataaaactctgtcattcagaagatgattttactcagcttatccaaaattatctctgtttactttttagaattttgtacattatcttttgggatccttaattagagatgatttctggaacattcagtctagaaagaaaacattggaattgactgatctctgtggtttggtttagaaaattcccctgtgcatggtattacctttttcaagctcagattcatctaatcctcaactgtacatgtgtacattcttcacctcctggtgccctatcccgcaaaatgggcttcctgcctggtttttctcttctcacattttttaaatggtcccctgtgtttgtagagaactcccttatacagagttttggttctagttttatttcgtagattttgcattttgtaccttttgagactatgtatttatatttggatcagatgcatatttattaatgtacagtcactgctagtgttcaaaataaaaatgttacaaat
